United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 53

SEQ ID NO: 802 - DNA, 516560 bp, Homo sapiens
cctgactgctcggttaggacctcggagagcgccaggcgccgcgaccagagggcccagagaagcggccggagcccgcctacctcggccccctcagcttcccgggctggcaggcggctagaggcgtctgaggaaggtgcctaagtcctgggtcagatagtcatccctctgggacgccgccgccgctgccgccgtccagctgtggctccctcgcacctgtgtgtgtctgtgtgagtgtgtgtgtgtgtttgagagagagagagacagagagagacagagacagagagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtccgcccttaagagagagacagagtcttggtctgttgaactctggtttgattgtataataatgatgatataatgctaatgacgatgatgacactgccttttatttttaccccagtgctgataaagcgtagttacagctggggatacagtccttgaaaatctgatgtgtgaggagggaatactgttgcttttggagttgtgttatatttatctttttttaaaaaggatatgctttttagaattaaaatttggcaaaacgaatcctgactctttttttccagtcggtcgtaaccaatgctcataaaatggggactgacttgactaatgaaaagagaaaggcttttaccaaggtctaattgcacgtgttaagtcacctctttccctttttttcctttgtatttctcaacagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaaggtaagttttgaattggcttaaagcctattatttctttattatactgttgtaaggaaacaaggggggaaaaacataccaggaacaggaaactgttgagatgtcagcatcagagtctgctgcagaaagctctgtgggtagatcagtttggcttaatagatattttaggcgtcaacttaaaaagcaatgatagtttaagtgggaaatgagcacacacaaaaagtagaatttgcaagataatgttaagatccaatagtggacaaaatttttaatatttgtgtattatattaactgaagaagcaaatagtcgtttggttttttgtgttatcagagaaaatattgttatttcactgttcagtatgaaatgaataaagctactagcatgttgctaggattaagtagataataggaaaatatgttcattttaagggggccaatgacattgctttaaaattccgaataaaaacaccttcacattcttaaactcttcataaatacacaaacagacaaatgcacaggcttataagaacttgcagttgtaggaactcaaaaatagcgggtgttctggtttagtaagaaaacattttatgtaattatactttgatattgaacttctaatgaatatgcaaaagagagtttctggtaggtagagaagatgagagtttataaaacaagcattaggttaatgcatagagatattgttattgctatatttgttatattttatgacataaagtgatttataattttattgcccttttttgagttgtcttggaatgtgcctattatatgcaacaaaggctactaagttatttatgtcatataaatgaatatagttttgtaaatgtgtttggctacataagaaatagaaaaattgcaaaattacagaaattaacaatttttaaaaatactttcacaaaagaaaagttttttgaaattattaaaattatatttgtggtaaacaagtgatatatgtataatgaggtatatttcaatcactgtctcagcctatattcctagcagggtcattataaaaacattaaatctatagttattagtttacataaaagcaagtttatttagagttaatttagataaacagatttaattctaagctactttgtgaaatttgtgtacagtaataatttttttcctcaataggaaataacagatattctgttcgatgagggaaggtcttaacagtggttatgagacaaatgtaaaagagtcctggagttcaaatttgaactgctaggcaggggaattatgccctgattctctaatctttgatgtgtttgcaattttcacgatcagattctgaaaattttttccaaattctctcaattcatgtatatgacagtgatacaggagaattttaccagaggtaaaactggtataggaaagatagacttctgaaacagaatggcattgggctgttgaggtcataaagcttgtagagaaggttttaaataaaaaacttcagggaaatgggtgaatgcaagagataatggaatacatagttatcttcccatttattcaggcaagagatagtcataggaagtaccagaagttaaatacatactactttaaaaacatatggcatggtaggaagagcactggcctaggaatcagaaaatttgtgttttatttaaagttctgctagttgacagccatatactcttgggtaagccatttatctcccttgagccttgatttctgcatctgcagtgtaggaataagtgtatctgctctccttaactaagagacggttattgggaggatcagacagaataaggtgaaggtaatgcataaatggaaaggatgataaaatatatacgaatattattgttaaagtttgtaaaatcacgtgttcatagtagagcgaatataactagtgggttataataatattagcttatgatttccaaataaattataagatagatagctatataagttgtccactaacagtactgaagtcttactaaatgtggaaaatactgtaacatctttggataggaatatagttaattttaaaaaatagttatatggatgtattataattacctggtctataacaaaacatataaaaatggactaaggaaatcccaaaattagaccgttactgaaatggggactttatttagactcatagactccctgattaaatgtgcaaaaaaatttctcttctgagttctaaggagctgtcatattctgggtgcttctaccttttcaacatgggcaaaactaaagtataaatctagacttggctgtttgaaagcctcctctcttctatctgattagtcatcacatcccctctattctatttccttagtatttctgaaatttatgaccttttctacatccccagtacttgttcgttccgtcatattttcttgcttggtcttttgaaatcactttctaactgatctctttacttctagttttactggattacacttcattttgttacaataatggctatttctgaaatacaatgttaattatgtcatttccttgctaaaaattctatattggtttcctacagcaatgatgctcttaaaatgaaagtcttatttgaaaccacagtaaataacatctattcaaacaaaaaaatgtggcaactcatgggcacacatttgtttcagaaattataagaataaattatacagccaattgataaaaaaactttttatatttgttttttattgtgtaatatcgcccataggaaggtagtaggatgttcgctagccttaaaaaagtgaaagtataaagctgtacccttcataataaacaaaatatctatgagatgttcaaagtcatagaaatggcagaagaaactttggttcaaggtcagccaaaaaaaaaaaaaagttaatgcattgggttactgcaatcgttcagaatgtgtatacattggaatgcctgcattgtccaggtatttgtgaaatacatgaactgcctttcctgaacttgaattctgtgaaatacaatttgaaactattgctctataaaataaatttcaaattgcttaccttgatgggtatagagtttccttcagaagagattcctgtttacctttccatttttatttgcttgattccctaagtatactgcattccctaaaagataccatattttctcatatctcaatgccttctctcattctttcgtttctgactagaataccttttctactttcatacgattggataattcccagccatcttttacctcataattcaaacatcacctctatgagactagctctgaccactgccacctcaactacccaccagggttcttttttttcttttttaaaaacctattctatgtttttctgtagcatctggcatatacctatagtgtgaatttagcatcttcctgtgattaaaaaagtttcttaaaaatctgtcactgccgttatactatgaactctttgaaaagcaaataatttttttttcttgtttccttcttattgctagggtatacactatctagctggccagtatttcttaactctggtgtctaaaatagagatttccagcacctccccattcttagagaatcaaaatctctagggatgagtcctaggcacttgcatttttttgaatggccccacaggagatttctatgcacagccattagtgaaaaccattatagtgggcacttgatacactttaaatgagtaaagatgcatatacatgattggtcgattaattgaaaaagatattaaagcagagagcaattactacttatatatgccttaaacattttattttaattgaaaacatctaaatatacaatttacaaatcatttgataaatgactacgtttttctgttgaatgttggttctgtgattggagttctgtgtggacttctcttccataaacctttccaaattcatatctacaactttcagttttggtttatttaaagcagagtaagaaattacatgcttttgaagcaaaccaagtgtcaagtccttctagattatatatacagtgatatgtataaagcaaggctttattttgttcacatctgtatcatctatgtatagaatggtgcctggcccattgaaggcagtcaaatatttgttgagcaaataaatgaataaattaaaggagggaagctatacagattgttgtgttaaaagcaaactagatattattttgaacagcttcttggagttgcttttatgaaataacttttatataaagaggtggagagcatctagtgaaagagttgataccactttaggaacatggtatatgcttttcaaacagatgtagaaaagaagattgtaggaggatttaattaaatttatttcagtttttattgaagaagatattaggaacattctcatttttaaatgatctttttgggggaacaactcagaagttctagattgacagtgacaaacacacagggtgttctagacctaattaacaaaagataaaaataagtatattaccaaaaaaagagtaaaataagtatattaccagaaccagatgacataatccctaaatttctgaataaactcttaaattagccaactcactattcataatcatttataaactgtttttataaatggtcacaatgtcagaaacaacatgtagttaactagtataacttctgcagggaaatggatttataacaatgatgctcatatctgacataatatcagatcgtaccaggtaaataggtatagatcagaaatacaggcatgaactgtagagagttgggctttccaggaccctagcaagatgaaaggagattaaatgcccagatatccttgaatactatctcttcctcaagattttcattgtctccacattctcctaatttcactccattttacttaagcggttttgcaactgagattgggaaaagatcatgatcacagttccacagttataaagttttcatccataaaaagaataatagaagattccctgagatgtgtggatttgttacattctcctgtcaccaaaaagcacagtagaggcatctttaagaatggtaatggaggcaaggaagaattaatctaccattaagactaagatgctaacaagcgtaataaccagaaagaattaaagatttttttttcttttaagaaccagaaaccaaagccagatgactcagtactccaggctgtctgctttgcttatcctgagagcataagggtgtaggggcaggcttgagtaaaggattatagatgtgtagaagtacgtttgtaaaattttaaagttacctagagggcaatcacattttctcacaaaaagtcctttggtgctagtatttgtcagcaaattgggttgttggtcttgtatagtgtggtggttcttaaatgttcttaaaaacaaacagtgccgtcatactttttgtatttctcatacatacagagctaagttaaaatcttaacataatttccaagtatgtttttctgtaggagtattatcactaagtaaacgaaatttctgtttcttaaaatttagtgcatttctgtagatatttctctagcctcatttgacgatgttcctgtgaaaaatctcaggattaagttcatatttacttttaataataggatgattgtactgatttcctgtattatagttctgtaaagccacttacatattggtttaatagcaatgacttttgactatatccattaaaagtatcaagtagaagccctgctttaaactttcaaattgagtttgtttttctcataagagaaaaatggaactttttgttcctacttaagtatcaaaatgatgatctttataaaaatgcttttgtttatagtgacagttattttcttttttagtcttaaaaggaggataacttttcttaattctttttagtatttgaaaggctaatcttttaatgtgcacaatatactagcgtttttatttaaaaatatagattaagtattctgaataattgttcctaatttcctaggtaatactaaactgtctttataaggactaggaaaaaaatcattgattaagttttatacagccaaaaatagaaataacatttaaaggatttagagaaggtagttataaagaatagaatataagccctccaaaaagtatatagtgggttcaccatgatacttagggagagacttgattaaatgaagcattcatagtcactgaatgaatgcagcaagaaggtattttgacatgtttattattgaaaatatattgtatttattatacacctttaaaaataattaagacataaactgttctcagccaactgactataataagaatgaaataatgctttctgggattgatttatcagcaaaatcacctatgatatattctggacttatctaacatattagaaagaagaatatgatttgagttttattggaagcccaaaattaccagttaatattgatggtttatagaattattttgaatataatggtatataatgatgctatataatcaatataatgaatttgaaattgaaaatattgtatttgttttagtttcagttaagtgttttatatttatttttatcttattttatttttaggtggagttttgctcttgttgcccaggctggagtgcaatggtgcagtcttggctcactgcaacctccatctcctgggttcaagcgattctcctgcctcagcttcccaagtagctgggattacaggcgcccaccaccacgcccggctaatttttgtatttttagtagagacggggtttcaccatgttggccaggctggtctcaaactcctgacctcaggtgatccgcccaccccagcctcccaaagtgctgggattacagccgtgagccaccgcacctggcaagtgttttataattcaataaatatctctttgaattgacaatagcataaaatcgacatcttatttggacatgtaaattttattataaataaaactgatcattttggtggttttagatgcagatttaatacctggatttagaaagtaaagattggaattgagagaaaattgttatacttcttttatctttcttttatttttactttaccaaaatgaacacaataaaattagttacactctgaagaaaactagctggattggttaatgttcagtttactttgttcctataaattgactaaaaacttgtctataaatctgtaaactgtaaaagtttgaaaattattagtagtataataaattttgaagttagattgagtctgggggaaatgcttacagttggtaaacatccatgtagatggaaaatgtgaaactagaaaaggagacagagaagaaccgagcagaataatatgaggaaaattcaagagtagaggcaggtaatctgaagcattctttagagagaatagtaagagagaaactcaggcatgtcccagctttgtggagtggtcaaagatagtaaaaacaaaacaaacttcaaaacaacaaacaaataacacagaattgtcagagacaagtgaattaggccaagaggaaattgattagggtaaacatattttcagtaaggtgatggatagaattaaggtcaacaatataatagagaatataattagtagcatcagtaccaagagtagaagtaggggagatgtgtgaggaattgactttatagaaaagaaaagtggtgaaaaaatagcagagacagtaggttttaatatcattttggtacactgtaggggtggtgatgcaattaatccacagaaaagcaattgaggctaccagaaagggaatggtagggtggggaatagaggtaagatttgccttttaaaatagcaaggggtggccatggtagcacatgcctgtagtcctagctactgaggaggatgagggggaggaacccttcaggataggagttcgaggctctaatgcactgtgatcatgaatagccactaatagtactccagcctgggcaacatagcaagacccctgtctctaagataaataaataagtaagtaaaataaaacagtaggtatctaatttggaatttttctccttacctgataagaatacatatttcatttgaattctcagtgaaatctgtgctttatgtcctttcaggtaaataaaagcatgtgattctatgagaagatcatatgacttttgtattgctgcttcaattaccaaaaacttattggcttaaaacaacacgaatttatcatcttattgttctggaggtcagaagtatgacatggatgtcactgggctaaaattaatgtgttcacagaactgcattcctttctggaggctgtagaggagattttgttttcttgactcttgcagcttttagaggctgatcacaattccttggccgatggccccctcccatcttcaaaaccagcccccttccattttcaaagccagttgatctttccaacatgtcaccaccctgactttcctgcctcccttttttaatatttaaggatgcctatgattacattgggcccaccaggataatccaggttaatctccccattacaaggttagttgattagcagtcttcattccatctgcaaccttaattcccctctgccatataagctaacatattcacaggttctttgggggctgttattctctgtacctagatgttcatcacctcacctgtttttgttttttgagttattttatggaaaactttaaacacacaagaacagagagaatagtattgaacccccagcttcaacaatgatcatccttggcaaatcttgctgatttatattctcttatttgctactcttacatttcattattttaatgcaaatctcagacattgtacccttccacctgtaaaaaccttacagagcagataagcacttctcctcaccctgtgcttacactattaatcctaaagaccattatcatagtgaagaaaattaacatttctttatataatctaacatgtagttagtgtttaaattcccttagttgtcccatattgtctttttgtagttgatttgtttagattggcatccaagcaaggttcatgttgcattttcacttggcttgaagttatcttaattcagtttgtgtaaagtcacaggttttttgataagatcagctatcttgtgcttttgtgtatattaatgaaaaaaataactctttgtcctgatttctttatgaactagaaggctatatgtgaggaagtgggtgggttgttcagtgtaccacaagatgccaaatagagaacttttaaatgttttctagacatggtaacattctttaaggaatgggaaaaagaatatttttaggtcatcctgagagctgttgtactattttgtgatgctactataggataggctttgctgagaatgttagaaaagagaaaagtgtcataaaagacacagtatgtgtcaaagtgaataaaagtgaggtggattctcaacgttactgatttttacccatgaaataaataaataaataatttgagggataggatgagattcagttttgtatagctcttcttttaagtgaaagaacagaacatttgataaggattcactctacagttacttagaatagaattatatagcaaaaagctgaaattgaattggacaaaatctgttttattagtaacttagatttcttcacttgggttaataggctaaatatacttgaagaactgagttggaaggtggtaggaagaggattaaaatactgatgaggaacacattttgatgtattgagttccatttataaataatctgtacattacatttattgaatatttacataattcaaaaggtaccttattctgattctctgccatcctatggtagtttattgttggctctttctttgctttttccagtttcatcttaaccaaaactcctttgctgtttgaggtaatattcaatattcttgtgctctgccacagctccccactagctatttggtgaattcagttacttattatttaaacatttattgaaagcatattttatatatgattctaaactagactttttaattgggcaacccttttttaggaatgactttgcaaggcaagcacacactctgtgaaccatttatattttaatgtgattaacagaataatttacatcatgtgaactttaattcatgttttataacttttatgaaactccctcttattcttttttcaatggctcaggtttttttgctccctgtctctttctttcttttttccttgtatttctactatttttgaattattttataatgtatttgatatctttctctttgtccttagcctatgttaatttccatttatatcttcttggctaaaagctgctttattctaaaataaaagaacctggaaaatgtctgaaatatatttcttttggtacaatttcatttccctaacaagtctaatacttattgagactattaacatacgaaagtaactctttaagtcacagtttctcttttattcaccaatttctttttgaaaggattggaaagtatttaatctgggtcagctcagtataattatcaaataattatctttaaatcatgcttctttgttctctgctaacagactcaaatttcttacaaattttttttttgaaaaatgatttggggtactttcctgcttcttaaaaatttaatacttttaaattgatgcataatagatgcacatatttttggggtacatatggtaatttaaaacatttatatggtttgtaaatatcaaatcagtataattgggatatacgtcaccttaaatatttgtctttgctttatgctaaaaacattagaattattctcttccagctattttgaaatgtacaatagatcattgtaaactatagtcaccctactgatctattaaatactagatattatttcttgattcaaaatatatatatttgtacccattaatcaacttgtcttcattttcccaccctccttccaggcctctggcaaacaatatactctctgtcttcatgagatgtactttttagctcctacctgagtgagaacctgtgatatttgtttttctgtgcttggtttatttcatttaacatgacttctcattacattcatgttactgcaagtgacaagatttcattcttttttatgactgaataatattcccttgtgtatatataccatattttctttatccattcattcattgatgggcacttgggttgattttatattttggctattgtgagtagtgctgcaataaatgtaacagtgccaatatctctttgatatattgatttcctttcttttgaacatataccgagtagtgcaattgctggttgttctatttttagttttgaggaacctccatacagttttccttagtggctgtactaatttacattcacaccaacaatgtgtgagttcccctctctccacatccttgccagcattcattattacctgtctcttttataaaagccattttaactggagtgagatgatatctcattgtagttttgatttgcatttctctgatgattagtgatgttgagcattttttcatatgcctgttggccatttgtatgtcttctttgagaaatgtctactcagatcttttcccatttaaaactcagattatttatttatttttgctattgagttgtttgagcttattatatattctggttcttcaccccttgtcagatgaatagtttgcaaatattttctcccattctgtgggttgtctctttaccttgttgatggtttcctttgctatacagaatatttttagcttgatgcaatcccattttccatttttgctttcgttgtgtgtacttttgaggtcttacaaaaaaatcattgcctagactgatgtcttggaacatttctccagcattttcttctagtagattcataattttagttcttagatttaagtctttaatcaattttgatttggtttttgtatatagtgacagggcctagtttcattattttgcatatagatatccagttttcccagcaccatttgttgaagaaactctccccactgaatgttcttggtaactttttcaaaaattagttggctgtaaatgtgtggatttatatctgggttttctgttctgttccattggtctatgtatctttgtttatgccagtatcatgctaatttggttactttaggtctgtagtatattttgaagtcaggtagtgtgatgcctctagctttgttgttttgctcagggtttctttggctattcaggatcttttgtggtttcatataaattttaggatttttttttgtgtttctgtgaagaaacattggtattttgatagagattgcattgaatctgtaaattactttgggtagaattgtcattttaacaatattaatttttccagttcatgagtgtgaaattctttccacttgtttgtgtcctcgtcaattcctttgtcagtgttttaccttgtagagatctttcacttctttaattaaatttattcataggtattcataggtattttatattctttgtagctattctaaatgagattgcgttttgatttctttgttcagattgttcactgttggcgcatgtaaatgctcctgatttttttgcatgtttattttgtatcctgcaactttactgaatttgcttatcagttataacagttttttggtggagtttttaggtttttgtaaggtaaggtcatatcacctgtgaacaaggctgatttgactcccttcttccaattggatacccctttatttttttctcttgcctaattgctatagtcaggactttctgtattaggctgactaaaagtggtgaaagtgggcatccttgtcttgctccagactttagaggaaaggctttcaaattttccctgttcagtatgatggtacctgtgggtttgtcatttatagcctttattattttgaggtatgtttttttctatccagtttgctgagggtttttctcataaagggatattgaattttatcaaattctttttctgcatctattaaaatgattggtttttgttcttggttgtgttagtgtgatatatcacgtttattgttttgcatttgtggaggattgtcacatctgtgttaatcagggatactggcctgtagttttctttttttattgtgtctttgtctggttttcataattctggtctcataggataagtttggaagtattccctcttcaatttttttgaagagtttgagtagaattgctatttgttctttaaaatgttaggtagaattcatcaatgaaaccatcaggcttttctttggtgggagactttttattactgcttcaatcttattcctcattattggtttgttgaggttttctatctcttcttggttcaatcttggtaggttgtatgtgtccatgaatttattcctttcttctaaattttctaatttgtttgcatacagttgttcacaatagtgtctaataattcctcgcatttctgtggtctcagttattatgtctctaattttttttgtttctcatggtatttatttggatattctttttttcttagtctagctaaaggtttgtctatttacattttcaaaagcaagcttttcatttcattgatcttctgtagtgttttttttattctcaactttattatttcttctctgatctttattatttctttttctatgaatgttgggttggattgttcttgctcttatagttccttgaggtgtatcttaggttgtttatttgaagtctttctgcttttttgatctaggtgtttaatgctatcaacttctctcctagtactgcttttgctgtatctcatagatttcagtatattgtatttccattttcatttgtttcaagaaaattttaaatttccttcttaatttttttcattgactcatttgtcattcaagagcatgttgtttaattttcctgtgtttgtgtagtttctgaggatcctcttgttactgatttttagttttattccattgtgatcataaaagatatgtcatatgatttttactttcttgaatttgttctaacttgttttatggcctgagatatggtctattctggagaatattccatgtgctgatgaaaaaaatgtgtattctgcagcagttgggtgaaatattttataaatgccaattaggcctatttggtctagtgtgtagtttacagtgatgtttgttgactttctggctggatgatctgtccgttactgagagagattttttttttaactgaatattcaacacatttgtaggaacagaaggaatgcaacaaggattagaattttataattacattatacatttatgtaaaagatgtttcatttctcaaagacgtttctcctacgtccctatcttttctatctttctcaaatcagtagttattactattctcatggacaagcttatttcattgtgttagacagtaattataccagtatgtttcacatcattatcatcttcaaaaattctacccttcatttcaccacacaatcccactgcattgtttcacagtacaattgtattccacttaaattagaaaagcccaaagaaattagagcaaaaacagtcaaattcatgtgaatgaatgctagagggcaaaatattttaaagtattgatttagtaacagttactaaatctacaggcataagacttctatttattcatattattaaaactgcaataatagaaatgaaatctacattaatgaaaaacaatctaaggaattagatcagtaatatttaaatatagatatattttgtgattagtatcaggtaaatatctaaactatctatcttaaattctggtctcagagaaaaatgtcagagacaattacaaagaagatgcttcatattatcaggtccatttttctaactagtgagatcctttgggagaatggctttagtctttcattttgtcagagatttccattggtcctgttgttggtaatccatttgtttacatccttacagtctacctcgtctttattttatttatttttatttatttatttattttttgagacagagtctcgctctgtcgcccagggtggagtgcagtggcgcgatctcggctcactgcaagctccgcctcccgggttcacaccattcttctgtctcagcctccccgagtagctgggactacaggctcccgtgaccacgcctggctaattttttgtatttttagtagaaacggggtttcaccgtgttagccaggatggtctggatctcctgacctcgtgatctgcccacctcggcctcccaaatgctgggattacaggcgtgagccaccgctcctggcccttgtctttattttaaattgttgtattcctgtatagctttataggctatatataactaacaaaaggagaaataagagggtatatgcatggatctagaattcttttgtatttccagaacagaattgaaatgatgatacaaggaatgcacaccgttgcctgggcttcacctcctaaaccgcaaccatgaagccctaatgacaatgtccacacttctggaggaagggatgaggagcagcctcgagtgggttgctgaagtaccctactattattgtattgcagtatacctctctttctagatttattaatgtttgcttcatatacttgggagctctcgtgttgggtgcgttgttatttataatcattatatcctcttgctgaattgactcctttattattatatagtgatcttctttgtctgtttttatagtctttgatttgtagtgtatttcatctgatctacatatagctactcctgctcttttttggtttccagttgcatggaatatctttttccaccccttcagtttcagaatgtggatttattgtaaggagtatatagttgggtcttgtatctttatccattcagccaccctatgccttttacttggataattgagtccatttacattcaagataattattgataagtaaggatttactactgccatactattgcatgttttctggttcttttgtaactcttttcttcatttcttcctttcttactgtcttcctttgtggttaagtgattttctctagtaatatgtcttaatttgttgctttttatttttagtgaagctacaggattttgcactgttattgccatgaggcttacagagaacatcttatagatataacaagtttatttgaaagagatgacaacttatattagatcatacaaagaataggacaaatgaagaagagtgggaaaaaatctctatactttaactccctcttccctcattttgaattttgttatctccatttatgtttttaattgcttatctcttaacggattgctgtgggtattattgtctttgataggtttgtcttttaggtttcatagtagaattataggtggattgcacactacagcttcagtattagagtattctgggtttgtctgtgtacttaattttaccagtgggttttatgctttcccatgttttgtttttgtaagttaatttttttttaaattttagatggaagaactccctttagcatttcttgtaagatgggtctggtggtgttgaattctctgagcttttgtttctctgggaaagactttgtctctccttcatagttgaagaacatgtttgctggatatagtattcttggatggcagttctttttttttttttttctttcaccactccctgctggcctatatagtttccattgagaagtctgaatggattaaacctcctttttatgttatttgcgtattttctcttgctgcttttaggatcctctctctgtctttgactattgagagtttgattatgccttggggtagtcctatttgagttgaatctgtttggtattccaccttcctgtacttggatgtttatctcttttctagttttagaaagttttctgttattatttctttgaacatgctgtctaccccttacccttgctcaactccatcttgactatcagtaattcttagatttggtcttttgaggtaattttctatattttgtaagcaatcttcattctattccatttttctcctctgcgtattttcaaatagcctgtctttgagctcacattatccttcccctgcttcatacatttagctgttgagggcctctagtgagtttttcagttcagcaaatatatttctcagttccaaaatttctgtttgatttttaagaatcatttcaatctttttgttaaatttctctgataaatttctttcctttcttttttttttttttttgagatggagtctccctctgtcacccagactggagtgcagtagcacgatcttggctcactgcaacctccgcctgccaggttcaagcggttctcctgcctcagcctcccgagtatctaggaccacaggtgcatgccaccacaactggcaaattttttgtatttttagtagagaaagggtttcactgtgttaaccaggacggtctcaatcttctgacctcatgatccacccaccttggcctcccaaattactgggattacaggtgtgagccactacgcccagccaatttttctgataaatttcttaattgcttttctgtgttgtgtgggaaggctggctaggggttcatgcccagcagacctgatggatgaacttcctatagcatgatactgctgaacagcctctaatttggtgtctcctttggctgagttacagagcagaatttccaaggctaggatggcagtcccacctcccctctttgtttctctttgtcatcagggatatttcttacttcaggtactgctaatgctttccctgggttggggtagagacagggctcctgttagggaacccaaaatatgggggaagctggttgtctaccttgagctcactttttacaaagtagaaatcatgagttgggggaaattttcttagctcttggtgcaaggcagattggtgtgagtgggatcacagatatggaaatcttattctctttactgtctgcttggagttttttcacttccctgtgaccctagaagctgacttgttcttatatttgagttttggggtatttctggtaataatctcagtgatgtatatttgtttaggttttctgtatgggcagtgaaacaactttggttgtatgctgccattttggaacctgtagtctccctaatacaacaatttctgtcttcatacaaagcaagattatatatttagtagaaataattttatttattgttaatgttttttacagtgctcatatattttattctgtgaagagctatagatttaaagaacttggaacaaagataaatattgagagaatagggtgctaagagctgaacatttgggagttgacaattgaaagcaaaataagaaagatcagggagggaagtatgtgaggtaaaatttacacataaaaatcagattttaagtactcatttcaatgagttttgataattatacacatctgtgtaaccatcagtcaaaacaagatataaaatatcttacattttctaaaaatttcttcctgacactttccagtgaatttcccatccttatccttttccagaggcaattaaattctgacttctttttttttcctcctgagatggagtctcactctgtcatccaggctggagtgcagtggcgaaatctcggctcactgcaacctccgtctctggggttcaagcaattctcctgcctcagcctctggagtagctgaaactacaggcgtgtaccaccacgcctggctaatttttgtatttttagtagaggcaaagtttcactatgttggccaggctgctctcgaactcctgaccttgtgatctgccctccttggcctcccaaagtgctgggattacaagtatgagccaccgcacctggcctaaattctgacttctatcaccatagcttatgcttacatgttctgagacttcatataaatagaatcatatggtatacagagtgtgtgtgtgtgtgtgtgtgtgtgtgtgtgtgtgtgtcttatacaacacaatgtgttaagatttattcaagttgttgatggtgtcagtgatttgttctttttttattgctgagtagtaggtagagagaaaaaaacttcaaaagtatccatacttcaaacatgcagatgcaggcaatgattattgatttttttgggtgcatttcattttagtatttttttatgtttagttttttgttatgtggaaattaacaaagaccacccaaatgaggacataggctattcagattttgctgtggcaaaacccaccatcgtttgtatttggcagagtcccaaacgcaggcagaagagtgggagagctttgtggtgaaaaaagggtaagctttaagtatgttcttattgtaagttgttggcatgggaagctggaggcaggctgtgtacaagggaggcattctatgtgattggtttgggaagcatatttggctttctctagtcagtattgagttggaagtgttgtgaatgagggagctgcggaagttagggatctggtagtcattggccatttcctgattattctgggctgatgattgcagagattgtggtttgacttcccagactggttgctgcagggattgtggtttggcttccttgtctggttgctgcagaggttgtaggttagagttctattatcatatgtagtttagtaattgtatattatattgtatagtcagtctcttggttatattttggtatgtgttatggatcttatatagaattttacatcctattttttttcacttaacattagaatataaacactttttggttgttaaggatttttttctttatataaatgtaatggctgtataacaatcagtttaggggatgtacttttattactggaaatttaattttcattcagtttttctcttcttacagtaatgcttttacgaacatctgtgggcattaaaccttcagcatatttaatattacttcccgagatgaaatttctagttgtaaaatagttaggttataagtctttatatatcttgttgaattactttctaaaagggttcacctagtagtatataactgtcagttcagtggtattcttaccagctttcgatatttagaaatatttttactaacttagtaaatgaaaaatacacttttgtaattatttaatttgtattttatgattactggtgagcttgattattttccagtatacttactagtcagttgagtttttttttatgaattgtcctttcatatcccctttcttcctatttattggttcctagtaatttctattagcttttatacattttaatatattaaattgatcaatcttttatctgttatagttttgtaaaatttttcccagttcattatttgcatcttgttcatgatagttctaatttgcataattcatatttttttctattgtcaaatctattgacttatccttagtgatttcttttttatcctctacaatccagagtttgaatattcatttctattttctttttttttttttttatgagaaaataaacttattttatttaagccatccagactctggtactttgtcatagcagacccagcaagctaatacaaagtcttatctacatagtgagcacaacagttattacataccattctctcttaactgttatttaatcatagtcctataagtacctgtgtgtttagggcttatattatttccttatattgatgtgttttggctgtgttttagctctttctgtagtagattcctcaggaagagttcatggaaacagtatttcttgagaaatgcattttgatactagtttgtaaggcgctttatattttttacttgaaagtcattttgcctggttataaaatccttgacttttttttctttctttggatgtcttaaatatgctactaatttttccctggcatgaggtattagtattgaaatattttagtgttttgatatatcacattttgacatttttattttaaccaaattcattttagtatatagtatgactccaaaatgatgtttcccccaaacagcccgtcggttgcaccataccatttaacttctgcttccctcttccactgaatgtggtattcctttgtcatatattaagttttgaaatgtactaggatttataactgggataactatgtttttctatttaactgctgcttccctcttccactgaatgtggtactcctttgtcatatattaagttttgaaatgtactaggatttataactgggataactatgtttttctatctttctgcctgttcttgtggcaatcacataccaatttcttttttcagtctaaaggctgaccaaaatgctatgtagactaggttctggaatatttaaaaggaaatacagtttgtgtgcctatcagccaaagactgcatacctgtagttaaacaaagttgggttttctctttttttttttttttagaataagggagactatataccatagggagggcttgttacaggatttgaacttgtgttaggtcattttagacaaagttcaaagaaacacgaattagatattgtcagaaagtggggtaattctatcatttgttatcctaagacgttttaactagaaggtaggaagagtggcatgaggctacataataggtaaagaagaagcagttgcatatgttagctggataaggggagcctttagctattagtgtggtttgtacaatattcttacagttatcactacccagacatgattccacagtggttttatttttgtcttgctttattacggtcatagagtggctttgtttgatgttggttttctgtgaaattattcatgttccaaaagagaaaaccatgacccagcccttagtgccaggtaaactgcagcttacagctgttagaggttgcttattttttcttttgttaaaaaatcaatttattacttttaaagtagtttttgtagataaagttgctagaatatgttgctaagcaggtatgctttaagaactagataagaaaaaaaatttctcattattaggcaacaatttgtattggtcgatttgcagcaaccagagaaggaaaccaaaccacaatccctgcagcaaccagtctgggaagtcaaaccacaatctctgcaatcatcagcccagaataatcaggaaatggccaatggctgccatatttgtatttgttatgtaattgttggataacagctattgttacagtgtaattatatacagtcacatgtaacttaatgatagggataggttctgagaaatgcattggtagacaatttggtcattgtgtgaacgtcacagagtgtacttacacaaacctatatggcatagcctaccacacacttagctatatagtatagcctattgctcctgggttataaacctatatagcatgttgcttgtactgaacactgtaggcaggtataacagaatggtaagtatttgtgtatctaagtatatctcaacatagaaaaagtacagtaaaaattatggtattataattttatgggtccacccataataagtagtccattgttgaccaaaatgtcattatgcagcacatgatggtatgaacttgaaatagtgttcttggaaacaactctcctaagtatataaatttcttatgctcttattatttacatgatttctctatttatttacatttctttccctctccactttgagaaagtaatgcagatgttatttcctccatataatagtctagcaggcagccatttttaattctagcagataaatagaagatttgaagtagcttttatttttctgagagtagttcaacccagcaaatcgctttagtattttttgtgtagctaggtgaatccacaaaattccagttactgtagaaataaagtgaattttaaaaaattaaactgtttataaaagctattatagaaataaaattaacactgttgggactgtaaactagttcaaccattgtggaagtcagtgtggcgattcctcagggatgtagaactggaaataccatttgacccagcaatcccattactgggtatatgcccaaaggattataaatcatgctgctataaagacacatgcacacgtatgtttattgcggcactattcacaatagcaaagacttggaaccaacccaaatgtccaacaatgataggctggattaagaaaatgtggcacatatacaccatggaatactatgcagccataaaaaatgatgagttcatgtcctttgtagggacatggatgaagctggaaaccatcattctcagtaaactatcgcaaggacaaaaaaccaaacaccacatgttctcactcataggtaggaattgaacaatgagaacacatggacataggaaggggaacatcacacaccagggcctgttgtggggtggggggagggggagggatagcattaggagatatacctaatgttaaatgacgagttaatgggtgcagcacaccaacatggcacatgtatacatatataactaacctgcacattgtgcacaggtaccctaaaacttaaagtataataataataaaaaaagaaataaaattaaattccaaaaatcctacaggaagctctgttgtgtatgaattaggctgagtgagataagttgactataatattctgattttttacctaaactatgcaacattagctgacgcagttattttaactgtatctcagaagctaaattatctggccaacatcactgcaaacattctatactgatggagtagtgtcactgctgtttttttcaaccctttgcttttagtcattctgtcatactggcaaacataaattgtgtgatataagaaaattttatgaggtaaaataatatctttaacaaatatatattttgatgagagcattgtattaatatttggtaataagatagccagactgttgaattaatcatactcagaaacttactgcattgggtggagattcagacaaggaagtgcatagggcatagtcacagaaggaatctgtctaaaaattgtatttacttgctttcatgtgattaagcataggcagagattaatattcaagatgaaaattccagatcctagaagagcagaggaaagagtgatatgggaggaactatgatagtggacaagaatttaaatagcttgatcttgaagaactaggattaaagatcatttaggaaccagtagcaaaacgaattcaataccaggtctactgaccaaagttttaaaaaaatctcctttatctagagagtggattacttttaaaggaatgattgtagtttgctgaaaccttcaatttcattttgaatgaaaccaccaatcattttcttcttgtaacttcacactgcaaaaaattttgagctttttttttgcccttcgtattctctctgcctaggttagctctaatttatttctttccctagttttctttttctttttttttttttcatttctctttgttcagtctttcttttcactgtctcagttgtacattctgcctgtgttccaagattaagaataatttctggtgctaaattgtcttgaggcatgttaagatttcagtatattgtaaatttctcatatgacttctttgacccatgtgctatttagaagtgtgttgtctaatctccaagtattttgggggtttccagctatctctctgttattgacttctagtttaattacactatggtcttagagcatactttgtttggtttctattcttttaaatttgttaaggtatgttttatggcccagaatgtggtttacctttgcgaatgttgtgtgaacttgagaagaatgtgtgttctgctgttgttggataaaatattctataaatgccaatcagatccagttgatgatggtacttttaacttttactatatctttactaatttttggcctgtgagatctgttaattattgagagaggggtgaagtctccaacgattatagtggatttatctatttctccttgtacttctattagtttttgctttacgtattttgatgctctattgttagacacatagacattaaggattcttatttcctctggaagaattagcccctttatcattacgtaatgtccatctttatccttggtattttttttccttgtcctgaatttggcattatctgaaattactatagctacacctgttttattttaattagtgtttgcatagtatctttctctatccctttagttttaatcagtctgtgtctttatattaaagtgggtttcttgtagacaacatatagtgggggactggttttttaatccaccttgacagtctctgtcttttaattgatatatttaattcattgccatttaaaatggttattgatagagttgaattaatatctatcatatttgttaccatttttatttgttggctttgttctttctggtttttttttggtcttatactctttttctgtcttgtctaactttgagcattttatatcattcaattttctctcctctcttattaattctacttatttttatactttttttagtggttgcccttaggtttgcaatatatattcacaactaatccaagacccctttaaataacaatgtaccactacatgagccatgcaagttcccttataataaagtatttccagttttttcctcctgtcctttataactgcgttcattcattttacttatccataggttataatcaccaagtacattgttgctattactatttttgaaaaaaaaaatctgttagctcaattaagaatttaatttaaaaagttttttttacccttatttattatttccctaacagtctttctttctttgtatagatctacgtttctgacccatatcattttccttctttctgaagaatttcttttagcatttcttgcaaggaagatctactggtgacaaattccctcaatttttgtttgttcaagaaggttatttctccttcccttttgaagaataattttattggatacagaattctaggttggtgtggtgtttttctttcaacactttaaacatatcacttcacatttttatggtttgcattgttcctgaagagaaatctgatataattcttaccctaagtcctcaatagataaagtttagtttttctgcgtttttttttaaagatttttctctttgtctttgatcttctgtagtttggatataatatcctatgcatatattttttggtgtttatcctatttggtgagctgagcttcctagaattatggtttggtgtctgtcgttaattttgggaaattctcagtcactattgcttcaaatatttcttctgtttctttctcttgacctttctgatattcccattatgtgtatttacattttttgataatcatctcatagtgctaggatattcgattcttcttttttctctttgcatatcagtttgaaaatttctattgaattttcttcaagctcactcttttctttcttcagccatttccagtctataggtgagcccatcaaggacattcttcatttctgttagagggcttttgatttctagcatttctttttgattcttagagtttccatttctctgcttaaattacccacctgttcttacatggtatccactgttttttataaagcccatagcttattaatcatagatttaaaaaatctctgtcatgtctgatgcagtttttgacacttgctgtctctacaaactgtgtcttttttggtcttttagtacatcttgtaatttttaaaatggaaaaaaggatgcacaggataaaagggactgagatacataggcttttagtttgagattatgtttatctgattggggtcaagctgtgattgttctttgctgtagctgtagctgtaatgtcagatggcaaaatttttttctgtgtccttgtttttgtatcttcagttgtctttaggttcacttagagactctttcttaaataaagtctgatacatgcaggtttttttttttgacagagtctcgctctgtctcccaggctggagggcagtggcgtgatctcggttcaccacaacctccacctcccgggtttatgccattctcctgcctcagcctcccaagtagctgggactactggtgcccaccaccacacccggctaatttttttgtatttttaggcctcccaaagtgctgggattacaggcgtgagccaccacgcctggccacatgcagtttttaaaagttgttttcccctgttattataggagccctattgatgtggtgttgaggtgtgggggagggaaaacattctgtaggtctataattaggactcagtcttttagtgagcctgtgtccttgggctgtgaccttcacaagtgcttctcaggttgatttatttttcttttattaggggagacaggaaggctagagttggtatttcttctctcttcccctacctggaaggctggagatggctggaggtgggcatatctcttccttcagtttggttaggctgtgtgtaaaacctcacttggataaagttttacttaagtaaactagtttccactagttttaagtggaaactagtttctcttgaggacaggtcttgttaagaacagaatgctctgagtatatttcaaaatgactcctttttccctccctctgctggaagcaggttgaaattttgttctgatcttcactgtaataacctcacaaaagtgagttgcaggtaaaactcacaaaagtgtagggacacctctaaccctccccactccaccagagtttttaactctcaaacttgttcacattaaacctccagcaatttgtcagttaaattttaggctgtaatcactgtagctcgaaccctgttactgcttcccacgcggaagtttctgtccttaggtttctgctcaggtatgttgtgatccctatatctgcctgtctgtctctctgtttttgggacagcaatttgtcctgtgaccttagttttctgatggatctaaagaaagttgttgattttcagtttctttgcttttttcttgttttgtggaggagagcgatgacttctatctaagcttccacatgccagactagaaatggaaatttcagtatcttaaaaaacaaacaaacaaaaaaacttaaaatcttagggtctatgttggaattaatttatatacttaaacaagggtctcagtatcataatagtagtaaataattgttaatgatttacaactttctgagttacttcgtagactcaaatctgattttgatacacaataataggggcataagtttaaccttttaattatattgaggtttactatgagttattttaaaattgagaagtgtttagtgagtgtttaagatgtatccagcattctttttcttttaaaagtttttttttattttacaagtaatgtatcttccatgtaaaaaagttagaaaatacaggtaagcaaaaacagaacaatctattattttacctagatataaccatcattaatgtttcacagtatttatatgtgatgtttttctatgtttatgattacatgtaaaaagtttttatataaaaatgggattgatacattcttcttggtaatatttctacttaatatattattaacatcttccttgtctgctcatttatttattttttatatatggttaagtggttcatagaattctattaagcatcctggcttatttaaatcattactcaattatttctaatattttactttcctaaagatactacattaaatgtctttgtgcatctttatatacttagaattcttccttgggataaattcctaggagagcaacttcacagctagaaagttagcatatttttaaaggtttttgatatatgcgaccaaattgtcccactgaaaggttgtacaggttgagcaacccaaatccaaaacatttggttattatcctgtggttcctttaactcaatggttgatcttgactctacaccaagctataattcttttgaaagccatttttgtctctggtcttaaattcatatagggcaaatcaagttctttcatctcgagatgggatcaaactactgaaatgctatatagctctcattctaaagctatcagtcacaccatgtgtattcactaggttggtgaccttgaacagttgattagcctttctttttcttttttcttcttagagacagaggcttgctctgttgcccaggctggagtgcaatggcaaaatcatagctcactgcagtgtcgaactcctgggttgaagggatcctcccacctcatccttcccaagtagctggaactacaggggcgaaacaccattcctggctaatttatttttattttttgtagagatggagtctcactatgttgcccaggctggtctcaactcatagcctcaagtgatcctcccaccttggcctcccatagtgctgggattacaggcttgtgtcaggactcctggccttgattagcctttgtaagcctcaatttcatcatttgtaatcataccacccatctcatggggctatagaaataaataaaaattaaatgatataatccacgtaaagtgtttttcattgtgtctagtacgtagtaaacaaatggtagggatatcagccctgggtgcaaggattgtatacatatagacttcttggtttattgctaatgtagcaagaggacagctgtcattttcaagttctttgcaactggcaacaaataagctaagaaagaaagacatggactatattacttctttggtaggggacaaaaatactgtttctgtaagtagattgtgtatttagattttattttatttatgatggaggctcaaaatgttccccctcccctgtctactactggaaattgaagaagtcaccatctgaggaaaagaggtaacccacagatacctaaaagctattcatatttatagaaataacaacagtacctgatatctcagtggactgtttgaaatgcaagtgtgtagctcatgagggaatcagacgaaagcaacagcaaatcgtctttagtagtttaacaccataattagttagataactaatctttttcaatcgtcgaacataacgttaaacataaccccattcttgtttcttttaagaaatacactattactgagaaatatagaaatacctatcaagtgtctataggtatttaatcaggtgtttaacatggtttccggtacaagtatttgtattagaagtacagatggaattggaaggggaccttaaaatgatctagttcactcttttattttatagatgaagaaactgagagattgagtaatgtgtccaggttagattgccagtgacagacctgagaactgaactacgtctcctgacttctaacaaaatatttttacatgtcattctatttctgtaattttgtttcacaagattttcattttttttaaaagtggtttttattttacccaaaagccaaattattttctatgactgctaatttccatttttattatatatcaatgagaaagatcattaagttcatataaattagtttgatagctatatagacacataaaatagattcaacaaaagatgtatttatgtttttcaaatgtgatacagtattaagttgcaatgtgtttacatgttaaatactctggggagagaagctagtgtagctaggaagaaaataaaagtttcagacaagcaggagaatttaagtggaagtactagggcaggaagaaagatggagtggaagccatgaccataaaagatactgcgaaatggaataccaaatttgagttcttaagagtctagaagagtatgatgacgaggctgtgttcatttgaggctgatattaattagtgatgatttgttgagttgaaagagaggacagaatgatgaggtcaaagtgtatgataaattgaagcaaggatattgaagactctgaggctgttgatagggtccagagtagagagaaaatatataagccagatggtaaaatcacgtaagaagatgaaaatgagtcctaggggtggaaaaaaaaaaacagtggaatttatttgtagagcactatctggctacatgagagattgttctttcagtcttgtgttctttattgaataataaagatgataggattggatatcctttaggggttatgcccatggttagttcatgttattagtgtgctggtattcgtattactctgtcactatatattggtatgtatatatacttttcaatggcaagaattgggcctgttaatatatataatttgatgtgtttctttgaaggtatgttttaacatatatatatataatattatgaaaggaagtgatagtatgagagatgatgagatagtttagagatggtaaatgaatttaatttgaacttgattctctcgtgttttgaaaggacacttttcttttaagtttaagtactataaatttgtacttacataatatgttcaacttacagagcatattaacatgcattatctcaatcatgagttttggggtaagattaacagtgtgaattacagaataagttactcatatatatgaattttgataaaaataagtagtattttgaatgcttataaggctcttgagctttaaacaatagaatctctgatctcaagtaattaatacggtagggaagaaacacaggtagtaaagaataatctacttttaatctgtaataatcactagatttaataatacattagtatgcataacatattggcaattatataactgcataaaatattgtaaaaatgtaggtgctcattctgttctaacatcctagcattatataattcagtttaatatggtgacagtagtcacaaggatggtcagtgggaaaagggtgagaatgaaagctactgtacttttaaaaaaaattttaaatgtgccttcattactatagaaagttcagacaacagctctgaatacagagataattatatattgatttaaacattattctagataaggaatttatttaaatatttacaaaatactttattacaattatttacctttcttaaaatatgacataacagtttttgaaggaaaaactgcttatatacacaaatcatatcaatgaactggaaaacactacctattaatatttaatcgtggcactaggctcagtgaagggggcaaatggaaggcatgatgtctgtttataaaggagtttagaacttatttggggagaccaaagtgccatatcattcgtcaataactttgaataaaaatggaaaaatcaaaaaaggaaaaattaaatgtcttcacagtgagctgaatattattttcaaggagaattcagtacacatatgctcctataagcatttaaacacaagccatttaaaacacctaagctgtggtgttggcttagcattttaacaaatattttatgtagcagtaaggctttgacttggaatttgagaagataaataggtgaatattttatttgtgaaaaatgctaacatttaggacctcattcgtttaatcgctgtgtataaataattttatgactattaggtttttgaagatactttgaaaagatattttattagcagctccaatcaaagcaaaatattaaaattgttcttgagatatataaacaaataattacttcttgaatactaaattctgatgggattttattgtcacagctacagtagaaattgatgacatcggctctgtatttctaatagaattataacaatggtattgtaatttctgtagtattcaataaacattgagatatatgaatataatactgctattaatgaagattatgaaaacaggttaatctaagttccaagctagtgaaaagtattttgtctttctaaccactttatataatagaaaatatattattcaatgttactgaataaaacctttgttttgaggcttttaacaaatttaacagacttcaaatttacaactagaaatataaataagaatttcctccctttttttttggtaattgcttattgctagtataggtaatagctactgatttttttttgttttaatcttctacctagataatttaccacattcttttatttccaaaacatttttagtaatttgtttctattttcttgtatttatatgcattatttcaatttattgtcttgctgaattagcttgaatttataaaacaaagttgaataataatgggaatagcaaatatatatgttttattcctgattttaatgggaatgactgtagttttttgttgtttagcatatgtttgttattttcattatgtcattttcttctaatcctatttcacatatttacctggtttgactgctaaatttcatcaaatgcctttccagaacctaatgatataatcatggttttattctttaatttgttgattaatgaataatgtcaatacaaatccttattcaacttcttgttgaaatctaacagaaatatgttttaaattttatttattttcccttccatgaaaaagaaaaagtatgaataattttctggctttgtaaataaaattaactcatatttatatttttctgaaaatgctatgtcaattaaaaattattatcacaggaaaaaattaagtaaaacaaacaatcagaattacagattccttagagactaaagattatattcacaagaggtagcagcaatctgtaaagtacagctgtcttgtaagactcctttttagagacaacatttgcaaagacatttatatgatgaagaatatcatttgcttttctgtatctgtatcttgccaaggtttattttgtaagcagttagaagttctcacaatttgaaggctagggtctggaaaactcaaaatttaaattaaggaaaggaaaaggataaaataagttagtaactaataagagtatgaggtatatatatttagtatctatacttacatttgtggaataaaatgtgtttggccatggtttatcattgtttgaatatatcacttggttttgatttatcagtatcttatttagtgttttgcacctatatttataagtcttcatttgctttataatgcttaaaacaatctgatattatgtagactataaaatatgatgagtttcctgtgaaattactactatattcaaaatagcccttttgtggctatttcatcctttgtggccctttgcagcagcccatccatcttttctgccttggacccaggaaacaactgttttcttcttcttcttcttttttttttttaaactggatcattagtatcttatatagtttatttttctctctgtctcgctttctctctttttctctgtctcttctgtttgaatatatgtatctgatgtttaacatattgaaagatgagggcaattgggggaagagtttgggactgaattagtgataagcacataaaaactaaggaaatgaagaaaatttaaaaaaattagccccagggaacaaaaacatttgtgtggcaaagtaaaagagtagtagttagtagagactgaacagttaggatttttttttggaggatggggatgtgggaagtatgcttgtatgtgtaatgggggtaggtgagaaagagaatcctttttttttccctttggaaaagtcagtaagtagcaatgtaaaaatgttattttgagacacattaagtaaaaatacaaaaataaagagcaaaaaatattgaaaagtggttgcatctgggaagtaggaaatgggagagggaaggagacatatgacttttaattatcttaatatgtcctatagaattatatgacttgttaaactatgtgcatgatagactatgttaaaaataaaactagcatgagaagagaaaaaagttagatataaaatttcaaaaaataagttaatgaacaaatatcccatttctattatatatatttccaaatataaaatgggagtggattagtgctttattcttttaacaatttaatataactaccttttggatctttgaatgtgatagtttccttgttatttcaagagatttgtaagtcttactgagaaactagtaccaatacttccatcgccaatgaccagtggttgtttacgtgagcaggtaatttgccactcttgtgcatacagaacaatcttacttttttatttttttgaatcacaatgtgatggagtttcatgggaacttgttatttctatcaccgttatgccactctatggtgtcatatgcattatagaccttttacttagtcttttctttcatccaagagagcaggaaattattcagcaatactttcagtgacccaagatgacatcagatttaggtaagagctgtgaacatacacacataatcctaaaaaactcaaggtttaaatgatttggctgttattgaaaacaagcatcattgaaattgagggacctttctcaacaatgagagttgctccatagttccagtaataattggcttttgtttaccaaagtggcaaaatatgttgtgtccatcacgttccttactacagatattttatctcaaattatatcaattcatgacttactgcataaattttgagacagtttatgtacaatttctgaattcaagatctggaatgatatgccccaatccacactttacccagagtgtaacatctgtagaccaaaaactcgacaagtaacctaatatcagaaaaggcatagcatatattaggtaatcatagctatttactggcaaatcttctacctagaataatttttaaataaaataaatgtatttcataattggaatattctattccctgttacatataggtattattattattttctatacatggtagtttccaatggttacattaatattattaagtgaaacctggtacaatgcttctaggagttctgtgttcaaatatagaaatgatagctttggcatatcagtattatttgaataggatatatatatgcaatgtcaaccaaaaaaatcagatgaaaaatatgtccaaatatgttgaatttatttgggaattagaaatgaagttttttttaacctgagatgcatagccatgccaagccatgtatgcatctgaagaggcgagagtaaaacgaagctggtattggcaaaaggagaagttcacataaactgcttggaaatagaggtcattggttttggagactcaaagccagagttggcatcagttcattggtggaaacgctattactgggcaagtgttctttcaagaggatcttatattaattatagcagtactgaaaaaagaatttctcttggagttgttttagaaagtccttgagacagtctttatctcagacatgcaagcatgaacccttcatgcttttcgcttttccagctctggtttgtttgggtctacaaaaaatgatttcattctggtatctgcaactttcacagcatgaaccattaatatgatagcacactagaagtctttagaatcaaaagccatatttatttttttcattttttaggctgatgatcaatactgggaagcattcctcataaattaacttggtgatctaatatttacttctttttaaaaatgaatggttggggtatgtattaggatgcaagttaggctactgtaacaggccataataactgtggcttaaacaatatagaaatttatctgtcttttatgaatatgtccaatcaaaagcaaccttgaactgattccatgattgtacggtgtcaataatccaacaagatctttctatcttgttctgccatcctcaacatatggcttccatttcatattctaagatggctgttctaactcctgctattgtatctattttccaatcagtcagaaggtaagaaaaatagaatatttgcctttaccattaagaatatattatatataatttcttctgttttcctttgttcacgatctggtctagcctgcagtggaggctgataaatatagtatttaactggattgttatctgctgaactaaaacttctattagtatagaagggaaaaatgcagacattggggaacagtagacagtccccatcacaggtggttttgaggctattttgccacattatgacagtattaagcctgaacaatcaggcctaatataaattctgctttgccaaagtactgctgttagttctatcctggtccctttgtgttcccaattatactaagaaaactaaaactaaaactacactaaaatattcagatttttttggtagctgggttctggttagattctgccaatgggaggcacttatgtcaaattaaaaagtagaggggaagcaaaagtcattttgtttccggtagtgcctcttgcaatatcagcactgagtacaggtttatgtatttcatcctcagaagaggtagcaacttccttaactcagggtagtatgactagccctcccacatatttgtaactaattctttctattacatatttatttgcttcaaatatctagatagatttgtgtaactattgatacgttggccacttcattcctgtaatattttgaagggagagtggaacaaaagaaaacaagcaaagcaaagtagcattaagaagagctagatattaagaaattcacttattttttactagctttgctaccattatcttacttcactgagcataaattataatatttcaagaacactttttgactttgtctaaaactgagaattttttaagcttaacatagttgtcttcaaactctgttctacattttctttgctccttttttcctactgcatctatatcattccagttgatgtccttgattcttttgaaatcaactaggtaccccaactgatgtcaactttttattgcatactttgtctcataatacgatttggtgttcttgagaagaaaaaattcttttacttcaaattgaaatataacccacccaccatacaattcacctatttaaagtgtacatttcagtggtgtttggtatgttcacagagttgtgcaacaacctccacgatcaattttagaacatttccatcagtccagaaaggcacgttgtattcattaacagtcaattcctattactctgaacccccatcccttggcaaccactaatataaattctgtttctatagattttcctattctatacacttcatgtaaatggaatcatacagtatgtgactagcttcttcagttagcataacattttcaaggttcatctatgttgtagcacatatcagtacttcattttttaaaattgaggaacaatattctattgtgtggatataccacattttgtttatttattcatcagtcgatggacatttgagttgtttctttttggctgctatgaataatgctgctatgaacattacaagagctttgtttatatttatgttttcatttctcttgggtttatgcccaggagcagaattgctgaatcatatggtaactctgtatttcatatattgaggaactaccaatctattttccaaagagcctgcattattttacatttctaacagcaatgtattagggctccaatttctttacatctttatcaacatgtgttaatatatctgttttttattatagttatcctagtgggtgcacagttgtatcttgttgatatgatttacagttccctaatggctaatgatgttgaggatctttcggtgtttattggccatttatatatattatttatttattatataataaatgtctgttaagatcctttgcccattttaaatttaggttatttgtctttttattgaattttaagggttctttatatattctggattaagttctttttcagatatttgatttgcaaattattttcccattctgtggattatcctttcccatttttatttcaatagtttttggggaacaggtggtttttggttacatagataactactttagtgctaatttctgagatttttggcacccatcacctgagcagtgtacactgtacccaatgtgtagtttttaactctcacccaactcccacccttcctcctgagcccccaaaatccattatatcattcttatgcctttgtgtcctcataggttagctcttacttatatgtgagaacatgtaatatttggtttttcattcctgagttacttaacttagaataatggtctccaactccacccaggtttctgtaaatgctattatttcattcctttttatgacagagtagtattttacggtgtatatataccacattctctttattcactcattggttgatgggcatttaggctggttccatatttttctgcgattggaaattgtgcagctataagcatgcctgtgcatgtgtctttttcatataatgattttttttttcttctgagtagatatccaatggtgggattgctggatcaaatggtagttctacttttagctctttaaggaatatctatactgttttctataggagttgtactagtttatattcccaccagcagtgtaaaagtgttcacttttcaccacatccacgccaacatctattattttttgatttttaaattatggtcagtcttgcaggagtaaggtggtatctcattgtggttttaatttgcattttcttgataattaatggtcttgagcatttttcatgtttgttgaccatttgtgtatcttcttttgagaattgtctattcatgtcctttgcccaatttttcatgggattattatatttatatttttattttttgctgatttgtttgagtttcttgtagattctggatattagttgtttctcagatgcatagttagtgaatattttctcccattctgtgggttgtctgtttactctgctgattatttcttttgctgtgcagaagctttttagtttaattaggtcccatttatttatgtttgtttttgttgcatttgcttttgggttcttggtcatgaactctttgcctaagccaatgtctagaagagtttttccaatgttatcttctaggatttttatggtttcaggttttagatttaagactttgatccaccttgaggtgatttttgtataaagtgagagatgaggatccagtttcattcttctacatgtggcttgccaattatcccagcaccatttgttaaatagggtgtcctttccctaccttatatttttggttgctttgttgaaggtcaaataccttgtcaaaatattcagctgtatttctgggttctttattctgttccatttgtctacatgcctatttttataccagtaccatgctgttttggtaactatagccttgtagtatagtttgaagtcagataatgtaatgcctccagatttgttttctttaactgtctttgatggtgtcctttatagcgcataagtttttgctttggacagagttcaatatgtctgttttttgtttcattgcttgtgtttttggtgttttatttaagaaaccattgtctacctttccacagtgtagacatacatcaaaacaccatgttctaaccataaacatttataatttttgtcaattaaaaaataatttaaaaaaacattacctaattgaagtcactaagatttaaacagatttctttattcttagagttttatagctttgacttttatatttaaacgtacgatccattttgagttaatttttgtgtatgttataagtaagggatttaacttgattcttttacatgtggatatagagttgctacagcaccatttgctgaaaggattagtctttcctcaatgaattgtcttggcactcttttcaaaaatcaatggactgaaaatgtgaggatttatttctggaatctcatttccgttccattaatctatatgtctatccttatgccaataccttattttcttgattactttaggtttgtataagttttgaaatagaaaaatgtgagttacctaactttgttctctttcaagattgttttgttattatgagtctcttggatatctatttaaattttaggattagtttgtcaattttttttattatactttaagttttagggtacatgtgcacaatgtgtaggttagttacatatgtatacatgagacatgctggtgcgctgcacccactgctcaatgaaataaaagaggatacaaacaaatggaagaacattccatgctcatgggtaggaagaatcaatatcgtgaaaatggccatactgcccaaagtaatttatagattcaatgccatccccatcaagctaccaatgattttcttcacagaattggaaaaaactactttaaagttcatatggaaccaaaaaagagccagcatcgccaagtcaaccctaagccaaaagaacaaagctggaggcatcacgctacctgacttcaaactatactacaaggctacagtaaccaaaacagcatggtactggtaccaaaacagatatagatcaatggaacagaacagaggcctcagaaataatgctgcatatctacaactatctgatctttgacaaacctgagaaaaacaagcaatggggaaaggattccctatttaataaatggtgctggaaaaactggctagccatatgtagaaagctgaaactggatcccttccttacaccttacacaaaaatcaattcaagatggattaaagacttaaacattagacctaaaaccataaaaaccgtagaagaaaacctaggcattaccattcaggacataggcacgggcaaggacttcatgtctaaaacaccaaaagcaatggcaacaaaagccaaaattgacaaatgcgatctaattaaactaaagagctactgcacagcaaaagaaactaccatcagagtgaacaggcaacccacaaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcggagaaatgcaaatcagaaccacaatgagatatcatctcacaccagttagaatggcaatcattaaaaagtcaggaaacaacaggtgctggagaggatgtggagaaataggaacacttttacactgttgttgggactgtaaactagttcaaccattgtggaagtcagtgtggcgattcctcagggatctagaactaaaaataccatttgacccagccatcccattacggggtatataccgaaaggagtataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagaacacatggatacaggaaggggaacatcacactctggggactgttgtggggtggggggatgggggagggatagcattgggagatataactaatgctagtttgtcaatttttgcaaaaaagccagctgggattttgacagagattgcattgattttaatatcaattcggagagtattgccacattaatgtttaatctatagatatctgggatgacttttatttagatcttcaagttttaaaagaatattgtgtagttttcagagtacaaattttgcacttcttttgttcattttattcctatatattttattcctttggattctacttattataaatggggttctttattttatttttggatagtttattgttagtatgcaggaatacaattgactttttatttttttaatatttcacttttaagtcctcataaaagcctttattatagcctaatggtaaagcactggatttataatggtgattttgcaacatggtgaatcaagacatttatcttcataaaaacactttgaagcagtgacttcaactcaccgtttctatagttctgacaacaattaatgtcatttttcttcttttggcattgatggatgcttgatcatgcaactatataaagtacccatgcccttatcaataaacaatatccttggtcaatgaataagggtgtgtacaatttttaaaattttttccgtatagtttcttttgtaccctgtcacccaggctggagtacagtggtgtgatcatggtttactgcagcctcaacctcccaggctcaagtgatcctcctatctaagcctccagagtatctgagactataggcatgcaccaccatgcccagctaatttttttttttcttaatagagacaagatctctctatcttgcccagggtggtatcgaactcctgggctcaagtgatccacctgccttgacctcccaaagtgctgggattacaggtgcaagtcactgcacccagcccattttccatatagtttctaagcaattgtcaggcattgttctaacaagaaatggatcttacagacatgcttgaaatagattcacttaaagagctgttgaacaaatatgatatgaaatataaacttggagtggggaaaactactcattataaataagcagcagtggaaatctatacagtaattttttgccagtagctccaatagccttgaaagatctcacaattgactttttttttttttttttttttgagatgaggtcttgttctgttgttcaggctggggcgtagtgacatgatcatggctcactgcagcttcaacctcctgggctcaagtgatccttctgccttagcctcctgagtagctgggactgcaggtgtgcgccatcatgcctggtgaatttttccttttttttttttttttgtagagatggggtcttgtaatattgcccaggttggttttgaactcctgaactcaagcaatcctcctgctttggcctcccaaagtgctgatattacagacatgggccactgtgcctagcccacaattgagttttttacattaattttgtaactttagcttgcagagctcctttattagttctaataattttttagtgtatttcttaggattgcatttatacaaaattgtgttccttgcagatagttttagttcttccttcctatctggatgtgtcttacttctttttcttgtctaattgctctggatgggatagaaccttcagtacaatattgaatagaggtggatagagtggaaatacttgtttgattcctaaccttagaaggaaaacattgattctttcactaatttttatgatgtaggttttttatacatgccatttattagatgtataaggcaggaacagaaagaaaagttgaaagaattatattgtgaacactcactaatatgtatattcttaccactaatatttgacagttatcattcacttatcatgtatctatctatccatctgtccacccaggtatctatattattttgtggatgcattttcaagttgcagatgtcagtatactttaccctttaacacctccgtatacataacattgaatagattttaatatttgtttctaataatttcttaacattttttgaggtgtaatttatatgcagagaaatcacaaattttattgtaccattttatgagttttaactaatgtatatgcttgtgtaatccaaattgctatgaaaatacagaatattacatctttactcaaaaaagtttcttcatattccttcccaatcaataactcttcaagacaactactgttctgattttataaacttgtgtatggcttcttagcatagttttttttgagaatcatttgtgttgttgcatctatcagtagtttgtgtcttttaattgtttagtagtattccattgtatgattatatcatatcacagtttgtttttttaattcttttgttggacacctgggctgtttccagatttttactattttgaatacagctggtagggtcttacttatacaaatcattttatgaacatatgcttttaattttcctgaatatatgcataggagtggaattgctagattgtaagacagatgtatatttagttttataagaaactgcaagatattttaaaaaagtgtttgtatcattttacactcccatcagcaatgtatgagtttaggttactccatctctgtgttaatgtttggtggtagcttttttttttcctttaaactaattttagacattctggtggctatataatggtatcttgtgattgtaatttttatttccctagagacttattggtattatttgctctctttcagacagttcggcatggttttcctcatcagcccacagcattagcctttgatccagttcagaaaatcttggctattgggacgagaacaggtgctatacgaatgtatccttaaattttggttcattatctgccacagtaatgccaattacatttctttaaatattcaggtaagataaatatttatgaccaaataaagtttattattttttaagaaatgagtaactattgtgaaaaatctgcactttcaaatttattggcatatttttaatgtctttgagatcagtattgatgtctcttctttaactcctgttatttgtaatttgtatcttctcttttttccttatccatctgcctagaagtttatcaattgtattgattctcatgattctcacaaagaatcaacttttgggtgcgttgctcttctttattgtgtttctatattcgatttcattgaattctgctttaatcacttaaatttctttgcttttgcttacctggggtttaatttgatcttctttctctagtttttaaagtggaaacagttaattaatttgagaactttcttcttttctaatatgtgcctatagtactataaatttcctcccaaattctactttagtgtcatcttgttttttaaaattaaactttttgagataattaattgtagatgcacatgtagttataagaaataatacagagatatccatattctttcacctactttgctccaattgtagcatcttaaaaaactatagtgtaatatcacaaccaggatattgacattatacaatcaagatacaaaacatttctatcaccacaaggattcttcatattgctcttttatggtcacaccttgtccctccaaccccatccttgacccctaacaaccactaatttgtttttcatttcaataattttgccacttcaaaaatgttatataaatggaatcatacagtttataatttttggcgattggccattttcactcagtataactctctgaagattcattcatattgttgcatgtatcaatagtttattcctttatactgaattggataatattccatggtatagatgtaccacagtgtagccattcacctattcaaagaaatttgacttgtttctggtttttggctattcttactaaacaactatgatcatctgtgtacatatttttgtgtgaacctaagtttttgtttctctggtgtaaatgcccaggagtacaactgaagggtcatgtggtaattagatattttagttttaatttttttagtgtaccattcagcgttattaaatacatttatattatgcaaccatcatcaccgtccttttctgtaaatctttcactttgtaaaactgaaactctacacccattaaattataactctccatgtccctcttcttctagcccctggaaaccaccattctgctttctgtttctataatttttactactctaggtaacttatataagtgaaagcatacagtattcttcttttttgtgactggcttatttcattcagcataatgtcctcaacgtttatccatgttgaagcatatgtgagaacttccttcctttttaagactgaataatatttcattgtgtgtatatatcacattttgatatctgttcgttaatttatgggcacttgttttttccatgttttagctattatgaataatattgctatgaacatgggtgtacaaatatctctttgaaatgttgcttttagttcttttgggtatatatccagaagaagaattgctggatcatatgataattgtatttttaattttttgaggaactgtcattctgtttctcatagcagctatactggtttacattttcaccaatagtaattgccctttgatgcaaatattttaaattttaatgaagttcaagttggctatttttttcttttgttgcctgtgctttggtgtcatatgtaagaaatctttaccaaatccaatggaatgaagcttttaccctgttttcttctaagagttttatagttttaggttttacatttgggccttttatccatttctgagtgaatttttgtatatagtaaaagggtctaatctcactatttggcatgtggatatcccattttcccagaaccatttgttgacaagactgtcttatccattgaatggtactggcacccttgtcaaaaaattatttgatcatacatgttagggtttgtttgtgggctctcctattctattccactgatctataggtatgtttctatgttactactacactgtttttatttactgtagctttgtagattggaaaccagatagtgtgaaatttgaaattagatgaattttcagcacttattgaaatgatcggatagtttttgttattgattatgttactgtgatatatgatatttattgatttgcatatgctgaaccattcatgaattcctgagatgattcccacttgataatgataagtgatttttaaaaaatatgttgtcttgttgaaattgatttgtgagtattttgttgaggatttttgcatctaggtttatcgaggatattggcttgtagtgttcttttttgttctgtctttgttggttttggtattaggataatgccggcctcatagatgagattgaaagtattccctgcttttcaatttttttcttaagagtttgagtagaagtagtattagttctttaaatgtttggtagacttctgaattactactgagtacataacgaaatgaaggtagcaataaagatgttctttgaaaccaacgagaacaaagatacaacataccaggatctctgggacacatttaaagcagtgtgtagagggaaatttatagcactaaatgcccacaagagaaagcaggaaagatctaaaattgatgccttaacatcacaattaaaagaactagagaagcaagagtaaatacattcaaaagctagcagagacaagaaataactaagatcagagcagaactgaaggacatagagacacaaaaaacctttcaaaaaatcaacgaatccaggagctggttttttgaaaagatcaacaaaattgatagaccgctagcaagactaataaagaagaaaagggagaagagtcaaatagacacaataaaaagtgataaaggggatatcaccaccgatcctgcagaaatacaaactaccatcacagaatactataaacaactctatgcaaataaactagaaaatctagaagaaatggataaattcctggacacatacaccctcccaagactaaaccaggaagaaattgaatctctgaatacaccaataacaggatctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatcaggccagcatcatcctgataccaaaggctgacagagacacaacaaaaaaatagaattttagaccagtatccctgatgaagatcaatgcaaaaatcctcaatataatacaaaccgaatccagcaacatatcaaaaagcttatccaccatgatcaagtgggcttcatccctgggatgcaagtctggttcaacatatgcaaatcaataaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctctaaataataagagctatctatgacaaacccacagccaatattatactgaatgggcaaaaactggaagcattccctttgaaaactggcacaagacagggatgccctctctcaccactcctattcaacatagtgttggaagttctggccagggcaattaggcaggagaaggaaataaagagtattcaattaggaaaagaggaattcaaattgtccctgtttgcaggtgacatgattgtatatctagaaatccccatcatctcagcccaaaatctccataagctgataagcaacttcagcaaagtctcaggatacaaaatcaatgtgcaaaaatcacaagcattcttatacaccaaaaacagacagagagccaaatcatgagtgaactcccattcacaattgcttcaaagagaataaaatacctaggaatccaacttacaagggacgtgaaggacctcttcaaggagaactacaaaccactgctcaatgaacttaaagaggatacaaacaaatggaagaacattccatgctcatggttaggaagaatcaatgtcttgaaactggccatactgctcaaggtaatttatagattcaatgccatccccatcaagctaccaatgactttcttcacagaactggaaaaaactactttaaagttcatatggaaccaaaaaagatcccacattgccaagtcaatcctaagccaacagaacaaagctggaggcatcatgctacctgacttcaaactatactacaaggctacagtaagcaaaacagcatggtactggtaccaaaacagagatatagaccaatggaacagaacagaggcctcagaaataatgccacacatctacaaccatctgatctttgacaaatctgacaaaaacaagaaagggggaaaggattccctattttataaatgatgctggtgggaaaactggctagccatatgtagaaagctgaaactggatcccttccttacaccttatacaaaaattaattcaagatggattaaagaattaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctacacagcaaaagaaactaccatcagaatgaacaggcaacctatagaatggaagaaaatttttgcaatctacctatctgacaaagggctaatatccagaatctacaaagaactcaaacaaaaatttaccagaaaaaaacaaacaaccccatcgaaaagtgggcaaatgatatgaacagacacttctcaaaagaagacatttatgcagcccaaagatacatgaaaaaaatgctcatcatcactgggcaacagagaaatgcaaatcaaaaccacaatgagataccatctcatgccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattacggggtatataccgaaaggagtataaatcatgctggtataaaaacacatgcacacgtatgtttattgtggcactattcataatagcaaagacttggaaccaacccaaatgtccatcaatgatagactggattaagaaaatatgacacatatacaccatggaatactatgctgccataaagaaggatgagttcatgtcctttgtagggacatggatgaagttggaaaccatcattctcagcaaactatggcaaggacagaaaaaccaaataccgcgtgttctcactcataggtgggaattgaacaatgagaacacttggacacaggaaggggaacatcacaccctggggcctgttgtggggtgggggcaggggggagggatagcattaggagatatacgtaatgtaaatgacgagttaatgggtgcagcacaccagcatggcacatgtatacatatgtaacaaacctgcacgttgtgcacatgtaccctaaaacttaaagtataataaaaaaaaaaggaattcagccatgatactatcaggtcttgggattttctttggtgaaagattttttttaaattactgtttaaatcttattactcatttttgatctgttcaggatatctatttcttcatatttcaatcttggtaggttgtatatgtctagaaatttatcaatttctttgaagttttaaaatttgttggtgcatagttgttcgtaatagtttctaatgagcctttgtatttctgtggtatgaaatataatatctcctttttagtttttgattttatttagttttttttttcccccgtgatacatctctttgttcactgaggtcaattagaggctatactttagtctttctttttttgttttttttttttaattatactttaagttctagggtacacgtgcacaacgtgcaggtttgatacataggtatacgtgtaccatgtttgtagctgcacccatcaactcatcatttacattaggtatttctcctaatgctatccctcccccagccctcgtcccccaacgaggccccagtgtgtgatgttccccgccccgtgtgtgagtgatctcattgttcaattcccctctataagtgagaacacgcagtgtttggttttctgtccttgcgatagtttgctgagaatgctggtttccagcttcatccatgtccctgcgaagggctagaactcatccttttttatggctacatagtattccatggtgtatatgtgccatattttcttaatccagtctatcattgatggacatttgggatgcttccaagtctttgctgttgtgaatagtgccaccataaacatacgtgtgcatgtgtctttatagtagtatgattgataatcctttgggtctatacccagtaatgggatggctgggtcaaaaggtacttgtagttctagatccttgaggaatcgccacactgtcttccacaatagttgaactagtttacactcccaccaacagtgtaaatgcattcctatttctccacatcctccccaacatctgttgtttcctgactttttaatgattgccattccaactggcatgagatggtatctcattgtgggtttgaatttcatttctctgatgaccagtgatgatgagcattttttcatgtgtcttttggctgcgtaaatgtcttcttttgagaagtgtctgttcatatcatttgcccacttttcgatggggttgtttgtttttttctggtaaatttttgtttgagttctttgtagattctggatattagccctttgtcagataggtagattgcaaaatttttcttccattctataggttgcctgttcattctgatggtagtttcttttgctgtgtagaagctctttagtttaattagatcccatttgtcaattttggcttttgttgccattgcttttggtgttttagtcatgaattccttgcccatgcctatatcctgaatggtattgcctaggttttcttctagggtttttatggttttaggtctcacatgtaattctttaatccatcttgaattaatttttgtgtaaggtgtaaggaagagatccagtttcagctttctacatatggctagccagttttcccagcatcatttattaaatagggaatcctttccccatttcgtgtttttgtcagatttgtcaaagatcagatggttgtagatgtgtggcattatttctgagggctctgttctgttccattgatctatatctctgttttggtaccagtaccatgctgttttgcttactgtagccttgtagtatagtttgaagtcaggtagcatgatggctccagctttgttcattttgcttagaattgtcttggcaatgcaggcccttttttggttccatatgaactttaaatagtttttccaattctgtgaagaaagtcattggtagcttgatggggatggcattgaatctataaattaccttgggcagtatagccattttcactatattgattcttcctatccatgagcatggaatattcttccatttgtttgtgtcctcttttatttcattgagcagtggtttgtagttcttcttcaagaagtccttcacatcccttgttagttggattcctaggtattttattctctttgtagccgttgtaaatgggagttcactcatgatttggctctctgtttgtctgttaatggtgtataagaatgcttttgatttttgcagatttattttgtatcctgagactttgctgaagttgcttatcagcttaaggagattttgggctgaggcaatggggttttctaaatatacaatcatgtcatctgcaaacagggacaatttgacttcctcttttcccaattgaatgccctttatttctttctcttgtttgattgccctggccagaacttccaacattatgttgaataggaatagtgagaaagggcatctctgtcttgtaccagttttcaaagggaatgcttccagtttttgcccattcagtatgatattggcagtatgtcataaatagctcttattattttgagatatgtgccatcaatacctagtttattgagagtttttagcatgaaagggtgttgagttttgtcaaaggtcttttttgcatctattgagataatcatgtggtttttgtcatttgttctgtttatttgatggattatgtttattgatttgcatatgttgaaccagtcttgcatcccagggatgaagctgacttgatcatggtggataagctttttgatgtgctgctggatttgttttgccagtattttattgaggatttttgcagcaatattcatcagggatagtggtctaaaattctcttttattgttgtgtccctgccaggcttttgtatcgggataatattggcctcataaaatgaatttgggaggatttcctctttttctattgattgaaatactttcagaaggaatgataccagctcctcttagtacctctggtagtattctgctttgaatccgtctggtcctggattgtttttggttggtaggctattaattattgcctcaatttcagatcctgttattggtctattcagagattcgacttcttcctggcttagtgttgcgagggtgtatgtgtcgaggaatttatccatttcttctagattttctagtttatttgcatagagttgtttacagtattttctgatggtagtttgtatttctgcaggatcggtggtgatattctttttatcattttttattgcatgtatttgattcttctctcttttcttctttattagtcttgctagtggtctatcaattttgttgatcttttccaaaaaagcagctcctggattcattgatgttttgaagggttttttgtgtctctatctccttcagttctgctctgatcttagttatttcttgccttctgctagcttttgaatttgtttgctcttgcttctctagttatattaagtgtgatgttaaggtgtcgattttagatctttccttccttctcttgtgggcttttagtgctatacataccctctatacactgcttaaatgtgtcccagagattctggtatgttgtgtctttgttctcattggtttcaaagaacatctttatttctgccttcatttcgttatttacccagtagtcagtcaggagcaagttgttcagttccatgtggttgtgcggttttgagtgaatttcttaatcctgagttctaatttgattgcactgtggtctgagagacagtttgttgtaatttctgttcttttacaattgctgaggagtgctttagttccaattatgtggccaattttgaaacaagtgtgatgtggtgctgaaaagaatgtatattctgttgatttggggtggagagttctgtagatgtctattaggtctgcttgttgcagatctgagttcaggtcctggacatccttgttaaccttctgtctcattgatctgtctaattttgacagtggggtgttaaaatctcccattattattgtgtgggagtctaagtctctttgtatgtctctaaggacttgctgtatgaatctgggtgctcctgttttgggtgcatatatatttacagtagttagctcttcttgttgaattgatccctttaccattatgtaatggccttctttgtctcttttgatctttgttggtttaaagtctgttttattagagactaggattgcaacccctggttttttttgcttgtttgttttccatttgcttggtagatcttcctccatctctttattttgagcctatgtgtgtctttgcatatgagatgggtttcctgaatacagcacactgatgggtgttgactgtttatccaatttgccagtctgtgtcttttaattggggcatttagcccatttacatttaaggttaatactgttatctgtgaatttgattctgtcatgatgttcactggttgttttgtcagctaattgatgcagtttcttcatagcatcgatggtctttataatttggcctgtttttgcagtggctgatactggttgtttctttctatgtttagtgcttccttgaggagctcttttaaggcaggcctggtgtgacaaaatttctgagcatttgcttgtctgtaaagaattttaattctccttcatttatgaagcctagtttggctggatatgatattctccattgaaaattcttttctgtaagaatgttggatattggcccccactctcttctggcttgtaggctttctgctgagagatctgttgttagtctgatgggcttccctttgtgggtaacttgacctttctctctggctgcccttaacattttttccttcatttcaaccttgttgaatctgacagttatgtgtcttggggttgctcttctcaaagagtatctttatgatcttctctttatttcctgaaattgagtgttggcttgtcttgctaggttggggaaattctcctggataataacctgaagagtgttttccaacttggtgccattctccccatcactttcagatacaccaatcaaatgtagaattggtctcttcacatagtcccatatttcttaaaggctttgttcgtttcttttcactcttttttttctctaaacttctcctgtgactttatttcattattttgatcttccatcactgataccctttcttccacttgatcgaatcagcttttgaagcttgtgcatgcgtcacaaagttcttgtgccatggttttcagctccatcaggtcatttaaggtcttctatacactgtttattctagttagccattcatcttatcttttgtcaaggtttttagcttccttgcaatgggttcaaacatcctcctttagctcggagaagtttgttattactgaccttccgaagcctacttctgtcaacttgtcaaagtcattctccgtccagctttgttccgttgctggcgaggagctgtgatcctttggaggggaagtggcagtttgatttttagaattttcagcttttctgctctggtttctccccatctttgtggctttatctacctttggtatttaatgctggtgacctagagatggggttttggtgtagatgacctttttgttgatgttgatgctattcctttctgtttgttagttttccttctaacagtcaggtccctcaactgcaggtcttttggagtttgctggaattcctctccaggtcctgtttgcctgggtatcaccattggaggctgcagaacagcaaatattgcagaacagcaaatattgctgcctgatccttcctctggaagcttcatcccagagtggcagctgtctatatgaggtgttggcccctactgggaggtgtgttccacttaggctacaagggggtcagggacccacttgaggaggcagtgtgtccgttctcagagctcaaatgctgtgctgggagaatcactgctctcttcagagctatcagacaggggcgtttaagtctgcagaagttgtctgctgccttttgttcagctataccctgcccagagagttggattctagaggcagtagagcttgttgagctgcagtgggctctgcccaattctagcttcctggttgctttgtttacctactcaagcttcagcaatggtggacgcccttcccctagccaggctgccgcttggcagatcaacctcagactgctgtgctagcagtgagcaaggctcagtgggtgtgggacccactgagccaggcacgagagagaatcgccttgtctgccggtttttaagaccttgggaaaagtgcagtatttggtcggggagtgtcctgtttttccatgtagtctgtcaccgcttcccttggctaggaaagggaaatttcccctccccttgcacttcctgggtgagacaatgcatcaccctgcttcagctcaccctccgtgggctgcacccactgtccaaccagtcccagtgagattaagcaggtacctcagttggaaatgcagaaatcacccatcttctgtgtcaatcacactgggagctgcagactggagttgttcctattcggccatcttcagttgtgtgattttctagagtagcgctaagctgcttggcctagcaagcctgggctgggatttttaggtctctcttttgttcttactctagctaaaggttttcaatttcgtttattttttcaaaacatcatttttattttgttgatatttgtttagtctcaattttatatctttatactctaatgtttattatttctttccttctactaattttgggtttgaatttttcttgctttccatttcttgaggtgcagtgttaggctgttcatttgaagtctttctaatttttatgatgtaggctttttattgctataaacaactttcttcttagaactgcttttgctgtatttcataggttttagtatgttgtgtttccattttaatttgtctcaagaaaattttcaattttcttttaaacttcttcattaaaccattcattgtttaggaatatgttgcttaataattatgattttgtacagtttctgatattccttctgtggtttacttctaattttatcccattatggtcagaaaagttatttaatagttttgacttctaaaaatttattaagatttgtttcgtgacctaacatatggtctgtcctagagaatgttgcatgtgctgttgagaaaaatgtgtattctgcggctattggatgcaatgttctataaatgtctgtttggtccatttggtcaagagttcagtttagctctgatgtttcttagttgattttctgttcagatgatctgtctaatgctgaacatggagtgctgtggttttctactgttattgtgtcacagtcagtctctctctttaggtctgttaatatttgtcttttatatttgggtgctctggtgttgactgcatatatctttataactgtaatatcctgttattgtattgaccccttcatcatcatataatgaccttctgtatctttttttatcattcttgactaaattttattttgtctgatataagtatagctactgctgctgtatgttggcttccatttgcatgtaatatcttattcatcccttcactttcagtttgtgcatgtctatactggtaaatagagtttcttgtagacagtatatagttggatgttttaaaaatccattcagccaccctgcattttaatttttaaaataaatttcaaaagctttgggggtacagattgtttctggttacatagataagttttttagtggtgatttctgatattttagtgcacctgttacctgagcattgtatactatacccaatatatagtcttttatccctcccccgttctgagtatccaaagtccattatatcactcttatgcctttgcatcctcatagcttagctctcacttaaaacatatgatatttgattctttattcctgagttacttcacttagaataatggcctcccgctccatctaagttcctgcaagaggcattatgtcattcctttttatggctgagtagcatttgtatatatgccattttttctttatctacttgttggttgatagacacttaggttagttccatatctttgcaattgtgaattgtgccaccataaacgtgtgtgcatgcatctttttcatataatgacttattttcctttgggtagatactcagtagtgggattgctagatcaaatggtaattttacttgtggttctttaaggaacgtctatactgttttccatagtgtttgtactaatttacattcctatcagcagtgtaaaagtgttccctttttaccacatccatgccaacatctatttttttttttaacttttaatttatagccatgcttgcaggagtaaggtgtaatctcatcatggttttaatttgcatttccctgataattagtgatgttgagtgttttttcatatgtttgttggttggttgtgtatcttttttgagaattatctattcatgtcctttgctcatttttcgatgggattatttgtgtttttttttttttttcttgttaatttgtttgagttccttgtagattctggatactagtcctttgttggctggatagtttgtgaagattttctttcactctgtgggttgtctgtttgctgattatttcttttgctctacagagctttttagtttaattaggtcccatttatttttggttttgttgtatttgcttttggagtcttaggcatgaattcttgcctaagtcaatgtcttgaggagtttttccaaagttatcttgtagaatttttatcgtttcaggtcttatatttaagtcttttatctatattgacttgatttttgtgtaaagtgagagatggagatccagttttatttttctacatgtggcttgcactcttttaattgaagacttttgtccacttaccttcaagattattttctgtttacattttattacttgttttctggttgttttgtagatactttctttctgttttcctctgttactgttttcctttgtggttaagtgaatttctctggtagtatgttttgattttgtgctacttatttttagtctattacaggtttttgcattgtggttactatgaggcttccaaaaaatcaggtcatttaaaactgattatgacttaacttttattgcatagagaagaaaagtattataagaaaaccaaaccctaccctttaacacccccccaataatttgatttattggtgtttcagtttacgtctttttatattatctgtttcttaaccagttattgtagtaattattgattttaataggtttttgtcttttagccttcatactcaagatgtaaatggcttacttattcaaattacagttttagaatattctgaattagtctttttttcttttatcagtgaattttacaccttcaaatgttttcttattatacactagtgcccatttattttagattgaatagcttttagtatttcttgtaagacaggtcacattttgatgaattctctcagcttctgtttgtttgggaatctttgaatgtgtttaaatgatacttttgctgggtacagtatttttggatggcaatttttcccatctctttttcaatataacatcccattatcatctggacagcaggatttctgctgagaaatctgctgcaatctgtattcaggatgctgttcaatatgatgtttcttttcttttgttgctttgagtatcctgtcttttcatttcactgattatgatatgccttagagatttctcctttgggttgaatttgatgggtggcccctgaacttcctatacctggacgatgtcttctttctctagattttggaatttttaaaccattattattattttttttacatgtgctttccaggtctttttcttcgtgtctcctgaacactggcctgctgtttttttccattctaggggaacttatattgagcacaggaactaaaacaattcactggaactaacttattgctcttccattgttgtctggtctggggaagacttacagtgaacaacagaacttaaatgctgctctggaattaaaaccctgccctgttgtttcctgaactggggaacacttacagtgagcaccaaatgttagacattgccccagaactgtattgtagccctgccattgtttcccagtctggggaagacttaagcagaaactaggacttaattctgacattttagttatttctctgtaggggggaggttccagattgagcatctgggcattgggaaaaatctggttagaaatttgggccttcctgcagattgcgttctctgcagccttatggtaccagtcagttgcttttacaattttatttatttaagaaaatttttttgtaaatttttcaagtgcaattttgttacatggatatattgagtagtggagaaattgaggattttgtacccgtcacccaagtagtgtacattgtactcagtaggtactattttatccttcacccgcaccccccccaactccttaactccatcccaccttttggagcctccaatgtctattattcaactctgtgtgtctatgtgtacccactgtttagcttctgctaaacatgtggttagtgagaacatgtggtttttgactttctatttctttctatttctgagtcatttcacatcttaggatagtggcctccagttccatccatattgctgcaaaatacacgactttattctttttatggctgagtagtattccatggcacatgcatacatacacacacacacacacacacacacatatacattcatctatatacacacatatataagcaccatggaataatacatatatgtacacacacatatatgtgtgtatatatatatcacattttatatatgtgtatatatgtgtatgtatatatatatatacacacatatatatatatgtctgtgccatggaatactggtataatatactattataatatccatgcgcacacatgcatgcacacacacacagaagtgtatatgactgttttttaaccaacccttcatatcattcattgatgagcacttagattgattccatgactttgctattgtggccagtgctgtgacctactgtgacaaacggggaatgtgatgtctctagctttattctttttgcttagaatttctttggctattgggacatttttttggtttatatgaattttacaattattcttattctatggggaatgatgttggcattggtaatttgataggaattgcattgaatatgtacattgatttgggcagtatggtcattttaatgatattgattcttccaatctataagcatggatgtttttccattatttgtgtcatctatgatttctttcattgttgttttgtagttctccttgtagagatctttcacctccttggttaaatgtatttctagatatacatttttctagccattgcaaatccgattgaattcttgatttgcttctcagcttcatcattattggtgtatataaatggttttgatttttatacaatgatttttatattctgaaactttactgaattcatctatcaaatctaggagtcttttggaggagcatttagggttttgtagatataagaatatgtcatcagtgaacagagataatttgactttctcttttccagtttgcatgcctcttatttctttctctcttttgttactctagctgggacttccagtactatgttgaataggagtgctggaagctggcattcttgtcttttccagttgttagggggaatgctttcaactctacctcattgagtatgatgttggctgtggatttgttgtatacagcttttataattttgagatatgctccttgtatgcctagtttgttgagaattgttatcatgaaggggtcctggatattatctaatgctttttcttcatctattgagattatcaggtagtttttatgtttttaattcagtttatgtggtgaatcaaatttattgatttgcatatgttgaatcgtccttgcaattctggaataaaactcactctattgtggtgtattatcttcttgatgtgctgttgaatttggtttgctactattttgttgaggagtttttgcaactctgttcatcagagatattgatctatagttttcctttttgttgtgtgtccctgcctggctttggtatcaaaatgatactggtttcctagaatgagttatgtaggattcccttctcgatattttggcataactttagtagaaccaccataagttcttttttgtaaatgtggtataattcagctgtgaatttgtctggtcctaggcttttattttcgtaggagattcttaaattactgattgactttactgctcattattggtattttcttgatttctatttcatcctagttcaatctcgggcagttatatgttttcaagagtttattcacttcctcttggtttttagtttgagagtgtagaggtgctcataatggtctctggtgatttttttttgcatttctataatgtcagttgtaatgtcagaaattgccatttctaattatgcttatttgaatcttctcttttttattcttggttaatctagctagcagtctatcattttctaaaatattttcagaatactaacttttcatttctttgattctttatatttttttattatactttagttttagggtacatgtgcacaatgtgcaggttagttacatatgtatacttgtgccattctggtgtgctgcacccattaacttgtcatttagcattaggtaaatctcctaatgctatccctcccccatccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccattccctacaaaggacatgaactcatcctttttatggctgcatagtattccatggtgtatatatgccacattttcttaatccagtcaatcattgttggacatttgggttggttccaagtctttgctattatgaatagtgccgcaataaacatacgtgtgcatgtgtctttatagcagcatgatttatagtcctttgggtatataccgagtaatgggatggctgggtcaaatggtatttctagttctagatccctgaggaatcaccacactaacttccacaatggttgaactagtttacagtcccaccaacagtgtaaaagtgttcctatttctccacatcctctctagcacctgttgtttcctgactttttaatgattgccattctaactggtgtgagatggtatctcattgtggttttgatttgcatttctctgatggccagtgatgatgagcactttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaatattctcccatgctctaggttgcctgttcactctgatggtattttcttttgctgtgcagaagctctttagtttaattagatcccatttgtcaactttggcttttgctgccattgcttttggtgttttagagatgaagtccttgcacatgcctatgtcctgaatgttaatgcgtaggttttcttctagggtttttatggttttaggtctgacgtttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcaaagatcagatagttgtagatatgcggtgttatttctgagggctctgttctgttccattgatctatatctctgttttggtaccagtaccatgctgttttggttactttagccttgtagtatagtttgaagtcgggtagcgtgatgcctccagctttgttcttttggcttaggattgacttggcgatgcgggctcttttttggttccgtatgaactttaaagtagttttttccaattctgtgaagaaagtcattggtagtttgatggggatggcattgaatctataaattaccttgggcagtgtggccattttcacgatattgcttcttcctactcatgagcatggaatattcttccatttggttgtatcctcttttatttccttgagcagtggtttgtagttctccttgaagaggtccttcacgtcccttgtaagttggattcctaggtgttttattctctttgtagcaattgtgaatgggagttcactcatgatttggctctttgtttgtctgttattggtgtataagaatgcttgtgatttttgcacattgattttgtatcctgagactttgctgaagttgcttatcagcttaaggagattttgggctgagacaatggggttttctagataacaattcatgtcatctgcaaacagagacaatttgacttcctcttttcctaattgaataccctttatttccttctcctgcctgattgccctggccagaacttccaacgctatgttgaataggagtggtgagagagggcatccctgtcttgtgccagttttcaaagggaatgcttccagtttttgcccattcagtacgatattggctgtaggtttgtcatagatagctcttattattttgagatacgtcccatcaatacctaatttattgagagtttttagcatgaagagttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattctgtttgccagtattttattgaggatttttgcatcaatgttcatcaaggatattggtctaaaattctcttttttttgttgtgtctctgtcaggctttggtatcaggatgatgctggcctcataaaatgagttagggaggttttcctctttttctattgattggaatagtttcagaaggaatggtaccagctcctcttgtacctcgggtagaattcggctgtgaatccatctggtcctggactctttttggttggtaagctattgattattgccacagtttcagagcctgttattagtctattcagagattcaacttcttcctggtttagtcttgggagggtgtatgtgtccaggaatttatccatttttcctagattttctagtttatttgtgtagaggtgtttgtagtattctctgatagtagtttgtatttctgtgggattggtggtgatatcccctctatcatttttcattgtgtctatttgattcttctctcttttcttctttagtagtcttgctagcagtgtatcaattttgttgatcatttcaaaaaatcagctcctgggttcattaattttttgaagggttttttatgtctctatctccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattttcctctacacactgctttgaatgtgtcccagtgtttctggtatgttgtgtctttgttctcactggtttcaaagaacatctttattcctgccttcatttcgttatgtacccagtagtcattcaggagcaggttgttcagtttccatgtagttgagcggttttgagtgagtttcttaaccctgagttttagtttgattgcactgtggtctgagagacagtttgttataatttctgttcttttacatttgctgaggagagctttacttccaactatgtggtcaattttggaataggtgtggtgtggtgctgaaaaatatgtatattctgttgatttggggtggagagttctgtagatgtctattaggtccacttggtgcagagctgagttcaattcctggttatccttgttacctttctgtctcattgatctgtctaatgttgacagtggggtgttaaagtctcccattaatattgtgtgggagtctaagtctctttgtaggtcagtaaggacttgcttcatgaatctgggtgctcctgtattgggtgcatatatatttaggatagttagctcttcttgttgaattgatccctttaccattatgtaatggccttctttgtcccttttgatctttgttggtttaaagtctgttttgtcagagagtaggattgcaacccctgcctttttttgttttccatttgcttgtagatcttccttcatccctttattttgagcctatatctgtctctgcacgtgagatgggtttcctgaatacagcacactgatgggtcttgactgtttatccaatttggcagtctgtgtcttttaattgtagcatttagtccttttacattgaaagttaatattgttatgtgtgaatttgatcctgtcattatgatgttagctggttattttgctccttagttgaggcagtttcttcctagcttcgatggtctttacaatttggcatgattttgcagtggctggtaccagttgtttctttccatgtttagtgcttccttcaggagctcttttagggcaggcctggtggtgacaaaatctctcagcatttgcttgtctgtgaagtattttatttctccttcatttatgaagcttagtttggctggatatgaaattctgggttgaaaattcttttctttaagaatgttgaatattggcccccactctcttctggcttgcagattttctgccaagagatctgctgttagtctgatgggcttccctttgtgggtaacccgacctttgtctctggctgcccttaacattttttccttcatttcaactttggtgaatatgacaattatgtgtcttggagttgctcttctcaaggaggatctttgtggcattctctgtatttcctgaatgtgaatgttggcctgccttgctagattggggaaattctcctggataatatcctgcagagtgttttccaacttggttccattctccctgtcactttcagatacaccaatcagatgtagattccgtcttttcacctagtcccatatttcttggaggctttgttcgtttctttttattcttttttctctaaacttcccttctcactacatttcattcatttcatcttcctttgctgataccctttcttccagttgttcgcatcagctcttgaggcttctgcattcttcacgtagttctcaagccttggctttcagctccatcagctcctttaagcacttctctgtattggttattctagttatacatttgtctaaatttttttcaaggtttttaacttctttgcctttggtttgaatttcctcctgtagctcggagtagtttgatcgtctgaagccttcttctctcaactcgtcaaagtcattctccatccaggtttgttctgttgctggtgaggaactgcattcctttggaggatgagaggcactctgctttttagagtttccagtttttctgctctgatttttccccatctttgtggttttatctacttttggtctttgatgatggtgatgtacagatgggttttggtgtgtatatcctttctgtttgttagttttccttctaacagatgggaccctcagctgcaggtctgttggagtttgctagaggtccactccagaccctgtttgcctcggtatcagcagcggtggctgcagaacagcagattttcgtgaaccgcgaatgctgctgtctgatcgttcctctggaagttttgtctcagaggagtacccagccgtgtgaggtgtcagtctgcccttactggggggtgcctcccagttatgctgcttgggggtcaggggtcagggacccacttgaggaggcagtctgcccgttctcagatctccagctgcatgctcggagaaccactgctctcttcaaagctgtcagacagggacatttaagtctgcagaggttactgctgtctttttgtttgtctgtgccttgccaccagaggtggagcctacagaggcaggcaggcctccttgagctgtggtgggcttcccccagttggagcttcccggctgctttgtttacctaagcaagcctgggcaatggcaggtgcccctcccccagcctcactgccgccttgcagtttgatctcagactgctgtgctagcaatcagcaatactccgtgggcataggaccctccgagccaggtgtgggatataatcttctggtgcaccgttttttaagcctgtcggaaaagcgcagtattagggtgggcgtgacccaattttccaggtgccgtctgtcacccctttctttgactaggaaagggaactccctgaccccttgtgcttcccgagtgaagcaatgcctcaccctgctttggctcacgcacagtgcactgcacccactgtcctgcacccactgtctggcactccctagtgagatgaacccggtacctccgatggaaatgcagaaatcacccatcttctgcgtcgctcacactgggagctgtagactggagctgttcatatttggccatcttgactgccagctccgatcctttgtatttttgtttggtctcagtttcatttagttctgctctgatctttgttgtttcttttgttctgctacctttggctttgttcttgttcttgaggtgtgactgtagattgtcagttggagatcttattatctttttaaggtaggcatttaacactataagcttccctcttagcatttcttttgctgtatcctgtatgttttagtatgttgtgtttctgttttcatttgtttcaaaaaaatttaaattcctagcctaatttcattattgatgcaacaatctttcaggagcaggttgttcaatttccacatatttgtatctttttgatagtttctgttggtgttgatttccagttttaattccactgtagtctgaaaaaaatacttgatttcaatttaaaagttttattgacacttgttttgtggcctgacatatggtatattttgggggatgtttcatgtgcagaacaggagaatatatattgtgtggttgttggctagaatgttttgtaaatttctatctgttctatttagtctagagaccaatttaagtaaagactttctttgttgatttttctgcctcaatgatctgtttaatgctgtcagtggggtgttgaaatcccccactattattgttttgctatttatctcttagttctggtagtgtttgttttatgaatatgggtgctctatgtatatagaattgttatattttcttgttgaatttatcactttatcaccatataatgtcctgctttttttttttttaactgttgttgatttaaaatctattttatctggtgtaagtatagctattcctgctcatttttggtttccatttgcataaaatatctgtttctactttttgactttgagtctttaaatatctttatgagttaggtgggtttcttataagaagctatcattggatcttcttttttaaaattcattctgccaatctatatctttcaagttaggcatttagttcatttacattcaaggttaatattcatatgtgaggtttttgtccctgtcataatgttaattgttacttagatggtttgcaatcttggttgtgtaattgttttataagttctataagttttttatattcctgtgtttttatgatggcattgcccattcatttccacgttttgaactccattgaaaatttcttgtatagctggtctagtagtgatgaattcccttagccgtttcttgtctaggaaatattttattttattttcattaatgaagcttaatttagcaggatacaaaatcctttgctagattttttttttcttcaaagagactgaaaataggaacccagcatcttcttgtttgtaaggtttctgctgagaagtccactgtcagtctgatggtatttccttcatagctgattagccccttctttctttccacttttaggactttctctttcatgttaactttggatcttctgatgagtatatgccatggtgaagtttgtcttgcaatgtatcttccaggagttttctgactttcttgtatgtgaatgtcaaatctctagcaaaaccagggaagttttcctaaattattccctcaatttttttaatactttttacatcttcttctgaaacaatgataactcatagcttagtaagtttaaataatcccatgtttctcaaaggctctgctcatttttattctttaattttttttgtctaactgggttaattaaaaagctctgttttctagctctgaagttgtttttgtttgttctagcctattattagggctttgatctctatattgtggttcctttaatgaatttttagttctagaagttcttttttaaaaaataattatccttagtaagttttcgattcatattctgaattgttttttctgattactttgtattggttttcaactgtctcttggatcttattgagctttcataccatccatattttgaattctttatctttgaattttcattttgaataagatccattgctagaaagctgatgtgatcctttgcaggtggtacaacactttgttttttcatattgccagtgttcttatgctggttccctctcatctgaagaagccatcacttcttatctttgagtttagttttgttttgatgggacattgtttttcctccttgaaggtatgattgtcctgtatgttgtgtatgattgtttggcttcaattctaggtgctttcaggtatcaaggtactgtatgagttccttggttatagatagcctttgtgcagtggctttcttaaatgccagttttagtagtgatgtcctgggtatttgagcaggctaattgccttctgcaataacaggattgtatttgtctcaggaagcttatctcattcctcaacactgtggacttccattatcaggttttgtattgtgttgtgcagttcaacccccaagctagtaagtaggtagcatctatgtgtaagagtggctgtggcagaagcagatgggtatgggcttgatctttgtttactgggaggtgctctctgttgtttcaggtgatgggccggtctgtagaatgcccagtttccaggaattccctgctgagcttccataggtggggggacaaagctgggtggaactggacatccaagctcacccatgaataccctattgacaagagaagacatcagcactgacatgagtggcagggagagctcctggtgaaatgtactgagctctctgaaggaggggagttggctgcaccagcttcacatcctaggcaggtgggaatgcaatccatttccctgttatacccctgtcccagggctcatgactctcagtttagtcagacatggttgtctacctccaggccacagtgtaactgagggctgcagaaaattcctgtcctatggctctctgtcgaagtggctttggagtagaacctcttatctcagctttgtggtgttcctggcctccaatgcaggaacactgctgctttgtatatagagggggagtggctccactttttggcatgtgcaagtgcatgccagctgtgatgttgtcagctggttgggttggcctgacttagaccctggactgatcaggtgccagttgtggtggactgggctaggcagtcccccaatttccaggcccctagatggccccttggatggtatgcatgagtcctggttggactggactgctggatttgtcctcaggtccctagggttcaggtgctgcctgtgatagggaggagtgggctggtccccagtcctgcagcagaatgctcaggcagggtggctgtgctgtggacctgccaccaagggaggctggacctttctctgccttgagcagtggaggcaggcagctgtgatacacatgttttgctcacacttccatctgacagcagtggtagtggtatctgtccttgaggcatatgaaagtgcctgacctgcctgcttctttctggcctgagggtggcagaggcagcagggatggcaggagtctaagggcagaacacaggcgtctggggtctggcctctcagagtggtgctggcttcagtggagatgctcagatgggggcagggtggcagcactgtgggtctgccatggcatatgtatatcggggcaggcgtctctcagtgggatcagcaaagtcaagcagttatggggtgctcagtttgctcacttctctgtcccacagcagtggtggtggtatctgtttttggggccttgtgaaggtgtttgagtgccctgctttctctctggccttgtggctggggcagtgatactgatggcagacccagggtaacacacaggcctctgggggttgggctctcagactgggactaggctacagctgctcagggctcaaaagcctgtgggacttcacatgagttcgaaaatgcctttgtgtaatttctaggcagttcccttttatcctggaggcctgggaggactgagggactcttctacagatagaattgaaaaaatctattataggagtgtggagccctaggggtctctcactcaccttttccccacatcagggagcttctatcagtttcacacctatcccagcccagtaggctgcttggattcattcttatttgctttctgtgattcttgtcacttctctgttgaattccagtgttctctcttagacaatccattcaaagtgtgtatatttacttgatattttgatttttcttaatggaagaggcacctactagctgcatctggccagccattttgaaccctccttccagtcagtctcttaactgtggcatccctggtgatcagagtgcagagtagctgctgagtttcacacgtcagttgctgtgatcagcatcctgctctttgttcctagttcaccccggatgattcagccactccactctcagtggttcccatgggatgggactggagtaggcttcctgttaagactcttctcttagactcatgaagaggttaaagattcacctccagttctcctctttcagctcagaaatcacaggtctagagtctctgtgagtgacattatgccagcttgggggataggctgatggagcctaaaatgactttttcttttaccagtaatggcttctcttgattttatggacgcagatattttctccacttctcctccaaacccagagttctggtgaactcaggatagtattctcatttttgaatagtttcttgaatttttgtgttgggaagtgatgccagggcatctactattctgctatcttgctgataccctgagatctcctgcatgctgactttgtgtcctactattttgctcaattcatttattagttctaacgggattttttttttggtggggggaatctttagggttttacatatgtaagatcatattatctgcaaacagagattacttacttcgttctttccaacttggatgcctttcatttctttctttccttttttttttttttttttttttgcctaattgctctggctagaacttctagtaagtaccatgttgaatagaagtggtgaaagtaggcatccttttcttattgttgattttaaaagaagagttttcagtctttcaccactgagtatgatgtatgatgtatgctgtgggttattcacatatagcctttatcgtgttgagttagtttccttttcttccttatttgttgagagtttttattataaaatggtgttgaattttgtcaaatgctttttctacatcaattgagatgttgtgtgttttttcccattcagtctcttattagatattacattgatcaatattcatatgttgaacaattcttgcatctcaggaataaatcccacttggtcatggtgtataattcttttaatatgctgctgtatttggtttgctagtatttttctgataatttcatgccagtgttcataagggatattgttttgtagctttttttttctagtagtgtatttgtgtgactttgttgttagggtactgttggccttacagaatgagttaggaagtactccctcattttcagtattttggaaaagtttgagaaggattggttttaatccttctttaaatgtttgttataattcctctgcgaagccatgggggcttttctttgtcaggagatgtcttttgtatatagttatgggttacaatatgatattttgatgtatgtatacatggcaaaatgattacatcaagctacttaacatatccagcacctgaaatatgtatcttttttgtagtgagagcatttaaaatgtgctgtcttagcaattttcaagtatacagtatactattatcaactatagtcaccatgctgtgtaatagatctctaaaactaattctcctaaatgaaactttgcattttttcaccaacatcagagatgagatttttttgacaactgagtcaatttctttattgttgtaggtctattcagattttctgtttctctgtggttagtgttggtagattttgtgtttctaggaatttgtccatttcttctagattcttcagttggttgatgtgtaattgttataggattgccttatcatcctttttatttctgtataatgagtagtaatattccatttttcatttctgactttagtaatttgagtcttctcttttttttcttcgttcatctagctaaaggtttgtgaattttgttcatctttccaaagaaccaacttttggtttcactgattttttctattgtttctctatttttaatttgtctctgctctaatctttattataccctttgttctgatggctgtgtgtttattttgttgttctttttctagttccttatgttataaagttatttgtttgagacttttttaaaaagtaaactaaaaattttggccttagcactgtttttgctgcatcccacgagttttggtatgttttcattttcatttgtatttaagtattttctatttcccttcatatttcttctttgatcaattggttgtttaacagtgtattgtttaatttcttcaaatttgtgactattgcagttttacatctgttgatttctaacttcatcccattgtggctggagaagatcctttgtatgttctgtatttttgaaatctagtgagacttaattattggcctaacgtatgatctgtcctgaaaaatgtgcacttgattagaatgtatatgctatggtttggtcgagtgttctgtatatgtctgttagattagttgatttattgtgttaaattctctctttatattctatctggttgttttatttaatattgtgagtttgacattgaagtatgcaactactatcatagaactgtctacttccttcaattttgtcagtttttgcttatattttgatggtctgtcattagataagtaaatattgttgtattgaaacattttgttaatatgtaattactttctttgtctcttgtaacctttttacatttaaagtacattttgtctaatattagtatagacacacctgttctgataacatgttgaaaaaactaaaggaagatatggagaaagtcaagaaaatgatgtataagcaaaatggaaatattgataaagaaatagcaaacaaaaaaatagaaatttgagagctgaaaattacaatactttaaataaaaaaattaccagaacaattcaaagacagatttaagcagacagaagaatcagcaaacttgaagatagcgcaatgaaaattattgagtctaaagaacgagaaaaggtggaacataagtgaatggaacagaagggacctgtgggacaccatcaagtggaccaacatgtgtatagtgggaatcccagaaagaaaaaagaaagttatagagagaatatttgaagaaataatgaccaaagctttccgaatttgatgaaagaaatgaatataagcatccaagatgctcaacaaactccaggtaagatggattcatattgagacacattataatcagactttaaaaagtcaagcaaagaaagaatcctgaaagcacatttaattttctaagaagatgccaaacaattttccagagtagtcgtacaattttgttcccaccagcagtgtatgaatggtctagtatttccacattattaccagaatattgtattatcagtatttttaagttttagtcgttttgataatgctgtagtaagaactaattgtggtactaattttcatttcatgctggctaatgacattgaataaacatgttatttgccatctgtataatatcttccttgaaatatgtatttatattttttgcccattttatattttgattatttcttttttgtaaagttgtgtttcaagagtttttatatattctagagactagtcctttgttggatatatggttttcatttattttctttcatttcttaacttgtattttcaccctcttaacttgacagggttcttcacagaggacggcttatcagttttttaaaaaatagattgtgctcgtggtttcacctcttagaattctttgcttagctctgaatattgatgattttttcctttttttaaaaaataaaatttacatttctacattttatacttaaatattagttttattaatattttatttgtgttgtcttaatttgattttgttatctgggtaatactatcttcataaagtaaattaggaagtattccttttatttgctttctggaagtttttgtgacaaattcttgttaattctttgttaaatgtttggtagaattctctggtgaaaccaactgggtctggagataatttcatgagagatttgatattccaaatttaatttacttagtaaattataggactattttgtttgttgccttcatcttggtttagtttttgtagtttgtcatcagtcttacctgatggtttttcaggtatatttatttttttttcaagaactagcctgttgctgcagttgattttctcttttttttttcctgttattatttcttcctttctctgcttttagtttattttgctctttttttctagtttcttgaagtaggaacttagattattggtactctgatttggtgctctgtcttttgtaaggttttactaagtgttattaattattctctctgcactgctttagctgttttaatacaggtgtttttttcatttagttatatttatttttcaaaatttcctttcagacttcttctttgaatcatgagctccttagaagtgtactaattaatttgcaagtgtttggaaaccttcttcttgttttgttattgatttctagtttaattccattgtgttaagaaaaaacactctgcttcacctcaattgttttaaattttaaagtttttgagatttgttttattgcctagggtatggtttgtcttgggaatactctgtgaactctggagaaacatgtatgttgttcttttgttggatgaaatattctatatttgtcaaatagatactgttggttgattgtgttgttgagttctatatccttgctaattttctttaaaaaatttttttagagatgaaaggggtacaagtgcagttttgttacatgagcatattatgtagtggtttgcctaggcttttagtgtagccatcacaaatagtgtccattgtacccacaaggtcatttatcatccctctccctgttcccactcttccacttttctgagtcttcactgtgaattatttcactctctatgtttatgtgtacacattatttaattcctacttacaagtgagaacatgtgatatttgactttatttctgagatatttcacttaaaataatggactccagttccatccttgtttttgcaaaagacatgatttcattctttttttaaggccgaataatattccatggaatatatatacaccacactttatttctcttactatccatcgatagacacttaagttgattccatatctctgctattgtgacttgtgctgtgctaaatgtataagtgcagttatcttttgatacaatgatttctcttcctttcggtaggtacccagtagtgggattgctgagtcaactgttttatgttttccatagaagttgtgcaaatttacattccaacaagcaatgtataattgttcccttttctgtgcatcctcatcaatatctgttgttgattgacttttaaataatagccattctgactggtgtaagatggtatctcgctgtggtttaatttgtattattctgatgatttgtgatattgagtatcttttcatatgtttattcgcaatttatatgtcttcctttgcaaaatgtctgttcatgtaatttgcccactctttaatgggtttgctttttttgctgttgttgagttgtttgaattccttgtagattctgcatgtgacttaacctgtcggatgcatagtttgcaaatatttgtcccattctgtctggtagttctataatatgctgagagtggagtaaattggggactataactcgaattttatgtttctgcatttctctttcccgctctactagtttttgttttacgtattacgtattttgaggctgtgtggtttggtttgcactcatttaggattgttatgtcccactggtgaattgatccttttatcattacataatgttttcatttgtcacaagtaatttttctctctaaaatctactctacctaatatccatatacccacagccaatatcatactgaatgggcaaaaacttgaagcattctctttgaaaactggcacaagacagggatgccctctctcaccacttctgctcaacatagtgttggaagttctggccaggacaatcaggcaggagaaggaaataaagggtattcaattaggaaacgaggaagtcaaattgtccctgtttgcagacgacatgattgtatatccagaaaaccccattgtctcagcccaaaatctccttaagctgataggcaacttcagcaaagtctcaggatacaaaatcaatgggcaaaaatcacaggcattcttatacaccaataacagacaaacagagagccaaatcatgagtgaactcccattcacaattgcttcaaagagaataaaatcctaggaatccaacttacaagggacgtgaaggacctcttcaaggagaactacaaaccactgctcgatgaaataaaagagggtacaaacaaatggaagaacattccttgctcatggataggaagaatcaatatcgtgaaaatggccatactgcccaaggtaatttatagattcaatgccatccccatcaagctaccaatgactttcttcacagaattggaaaaaactacttcaaagttcatatggaaccaaaaaagagcccacatcgccaagtcaatcctaagccaaaacaacaaagctggaggcatcacgctacctgacttcaaactatactacaaggctacagtaaccaaaacagcatggtactggtaccaaaacagcatggtactggtaccaaaacagagatatagaccaatggaacagaacagagccctcagaaataatgccggatatttacaactatctgatctttgacaaacgtgacaaaaacaagaaatggggaaaagattccttatttaatagatgatgctgggaaaactggctagccatatgtagaaagctgaaactggatcccttccttacacgttatacaaaaattaattcaagatggattaaagacttaaatgttagacctaaaaccataaaaaccctagaagaaaacctaggcaataccattcaggtcataggcatgggcaaggacttcatgactaaaacaccaaaagcaatggcaacaaaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaacaaacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacagtggtggtgggactgtaaactagttcaaccattgtggaagtcagtgtggcgattcctcagggatctagaactagaaataccatttgacccagccatcccattactgggtatatacccaaaggattataaatcatgctactataaagacacatgcacatgtatgtttatggtggcactattcacaatagcaaagacttggaaccaacccaaatgtccaacaatgatagactggattaagaaaatgtggcacatatacaccatggaatactgtgcagccataaaaaatgatgagttcatgtcctttgtagggacgtggttgaagcaaactatcacaaggacaaaaaaccaaacaccgcatgttctcactcataggtgggaattgaacaatgagaacacatggacacagggtggcaaacatcacacaccggggcctgttgtggggtgggggcaggggggagggatagcattaggagatatatgtaatgttaaatgacgagttaatgggtgcagcataccaacatggcacatgtatacatatgtaactaacatgcacgttgtgcagatgtaccctaaaacttaaagtataataaaaaaaatccatatagtgattgctgctttttaaaaaaattaatatttatatggtatatttctttccatgtttttgctttaaattgacctatgtcattgtatttgaaatgatttattgtagagaacatttttttggatcactaaagaaaatctatgtcaatctgcttttttctttaaaaaaacttatttatttatttatttttagattgattcttaatatttctctgtatttatggagcataggcaatatttcattacatgaatacaatgtgtagtgatcaactcagaatgtttagcatatccattacctcaagtgtttattatttatatatgttgggaacattttaagtcctgtctcctagctattttgaaatataaaacaacattgtttttaattataatcaccctactctgctattgaacattagacctcattccttctatctagttgtatatttgtacccattaactaacctctcttgtccttcccccatgcagccttcctcacctctgttaaactaccattctacactctaccttcatgagatcaattttttttatctactacatatgagtgagaatatgtgatgtttatatttctgtgactggctgattttacttaacatgatggacgtgcagttctatccatgctgctgcaaatgacaggattttattctttttttaaataactgaatagatttcattttgtatatataccacatttttcttattatttatccattgatggaaacttagcttgattctatatctttgcatttatgaatagtgctgtaataaacatggaactgcagatattcctttgttacactaatttcctttcctttggataaatactcagtagtagaatgctggataatatggtagttctatttttagctttttgaggaaccttaatattgttttctgtaatgcctatactaatttacactgccgccacccgtgtataagagttccttttctccacatccttgccagtatctgctatttttgtctttttgataatagacattttaactggagtaagatgatatctcattgtggttttgatttgcatgtatctgatgtttagtgatgttaagcatttttcgtgtgccttttgaccatttgtatgtcttcttttgagaaatgtctgccctggtcttttgcccagtttttaatgggattatttatttgtttgtttgattttgctgttgaactatttgagttccttatatactctggatattagtcctttgttagatggatagtttgcaaatatgttctcttattgaacaggtagcctcttcactctgttaattgttttcttggctctgcagtaggttttcaatttaataccatcttatttgtctatttttgtttttgttgcgtatgcttttacagtctttcttaataaatcatttcttataccatgtactgcagtgtttcccctatgttttcttctagtattttcagttccaggtcttatgtttaaggctttaagcatttggagttgagttttgcgtattctgagatttaggggtctagtttcattgttctacataaggatatgtccagttttcccaaccctgtttattgaggagactgtcctttccccattgtatgttctttgcaccaaatgagttggttgtaaatatgtggatttatttgtgaattctgtgttctgttccattggtctacatgtctgtttttatatccatatcatgctgttttgtctatattgccttgtaatatattttgacatcaggtagtgtgatgcttccagctttgttctttttctttaggattgcttttgctactcaggctctttttggttccatataaattttaggatttttttctatttttgtgagaatatcattgatttttttaatagagattgcattgaatgtacagatggctttgggtagtatggtcatttagataataataattcttccaattcatgagcatgggatatgtttccatctgtttgtgtcctcttaaatttctttcatcagtgttttgtagttttccttggagaggtctttcaactcctttgttaaatgtattcctttttatttttgtgactgttgtaaacgggattgctgtctcaatttctttttcagctttttcataattgatgtatagaaatgctactgatttttgtgtgccaatttttttttgtcctgcaactttaatgaatttgtttattagttctaagaattttttggtgcagtctttaagtttttctgaatataagattatttctgcaaagggacagtttgacttcctcttttctaatttggatgccttttatttttttctcctgcctaattgctctggctagaattttcagtactatgttttatggatgtggtgaaaatggatatccttttctttttctgtgtcttagaaaaaaggctgtcagcatttccacattcagtatgatgttagctgtgggtttatcatatatgacctttttcatgttaaggtatgtttcttcaatgcctagtttgttgagcattttttattttgagagttgagatgttgaattttatctagtccttttctctgtttagatgatcatatgatttgtgtccttattttgttgatgtatttcatttactgctttgcaaatgttgaagtacccttgcctctctgagataaatcctacttgatcatgctatattatctttctgatgtgccgtttaattgggtttgctagtattctgttgatttttgcatcttttttcatcatgagtaatggtctgtagttttcttttttgttgcatggttttctggtttttttaatcagggtatttctggccttatacattgaattagggggaatttactcttcaattttttggaatagtttgaggacaattggtgttagttcttcatacatttggtagaacttggcagtgaagccattgggtcctgggcttttctttgttggaagactttttattactgattcaatcttgttatccattattggctgtccaggttttctattttttttccaggttcaattttgggaggttttatgtaaccaggagtttatccatttcctcaacctacttttaaaaattgatatattaagacatttaccattaaggtaattatattttagggattaagtctgcaaattaaaaaagtgttttctgcttgttttctctttttgttttcttttcctattttgaaacagaatttttctctgtcatccaggctggaatgcaatggcatgatcatggctcacagcaaccttgaccttctaggctcaagcgatcctttcacttcagcctccccagtagctgggatcgcaggagtgttccaccatgcctggctaatttttttattttttgtagatgtagggtttccctatgtcaaccaggctgatcttgaactcctgggctcaagtgatccttctgccttggcctcccaaatatctagaattacaggcataagccaccacacctggctgtttcctgtttttcttgttcttctgtttctcttttcttaccttcttgtgcattaattgaacatttttaatgatttaatgttgatttatttatgttgttttgagtatattgctttgtagaattttcttaatgatttctctcggtagtacaataaacatgtaaattatcacagtctacagttatcaacatttttttttactcttagtgaggcatggaaaccttacttccacttaagtctccttaccctagaataatataattttcttaagtattttttacatacattgagcgccatatcagataatgttataactgtggattcaacaatcaaatatgacttacgaaactaataagaattagaatagtttattatattgaaccacattttccacccgttcttatgttactatttcctctctgaagtttcaagacttcttttcttatcatttcctttctgctggggaaattcctttagccattttcaagggtaggttttacagaatcaaattatcttagtttttcttcatctgagaatgtctttatttcactctcattcctgaaggatatttttttctgggtgtagaatacacaattagcagttttctttcagaacctgaaaaatgtaacgtctccttctggcctctatagtttcagaagagagacatgctatcattcaaattcatttttatttgtaatacagtatttttttctggctgctttccatatttttgttttgttttgttttagtttttaaagcttaattatgatgtgccttggcatgcatatctctgggtttatcttatttggtgtttacgcagatttttgaatctataagtttacattttcaataaaattgggaaatttttagtgatagttatttttaatttaaaaatttaaattaatataatgtatatttaaggtatacaatgtcatatatattttttgaactgattactatagtcaagtcaattaacatatctttgtcttcatatactcacatagttaccattttgaggagtgttgagacttaaggtctgttcttttagcaaacttcaagtatacaacacagtattagtagctatagtcatcatgctctaaattaaacctctaaaactcattcatcctgtataactgaaactttgtacactttaactaatatctccccattttcccagcctccttggcactggtagccaccattttaccctgctcctatgaattcaacttttttagatttcacatatatgtgtaatcacacactgtttttctatctgtgtctggagtttttcacttatcttaatatcctccacattcatccatgttgttgcaaatgagagaaattcccacttttcttgctttccaacttttattctaggttcaggggggtacatgttcaggtttgttacatgggtaaattgcatgtcatggggatttggtctacagattatatcatcactcaggtaatgagcatagtagtcaatagtttttcaatccttatcctcctttcactgaccaccctgaagtaggcactggtgtttcatcatttttatccatgtgtactcaatgttcagctcccacttatgtaagtgagaacatgcagtattggttttctgttcctgtgttgacatgcttagtataatggcctctagctccatccatgttactgcaaaggaaatgattttttttatggctgcataattttccatggtgtatatgtatcacacttcctttatcccattcaccactgatagacatttaggttgattccatgtctttcctattgtgaatagtgcttcactgaacatatgcatgcatgtgtctttatggtagaatgatttatattgtcttgggtatatacccactagtgggattgtttagttgaatgatagttctgttttaagttctttgagaattctccaaactgatttccacaggagtggaactaatttacattgccatcagcagtgaataagcattcccttttctccataactgtgccaatatctgttattttttgacttttcaatagccattctgactggtatgatatattttattgtgattttaatgtgcatttctctaatgattgaacattttttcatacgcttgttggccatgtgtatgtcttcttttgagtagcatctgttcatgtcctttgcccaatttttagtggggttgtttgttttttgctttttaatttgtttttaagcttttgtagtctggatattagacctttgtcagatgcatagcttgcaaatattttctctcattctgtagattgtctgtttactctgttgatagtttcctgtgctgtgtagagaggcaatgaaaaaagaaaacttcaggtcaatattgtctttgaatgtggatgcagaaatataagcaaatgaaatagaagcaaactgaattcagcggcacatcaaaaagctgatccactaagatcaaatacactttatacctagaatgcaaggtttgttcaacatatgcaaatcaataattttgattcatcacataaacagagctaaagacaaaaaccacatgatcatctcaatagttgcagataaagctttctatacaattcaagatcccttcatgttaaaaaccctcaacaaacaaagcattgaaggaacatacttcaaaataattagtgccgtctatgaaaatcccacagccaacatcatactgaatgggcaatagctgtaattattccccttgaaaaccacaacaagacaaatgtgcccccttttaccactccaattcaacatagtactggaagtcctagccagagcaatcagggaagagaaagaagtaaagtcctccaaataggaagagaggaagttaaatgatccctgtttgcagacaatatgattttatacccaggaaaccctgtaatctgtgccccaaaggtccttgatctgataaacatctttggcaaagtttttttttaatattatactttaaattttggggtacatgtgcagaacgtgcaggtttgttacataggtatacacgtgccatggtggtttgctgcacccatcaacccatcatctacattaggtatttctcctaatgctatccctcccctagctgaccattccccaacaggccccagtgtgtgatattcccctgcctgtgtccatgtgttcttattgttcaactcctaattaggagtgagaacacgtggtgtttggttttctgtttttctgttagtttgctgcaaagttttaagatacaaaaattgatgttcaaaaatcaatagcattcctatacaccaaaaacatccaagctgagagttaaatcaagaatgcattcctcttcacaatagccacaaaatgaacaaaaatctaggaatgcagctaacctgggcagtggaagatctgtacaatcagaattacaaaatattgctgaatgaagtgagagctgacagaaatgaatggaaaaacactccaatctcatggataggaagaatcaatattgttaagatggtcaatgaatttcttgatttctgcttaatttcattgtttactcaaaaatcattgaggagtagattgtttaattttcatataattgtatgttttgtgagatcttcatattgatttctgtttttgttgtcctatggtctgagtgatggagtctcattctctcacccaggctggagtgcagtggcatgattttggctcactgcaacctcttcctcccgggttcaagtgattcttgtggctcagcctcccgagtagctgggactacaggcatatgctaccacgttcagctaatttttgtatttttagtagagatgtggtttcaccgtgttggccaggcttgtcttgaactcctgatctgaagtgatctgcctaccttggccttccaaagtgctgagattacaccttccttgttacttttgatgttgtggtttaaagtttgttttatctgaaataagaatagcaaccccaattcttttttcttttccatttgcatgatagatctttctccatccctttaatttgatcctatgtgtgtcattacacgtgacattggtctctcgaagacagcgtacagttgggtgttgcttctttatctaattgactatgctgtgcctttaaaatgagtcatttagcccatttatgttcaagattaatattgacatgtgccaatttgatcctgtcattgtgttgttagctggggtttttttttgtggactttattgtgtagttgctttatagcgtcaatggtctgtgtacttacatatgtttttgtgatgggtggtaagtctttcattttcaggattagcacttccttaaagagctcttgtaaggcaggtcttgatggtaacaaattttcttagcatttgcttgtctgaaaaatattgcatttctcctttatttgtctcctttatttgcttgtctgaaaaatatttcatttctcctttagtttggtgggatatgaaatttgtgattgacatttcttttctttaatgatgttgaatataggcccccagtcttttctagcttacagggtttctgctgaaagttctgctgttagcctgatggggctccctttttaggtgacctccccttctctctagctgtctttaatattttgtccttcacattgagcttggggaatctgatgactgtgtgttttgggggtggtcatcttgcatagtatcttccaggggttctctgaatttcctgaatttgaatgtgaacctctctagtgaggttggggaaattttcatgaagaaaatcctcaaatatgtattacaagttgcttgctctctccccctctctttcagtgacactaaggagtcatagatttggtctataaaaattccatatatcttatatattatgttcattcttttacattcttttttccttatttttttcttgactgaatagatttgaagagccagtctttgagttctgaggctctttcctgaacttagtatattctgctgttagtatttccaattgaattatgaaattcttgtggtgagtttttcatgtctatcagatcagttaggttctttcttaaatggctatttcatctttctgctcttgaattgttttactggatttcttagatttcttttgtattgaatttcaacttcctcctgaatcttgatgatcattgccattgccatccagatcctgaattctatgtctgtcatttcagccatttcagtttggttaagaactattgctgggaagctaatatggtcatttggaggtaagaaggcactccggattttacagttgccagaggtcttgcactgattctcatctgtgtgggctgatgttcctttaatctttgaagttgctgtcctttggatggggctttttctttttatattctttgctacctttgaatgttcgactgtggtataagttgggtttagttgactggcttcatttctggatgatttcaggaggccatggctcaactcagcactcttgggctgtgcactttaatcctggggttgctgggatcaagcctatggctttgttctctggcttctcaaagttaaccatttgatgtactcagccggggtggcggggggaagggggtaagtgtttctggtcctctggcaatgatactgcattggtggatgctggcaaaagccctttgtcaaggtgatggcaacatgatccatgcccacatgcatgtgctgggagtggcaggtggcagcagcatggcagggtctgtgcataggcatgtgtactggcatagccattggggaggctgcaggtggatgcatgctggcaaggcccatgtgaaaaaactctcttacagttaggctgggtcttccagtaaaagagctatagcagtagctacttggaagtgccctggttgagcatctgaggctacactgcaagtggatgtggccaggcagagatcctcgggaattcttgcagaaaggggatactcagatcagactggtcacatcccacaggcacgatagctctgttctgtgcaagtttgacagtcaaaaaatacctaagccacctggaacagtgtggtgagccttggaggatgggtatccctggctgtgctccactgcagccattcccacgtcaaaccctctgggctttgcaggatggagtcctgtctctgctaactcccaagcagctcccacttggagctcatggagtctcctgcatctaggtgtccttggttacatggcaagagtgggccactccatgcctatttaactcattctttctccaggagcttcgtggggccaggaatgagtcctagtgctctgcaaccctgtatagggttcccagcttcctctcccttcagcgcagattctgcattctctgtccattcactctcaaagccttccttctgaagatttcattggggtgtgctgatcttcatggtctggccactcagtgagagaagctcttcctagctgtgtctagtcagccatcttggctctttcctctttttcaaggccgaataatattctattgtatgcattcaccacatttttttatccattcatccattgacagacacttaggttgttctcatattatggctataatgaataatgctttaatgaaccttcaagtgcagatatatctatgacatactgattttatttcctttttcatatatacccagaagagagattactggatcatatagtatttttaattatttgaggatcctttttactgttttccaaaatggctgtaccaatttatgtttttcactaatagtgtacagttgtttctttttcttcacattctcatcaacacttatctttcttctctttgataataggcattctaatcgatgtgagataatatctcattgttgttttcattagtgcttccctgatgattagtaatgttgagcgcattttcatatatctattgtccatctgttgtgtgtcttctttggaaaatatctattcaggtcatttgcccattttaaaatttgagggttttttttgttattgagttatatgagtttcttttatatatgcatatcagatatatggtttgcaaataaatatgatctgctaatcttcagtggcctttaattttgttgatgattttatttgcagaaactcagtttgatatagtcccatttgtttattttgttgttgtttttgcctttgcttttggtatcatattcaaaacaatcattaccaagatcagtatcaaagtatttttactatattttcttttaagagattaacttgtcattttacattaggtatacctcctaatgcaatccctcccccagccccccaccccacaacaggccccagtgtgtgatgttccccttcctgtgtccatgtgttctcattgttcaattcccagctatgagtgagaacatgcggtgtttggttttttgtccttgcgatagtttgctgagaatgatggtttccagcttcatccatgtccctacaaagaacatgaactcatcattttttatggctgcatagtattccatggtgtatatgtgcaacattttcttgatccagtctattattgttggacatttggcttggttccaagtccttgctattgtgaatagtgcctcaataaacatacgtgtgcatgtgtctttatagcagcatgttttataatcctttgggtatatacccagtaatgggatggctgggtcaaatggtatttctagttctagatccccgaggaattgccacactgacttccacaatggttgaactagtttacagtcccaccaacagtgtaaaagtgttcctatttctccacatcctctccagcacctgttgtttcctgactttttaatgattgccattctaactggtgtgagacggtatctcattgtggttttgatttacatttctctgatggccagtgatgatgagcattttttcatgtgtcttttggctgcataaatgtcttcttttgagaagtgtctgttcatatgctttgctcactttttaatggggttgtttctttcttgtaattttgtttgagttcattgtagattctggatattagccctttgtcagatgagtagattgcaaaaattttctcccatgctctaggttgcctgttcactctgatggtagtttcttttgctgtgcagaagctctttagtttaattagatcccatttgtcaattttggcttttgttgccattgcttttggtgttttagacatgaagtccttgcccatgcctatgaactgaatggtattgcctaggttttcttctagggtttttatggtttcaggtctaacatgtgagtctttaatccatcttgaattaatttttgtataaggtgtaaggaagggatccagtttcagctttctacatatggctaggcagttttcccagcaccatttattaaatagggaatcctttccccatttcttgtttttgtcaggtttgtcaaagatcagatggttgaagatatatggcattatttctgagggctctgttctgttccattggtctactctgttttggtaccagtaccacgctgttttggttactgtagccttgcagtatagtttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcactgaatctataaattaccttgggcagtatggccattttcatgatattgattcttcctacccatgatcatggaatgttcttccatttgtttgtatcctcttttatttcatcgagcagtggtttgtagctctccttgaagaggtccttcacatcccttgtaagttggattcctaggtattttattctctttgaagcaattgtgaatgggagttcactcatgatttggctctctgtttgtctgttattggtgtataagaatgcctgtgatttttgcccattgattttgtatcctgagactttgctgaagttgcctatcagcttaaggagatttggggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccatttggtatgatattggctgtgggtttgtcatagatagctcttcttattttgagatacgtcccatgaatacctaattttttgagagtttttagcatgaagcgttgttgaattttgtcaaaggccttttatgcatctattgagataatcatgtgggttttgtcattggttttatttatatgctggattacgtttattgatttgcatatgttgaaccagccttgcatcccagggatgaagcccacttgatcatggtggataagctttttgatgtgctcctgtattcggtttgccagtattttgttgaggatttttgcatcgatgttcatcagggatgttggtctaaaattctcttttttggttgtgtctctgccaggctttggtatcaggataatgctggcttcataaaatgagttagggaggattccctctatttctattgattggaatagtttcagaaggaatgttaccagctcctccttgtaactctggtagaatttggctgtgaatccatctggtcctggactttttttggttggtaggctattaattattgcctcaatttcagagcctgtttttggtctattcagatattcaacttcttccttatttagtcttgagagggtgtatgtgtccaggaatttatccatttcttctagattttctagtttatttgcatagtggtgtttatagtattctctgatggtagtttgtatttctgtgtgaacggtggtgatatcccctttatcatgttttattgcgtctatttgattcttctctcttttcttctttattagtcatgctagcggtctatcaattttgttgatcttttcacaaaaccagctcctggattcattgatgttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcgtttagtgctataaatttccctctacacactgctttaaatgtgtcccagagattctggtatgttgtatctttgttctcattggtttcaaagaacatctttatttctgccttcttttcgtcatgtacccagtagtcattcaggagcaggttgttcagtttccatgtagttgagtggttttgagtgagtttcttaatcctgacttctagtttgattgcactgtggtctgagagacagtttgttatgatttctgttcttttacatttgctgaggagtgctttacttccaactatgtggtcacttttggaataggtatggtgtggtgctgaaaagaatgtgtattctgatgatttggggtggagagttctgttgatgtctgttaggtctgcttggtgcagagctgagttcaattcctgggtatccttgttaactttctgtctcgttgttctgtctaatgttgacagtggggtgttaaagtctcccattatttttgtgtgggagtctaagtctctttgtgggtctctaaggacttgctttgtgaatctgggtgcccctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccatttgcttggtagatcttcctccatccctttattttgagcctatgtgtgtccctgcacgtgagatgggtttcctcaatacagcacactgatggatcttgactctatccactttgccagtccgtgtcttttaattggggcatttagcccatttacatttaaggttgatattgttatgtatgaatttgatcctgtcattatgatgttagctggttattttgcttgttagttgatacagtttcttcctagtatcaatggtctttacaatttggcatgtttttgcagtggctggtgccagtttttcctttctatgtttagtgcctccttcaggagctcttttagggcaggcctggtggtgacaaaatctctcagcatttgcttgtctgtgaaggattttatttcaccttcacttataggcttagtttggctgtatatgaaattctgggttgaaaattattttctttaagaatgttgaatattggcccccactctcttctggcttgtagagtttctgctgagagatcacctgttagtctgatgggcttccctttgtgggtaacccgacctttgtctctggctacccttaacattttttccttcatttcaactttggtgaatctgacaattatgtgtcttggagttgctcttcttgaggagtatctttgtggcgttctctgtatttcctgaatttgaatattggcctgtcttgctagattggggaagttctccagctttttaaaagttattgaaattatacttttacatttttaaattctacttgtatgttaaactacattaattttgaatagatattgaagttactttacatttctgtgataagcccccttgattatgatacattatctatcttatatattgttctttttgatcactgaggattttgttgactgtttttcttgtttctaaagaatatttgtctgtagctttcttttatgataatagttttggctggtgtagttattaataaaattctggcctcaaatttaattgagaattatttgcatctattctatatttgggaagagtttgtgtgaaattagtgtttttttaattccttaaatgtttgctggaattcaacagtgaaaccatttgggtatgaatttttttcttggaaagttttaaactagaaattaaaattctttaatagatatagcagcattattctcctcaggaatgagatattcaactctgttaaatcattacttgacgcagcaggagataacaggatgagggtgggatattattcactagtacttctgatctgttgtttacataggcagaatgagcatcagtggttagagaaagcctttaactgcttgtagttgaagcttgcactgcttgtagttgaaggttaccctgcctgcatagaaattgtaatggtcaaaagaatgtggtcaggatactgacagcatcttctacagatacacatcttttactacacagttactcttatgctccatgttaagtttactatgtaaactaatacttacaggtgttattcatttatgacattaaaaaaaatttataatgggagagttagtggaaaaaactatactttcctgctgctatggttaattctaaggttgtaatagatatttatcattttttcttttaccgttttttatagattttccttactctcatccagcacttctgctattttaggtttctttcctactgggtttatgtaggccttttctgggtgtcagagtacttgttaagctgtgctttctccatttgcttataagtgattagtactgggcatcgacgcctcaataataagcttctcctggaccacttttagtagcaacaactctagcccctcataataatcagggtcagttcccagtataataactcattcctttgccagctggtctagtgtcatgagaggttctaaagtatccaagtggtagccttaggtttactgtaattcttatatccccttgtagaagcattccctcccctggaactaatgtctctagtgcaacagtgactaaatttatatagacaggaagtgcacatttccaaaatagacattgagaatgatggtatgaggaaaccatttctacttctactttttggttctcaaacctatatattacaactaatggggatacaacaccaaataatggacattgactggaagtattaatcctcatcttgaataataacacacttaaaactatatagtatcatgtttaagctggttccttacaatggtttaagaggctattccagcacactcttaggctgctagcttttagcttatgtgataatagtactactagtatattcaatggtaatgtgtcctttatttcatctccttcattgtcaactgggtcctttggtttgaggcaattttatatggaatttgttgaggctaaatcactttatgtttctgagatagtggtccagcacaaggaaaatccatatttagaatatgtagcaattgtaataaataaaatatctatcttttccaggatggaatagtttcttacggtttaatataatcaattttttttttttaccaagtgggtggttgatcttttgaggaatgatatcatattgatggtttagcttggattcttctgactggttggatatgcagtagagacagtgagtagatgaactttaaagagaaggatttcataacattggttccatgcgtagcctccattcctgccacctggtcactctgttcctcattatgaaggcagtggggtggctgaggacagacaatggctgacttatcttcaccaattggtcatcctacttaactgggtttttagtgtctcttcagtggtagatgtactatgttaggcattgacataagaaataagaatccacataccttgcatgcactcccctagattcattcacatgcttcttccccctcttggtctctaatcttccaatttattttctagactcctgaccaaccaatcatgccatttgcaactgcccaacagtctgcatttatccttcctcacattacttctctgtccataccaagtttatgactaagtgtactgcttggatccttgctcagtgggaggaattcccttcaccactgttttaacacaaccacatctgaatgtggtagcagttcatttattactgtaccaccttatggagaggacccatttatttaaaaagcgcattcttatttctcctctttgtggtagttataaggaaacacctacatgttcatagctatgagcagaggaagcaataatggtgcaattagagaaaggtgaaatggggatctgagtcacttatatatgaacttagttgggcctaattctgaatgtaccacttctatcatgtttttgctattgtgccaactcttcttatttggtggatcgtaatgtttttttctagatcatctatttagtgtctacaagggcctagtagcatgtcaggaatttctttttgaatgatgaatgttccctatgcagacatcatggccttgctcaagaactcgaaaggcatctgcttggactcctactgagttttaaaaatggggatattttcaacacatcaacagttgcacaccacatgctagaggctatgttgacatgttctagtaaagatacttcatctgatattacaagtgtgattgaaataccacttggttaaatttgtaggaatttacagttgtctgctatgattcatatcatttttggagaactcagacctattaattaattgggcatatggggggccatgatagtgttttaagtctccaagttcaacagtccttaagagattcgagtcttcccctttcagcagtacataattatttaggtaaatgactatatatatctttggggaaggagtgagggaatcactactacacatagttgttgtggcactgcagcatcttcttcaagaggaattggtctccccttcaattgataggctctggatctgagaactggctcatttatggaaactgggcaaggtattttaattttccctttggtgtctaatattagtcttctgctattccagaattctgttttttttctcactgatactagagaacctagtgttacagcattattccctaccatcaatcctggcaagcagaagaaactatcactgagcttctcactagcagataatagttgacccttgaacaacacgggggttaggggaactgatctgccacaccgtcaaaagcctgtgtacaacttttgactctacaaaaactttactaatagcctactgttgactgcaagccatactaataacataaacagtcaattaatacctatctcatacattaaatgtgttgtatactgtattcgtataataacggaagctagagaaaggaaaatattaagaaaatcataagaaagagaaaatatatttattcatttagtggaagtagattgtcataagggtcttcatccttgttatctttactttgagtaggttgagaaggagatggaagagaaggggtttgtcttgctgtctggggtggcagaggcaaataaaaaattcatgtttaagtggactaacatagtttgaacttgtgttgttcaagggccgattgtacttattgctttggtgaaagaaatattatttgggttcagtaggggaatataatcatttggttgtctttcttgtattatgttttaaatctagtatgtctacctcttggagtttcaggactgctttctttgtacttcgccgaggtagttacagcatctcaacctcattatcatagtcatttttaagccttgaaactatcccggtaacatttaggcttggctgcaggtgtacttcctaccatgttaaatcctcagttctagaaaagtgtctctgaatcagtaaaatccccgtccccttattcgttcttatatgctatactctccccagttcagtgcttctaacatccatttctcagtatggtctcctggttgttgccagtacctattagatgagtcctgcaaccctttatttttatagcaaggacaatattttcccaatttgagcattctgagattttcagataattgggagttagcctagtggacactcaaatggtataaggacaagtgatactagtgcgccactatcagttcttggtaccctctattcctctcaagcttcatcctcatttacctgcttaccattatagctaaatatacttagaaaatacttagaatgctgtaacaaagtctaagaaatctgccatccaaaatgaacagatgttactcctggtaatattcacttttaaaaaaaaaaagttattacagatacaattaagatcccaaatcctctttttcagcccctttcccatccaaagctggacacttataatgaatttgttatatctttttttttgttttgttgttaaactttttaagctgctttattgacacataacttggctaccacataatttaatcatttaaagtaaacaattcagtgattttggtatgttcacggggttgtgcaataattactacagtgaattttagaacatttccatcactccagaaagaaactctgtacctattagacagtcactttctattttctatttcccccaaatcctcctaatcctagctactatggatctattttctgtctatatagatttccttattgtggaaattttatataaatgaaatcatgccatatgtagtcttttgtgactgacttatttcatttaatataatgtttgcaaagtttatgcatgtatcaatacttgatttttttattggcaaataaaattctattttatggatataccacattttattatatattcattacagtagttgatggatacttggattgcctttctacttcttggttattataaatcatgcttctatgaacatttgtgcacaggcttttgtgtgcatatgttttcatttgtcttgggcatgtattcaggaagggaattgctgcatcatgtggtaactctatgttttacattatgaggagctgctattattgaattccaaaaaggttgcatggtttcacattcccaccagcaatgtgttagatcttaaatttctttatatcttccatatggatatctttaccaacacttgctattgtttatttttttgaatatagccatcttagtggctgtagagtggtatttcatggtggttttgataggcatgtccctggactaatgatgttgaccttcttttcatgcatttattgtcagtttgtatatttcctttagagaaatgtcgatttaaatattttgctcagttttatttgggtaattattattgttattattattcttagatttaggggatacatgtgcatgtgcaggtttgttacattggtatgttgtttgatactgaggtttgggcttctaatgatcccatcacccaagtaggaaacaaagtacctgataggtagtttttcaacccttatccaccttccatcttccctccacccttttgatatctccagtatttatggttcctatctttgtgtccatttatactcagtgtttagttcctacttacaagtgagaagatgcagtatttgattttctgtttctttattaatttgcttatgataatggcctccagctgcatccatgttgctgcaatggacacgattttattctttttttttatggcttcatagtattgcatggtgtatatgtaccacattttctttatccaatctatcattgatgggcacctgggttgattccatgttcttgctattatgaatagtgctgtaataaacatatgaggccaaatgactttttggtggaatgatttattttcctttggatatatacccattaatgggattgctaggttaaatggtaattctgtttttactttgagaaatctccaaactactttccacagaggctgaactaatttgcattctcaccaatggtatataagtgttcccttttcttggcaaccttgccaacatctgttattttccgactttttaataatagtcattctgactggtgtgagatggtatcatattgtggttttaatttgcatctttctgatgattagtgatgttgagcattttttatatgtttgttgggtgcttgtatgtcttctttggataagtgtctgttcatgatctttgcccactttcaacggagttatttgtttcttataggttttgggtattagtcctttgttggatgcctggtttgcaaatattttctcccattctgtaggtcatttgtttactctgttgatagtttcttttgctgtatggaaggttttagttcaattaggtcccaactgtcaatttttggttttgttgcatttgcctttgaggttaatatctagaagggtatttcctagattttcttctaagattgtgtagtttgagatgttacatttaagtctttaatccattttaagttaaccttttttatggtgagaagtaggggattagtttcattctacatatggttagtcagttttcccagcatcatttattgaattaggatatcctttccctgttgtttatttttgtcaactttgtcaaagatcagatggttgtaggtatacagcattatttctgggctctctcttctgttccattggtctgtatgtctgtttttgtaccagtaccatgctgttttgattactgtagccttgccatatagtttgaagtcaggtaatatgatgcctccagctttgttctttttgcttagaattatattggctattcaggctcttttggttccatgtgaattttagaatttttttttctaattccatgaaaagtcatgttggtaaatagataggaatagtgttgagtctgtagattgttttgagcagtatggacattttaatgatattaattcttccaatccatgaatatagaatgcttttctatttgtttgtgtcatctacaatatctacctcttacatcaacatccaccgtaggaaaacactactaaccttctgtcaccacatagcagggttgtctttttttgagttccatataaatggaattatacagtatatattgttttctgtctgaggtatttccttcagcataatgatttaatcttgtagttcaagacttatttatcagtagttcatgacttattattgctgagtagtatacaaatgtatagatatgtcacagtttgcttattttttcacttgttcatggacttgtttttctatcttttggctattatgaataccaaacattaggtgtcttatggcaaatatatatttaacttcataggaaattgccaagctattttccaaaataggggtacaattttacactctcaccagcaatatgtcactgtttcagtagattcatattctttccagtacttatctgtatttgcagatctacatattgattatgtaaaaatctcaatgaatctaaaaagcaactattagacctaataagtaaacttagcaagattacagaaacaaatatttaataattatatttttatgtgatatgagtaataaattgaaaaactaaataaaaattaactttaatattgataaaaataataaagtacttagggataattgaacaaaggatattcaagacctctatactgaaaattataaaacacagcagatagaaattatagaagactgaaatcagtggagaaaaagatcatgtttgtgtgttgaatgactcagtgtcattaagaggttctttccaaattgctagagattcaatccaatcctaatcatgatctcagcatggtttgttgtttttgtttttatttttggtaaatattgacaaggtgatttaaaactctttaacaaaatagcaagaagttgacccagctagggattaatataagaatttatgattggcttaataattttaaaaatcagttaattagatttctggtttcaacttcaacatgcaaagagcttggaagttgttactcccattcttaaaacaataagatgttgatcagtcttaaaattaacaacttttcttggacctattagagaactgagatttcagtgaaaacctacagccagaagcctgaagagaaaagcaaatccagataatcacagatagtgcagaagccactaaagccataaacttacagaaacactcaaatagtaacttttttcaaattggtgggtgctgaatgtgggactagcatgagaatgagaaactgctggttactgaaatgttcgggaacccccaatacttttccttttagggaacccaccaggttctcatggtagagatctgagaaagattcctttatgactctggcagggtgcttattcttccgaataagcattgtaaaatatactcagagcattctccctaacaaaaaagtattttcctggaaaaaaggctttactagagccttatccaaggtaggggaagggcattgctcaactttagccaccttggccttcctgtctcatcagatgggggcaaaaggtgttacaactggagaaacacttgtgaatgtcacagcccagacacacagacccattatatcaagactgagatttaatcataaaatcattgagcattttccttctcccacatcttaccataacatgctaaccagtcttcatataataacaagtgcagactctgtctgaggaggaatatttcaagaagtccaaagtcaagaacaaaggcacaaacgaagacactagagaaatttgaagtctctggcatatatggctatagcacacatcaagtgcacttacacagattaacgtaaatactctaaaggtcatttacctcagttcctattaatcaatacaaacgtgtggttttcaacaaaaaattacaaggcattccaaagaccagaaaaaatacaatcatctaaacagatacagcagttaacagaaccagagtcagcaatagcatagattatggaattgttagaaaaggaatttaaaataacaatgaaactatgtgaaaagatttaatgtagagattagacaaaatgtatacaggtaagcaacatggaagatgactaatgaaagcctagaggtggaaactctaagattcaaaaggaaattctagaaatcaaaaacactgtacagaaataaatgactttgatgtacgtatctatagattagactcagacatagaatgagtcattgagtttgaagatagataaatagaaacttctcaaatggaaatgtaaagaaggaaggcaattgggggtgggctggtgaatagaatatccaataactgtgtgacagtttcaaaaggtgtaacatagatgtgcgtttggactaccagaagcagaagaaagagtgagcaaaacagaagaactatatttgatctttgaaagacataatgtagcaaactcacatgaggacagatagataatctgaataggcctgtatctattgaagaaattaaaccaattattagtaatcttccaaaacagaaagcaccaggcccacatgtgtttactggtgaattctaacaaaacattcaaggaaaaaattatatcagttctctgtaatctcttctagaaaatagaagcagatggaatatttccagttcatccctggaggattagcattacccaagtatcaaatccagacaaagacattaccagaaaggaaaactacagaccaatatgtctcatgaacataaatgcaaaaatcatctacaaaatattagcaaatcaaatccaacaatgtacaaaaagaattatacactatgaccaagtgggatttattccagttatacaaggctcatttagcattaaaaaaattaatgtaaaccatcacaccaacaggctacagaaaaaacaattaaatgattatattagtagatgcagagtaagcattgcatttgacaaaatctcacacccacacatgataaaaaccctcaacaaactaggaatggaagggaacttcttcaacttgataaagaacatctaccaagaacctacagcaacattatacttaattgtaaggaactagatgcttacctgctaagatcatgaacaaggtaaggatgtatccccaaggatttctatttaacatcttagtggaagtcctagctgtaatacagtaagatcagaaaagcaaacaaaagatatacagattgggaaggaagaaataacactatctttgtttgcagattacatgattatgtagcacatcccacagaatcaacaaaaacacttctggaactaacaagtgatttcagcaaagttgcaggatatgaggttaatatatgtaagtcagttgctttcttatataccagcaatgaacaattaaaaacacagtaccatttacattggcatctaaaataactgaaatacttatatataaatgtaacaaaatacatgtaagatctatataacgaaaatcagaagactgatgaaagaaatcatagaagatctaaataaatgggggggtggtgaaggtgatggttcatggctgtaatcacaacattttgggaggctgaggcaggaggatttcttgaggccaggagttcaagtctggcccggggcaatgttgtgagaccccagtttctaaacaaaaccaaaaaaatagccatgtgttgtggcatgcacccgcagtcctaactacccaggaggctgagttgagaggatcacttgagcccagaagttcaaggttgcagtgagccacgatcacgccactgcactccagcctgggtgacagagggaggccctttttcaaatgaatgaatgaatgaatgaatgaagagatattccaggtacatggatagcaatattcaatattgtcaagattgagttctttccaacttgatctatagattcaatttagtcccagcaagttattttgtagataagagcaaagtgattccaaagtgtatatggaatggcaaaagacccagaataaccaacacaatcttgaaggagagcagttgggagactgtcattactggacttcaagtcttattataaagctacagtaattaagacagtgttgtacaggtaaaagaataaataaatagatcaatgatacaaaataggtaacaccaaaatagatctgtataaatacaatcaactaatctttgacaaagaaacaatggcaattcagtgggggaaagtatagtctttgaaacaagtgatgctggaacaactggacatccatataccaaaaaaaaaaaaaaaaaaaaaatgcagacacagtccttacatctttcacaaaaatcaacccaaaatggatcataggcttaaatgtaaaacacaaaattataaaactcttagaagataacagaagaaaacctaggtgatgtggcttttgtaatagctttttaggtacaatagtaagaaaagaatcggtaacttggattttattaaaataaggcacaaaatggcagataggaggcggaactaacttgcagctaccacttggatggacagaacagcatgtggagacccacatcatgaacttttacttcatgaattactgcaggaacataccaacaaagacaagagaatccacagaccctttgaaggaggtggattgctgctgcaggctctatgggacagccaagaaaccgtgagcctgcttgctttctcagcttagaggcttgtagcctggggcagattctcagccctgctcaccggctgccgggaaataaactctgtgctgttgagggggcacagtgggagtgaaactggcctttcggctgcaggctgcctgggaactgggtcaggcctgtggctgcaggcttttccccacttcccgggtgacctgtgggatgcagcagaggcagccgtaatccccccggaatgtatctccattggcctgaaaaccacacccccattcctcacaggagccacagcaagccctgcccaaggagagtctgagctcagacatgcctagccctgcccctcaactgatggtctttgtctacctaccctaattgaagacaaacgacataatgccttgggagctgtattggcctgcacactacctgagaaacctgaacacttatccaaaggtgaccacagggcaagcttgtatcctccctatacaaccgcagctgatgtgctcttgaaagccccacctcatggctggaggccaaccaacacaaaaccaacacacttaccaaaaatacaaccaaggaccttcacagagtccacttcactcccctgccatctccactggagcaggtcctggtatccatggcttagagacctgataatggatcacatcacaggactctttgcagacactccccacccagtaccagcccagagcccagtagctccactaggtgattagatctggaagagaaataacaatcgcacagtttggctctcaggaagctccaccgcaggagaaagtggagagcaccacattaagggatcactccatgggacaaaagaatctgaacagcagcccttgagtcccagatcttcccactgacataatctacccaaatgagaagaaactggaaacacaattccggtaatatgacaaaacaaggttctttgacacccccaaaagatcacactagctcaccagcaatggatccaaaccaaaacaaaacctctgaattgccagaaaaagaattcagaaggtcgactacttagccaatcaaggaggcaacagagaaaggtgaagtccaacttaacgaaataagaaaaaatgatgcaggatacaaatggaagaatcgccagtgaaatagatagcataaataaaaaacaatcacaacttcttgaaatgaagaacacacttagaaaattacaaaatgcactggaaaggctcggcaataatattgaacaagtagaagaaagaacttcagaacttgaagacaggacttttgatttaatccaatccaacaaagacaaagaaaaaagaaaaaaaatgcctccaagacgtttgggatgttaaatggtcaaaccgaaaaatattggtgttccccaggaagaggagaaatctaaaagtttggaaaacatatttgagggaataatcaaggaaaagttccccagccttgctagagatctagacatccaaatacgagaagctcaaagaacacctgggaaatttattgcaaaaagataatcacctagacacatagttatcggttatctaaaatcatgatgaaggaaataatcttaagagctgtgaggcaaaagcatcaagtaacctataaaggaaaacctatcagattaacagcagatttctcagcagaaaccatacaagctagaagggattggttcctatctttagtttccttaaacaaaacaattatcaggcaagaattttttatcaggtgaaactaagcttcataaatgaagggaagatacagtctttttcagacaaacaaattctgagagaatttgccactaccaagccagcaccacaagaactgctaaagggagttctaaatcttgaaacaaatccttgaaatacaccaaaatagaatctacttaaagcataaaactcacagtacctataaaacaatacaatgaaaaaaaaaaacccaacaaagtattcaggcaacaaatagcacaatgagtacaatagtaccttatatctcaatgctaacattgaatgtaaatggcctaatttctccacttgaaagatatagagtggcaaaatggataagaatttaccaaccaagtatctgctgtctttgagagactcaccttccacataaggactcacataaacttaagataaaggggtggaaaaacatagtccatgcaactggacaccagaagcaagcaggagtagctattttttaatatcagacaaaacaaagtttaaagcaacagcagttaaaaaagaggggcattgtataatgataaaaggattagtccaacaggaaaatatgacaatcctaaatatacaggcaacccacactggagctcccaaatttataaaacaattactactagacctaagcaatgagatagacagcagaacaataatagtgtgggactttaatactctactgatagtactagacaggtcatcaagtcggaaagtgaacaaagaaacaatggacttaaactataccctagaacaaatggatttaatagatatttacagaacattctacccaacaactgcagaatataccttccattcattagcatatggaacattctccaagaaagaccatatcataggccacaaaacaagtctcaacaaatttaagaaaatcgaaattatagcaagtgctctctctattatagtggaatataactggaaatcatcttcaaaaggaaccctcaaaaccatgcaaataatggaaattaaataacctattcctgaatgattgctgggtcaacaatgaaatcaagaggaaaatttaaaattccttgaactgaacaatagtagtgacacaacctatcaaatctcctggaatacagcaaagctgatgctaagaggaaagttcatagcattaaatgcctatataaaaaagtctgaaagagcacaaatagacaatctaaggtcacacctcaagaaactagagaaacaagaacaaaccaaaccaaacccaaacccagcagaagaaaagtcataaccaataacagagcagaactaaatgaaattgaaactaaaaaatatacaaaagacaaattaaacaaaaactggtactttgaaaagataaataaaattgataggccattagcaagattaaccaagaaaagaagagagaagatccaaataaaccccattagaaatgaaacaggagatattacaaccaataccacagaaatacaaaagatcgttcaaagctactatgaacacctttatgtgcataaactagaaaacctagaggagatggataaagtgctggaaatacacaaacctcttagattaaaccaggaagaaatagaaactctaaacagactctaaatagtaacaagcagcaagattgaaattgtaattaaaaagttaccaacaacaacaaaaaaagtccaggaccagatggattaacagctgtattctatgagacaatcaaataagaatctgtaccaatgctattgacactattctaaaagataaaagaggtaatcctctctaaatcaaatcctaatatcaaaaccaagaaaggaccttaaataaaaagtaaactatagactaatatccctgattaacatagatgcaaaaatcctcaacaaaatactagctaaccgaatccaagaccatattaaaaatataatccaccatgatcaagtgggtttcataccagggatgcaggcatagtttagcatacacaaatcaataagtgtgatataccacataaataggattaaaaaccaaattcacatgatcatctcaatagacacagaaaaggcatttgacaaaatccagcaccgctttatgattaaaaccctcagtaaaattggcagagaagggacgtatcttaaggtaaagccatctgtgacaaacccacagccaacattatactgaatggggaaaagttgaaagcattccccctgagaactggaaaaagataaagatacccacttttaccacttctagtcaacatagtactggaaatcctagccagagcaattagacaagagaaagaaagaaagggcatccaaactggtaaagaggaagtcaaactgttgctgtttgtgatgattgtatacctagaaaactctaaagactcatctaaaaagctcctagaactggtaaatagattcagcaaagtttcaagatacaaaaataatgcacacaaatcagtagctcttctatacaccaacagttaccaagttgagaatgaaatcaagctcaattcctttgacaatagttgcaaaaaaaaaaatacttaggaatatacttaaccaaggagattaaaggcctgtacaaggaaaactacaaaacactgctgaaagaaatcagatgatgcaaacaaatggacacccctcccatgctcatggatggatagaatcagtattgtgaaaatgactatacttccaaaagcaatctacaaattcaatgcaattatcatctaaataccaccatcattcttcacagaactagaaaatacaatcataaaattcatatggaaccaaaaaagagcccacctagccaaagcaagacaaagcaaaaagaacaaatatggaggtatcacattatcccattgcaaactacactacaaggctatggttaccaaaacagtggtattggtataaaaatagttatgtagacaaatggaacaggatagagaacccagaaatacagccaacttatctttgacaaagcaaacaaaaacataagatgaggaaaggacaccctatttaacaaatggtgctgggataattggcaagccaggtgtataaaaacgaaactggattctcttctctcactttatacaaaaatcagctcaagatggatcaaagacttaaatctaagacctgacaccataaaaattctagaagtctcactccgtcgcccaggctggagtgcagtggtgcaatcttggctcactgcaagctctgcctcccgggttcacgccattctcctacctcagcctcccaagtagctgggactacaggtgcccaccaccacccccagctaatttttttttgtatttttagtagagatggagtttcaccgtgttagccaggatggtctcgatctcctgaccttgtgatacgcccgccttggcctcccaaagtgctgggattacaggcatgagccaccgtgcctggcctaaaaatgtattcttaaacaaaaaatgaaaaataaaaattgccctgcgaaagacactcttaaaggaatcaaaagagaggccacagacttggagaaaatatttgcaaaacatgtatctaaaaaagtattgctgtccacaagcttaaagaactttaaaaactcaacaataagaaaacaacctaatttaaacattggtaaaatttctgaacagatatcaccaaagaggctatatggatcacaaataagcatatgaaaatatgctttgcctcatatgccattagggaattaggatgggtctagagtggctttactttaggaattctttagtcctaccactaaggtaaaatctttttggggttactactgaatgcctctggttgagcattgagatatctctactcttggtgtttgaaattcaaatacctttcagtgttctgtcagctctcggatacattcagctctggaattcaggtaacttcgagtgctatgtaagctgtcaagtctaaacatctcttgggtttccacttcttttctgtgaagccccatgcaggtaaaataaaaatattaccatcaataacatttataaactcattctaccattaatgtcatttgttaatttaatttgcaacactcaagtagaaaacgttaagaggttggagaaaatttttccttctctacaacatctattccatgatatatatcccataaatgtataaacacaagtatatagatttgatccttacagaaattaaaagataataaagacaacaaaaatagtgcataaagcttgagcaattgatttagaaaaccctggattagaattctacttctatcatgccctggttttttgatcatgaaaaatcacttaatttctcaatgcttagaacagtatcattctaatattgtatataacagaatgttaaaatgatagtttaaattgaggtctccaaaactaggtggcaaatattccccaaattccaaagcaaggcactaaatcaccttggcaaggcttgaagagaaaatgaaaaagtaatttatgactcttaggtaaccacccaactcaattaataagagaagttagagaggccaagagagatgttagagattataaatatttctttaaagggagttttggtggtttttaagcctcccctatttttgaagaagtaggaaatgcttccctatctccctatgctggacctagtgaaaaggagttttcaaaatgattccttggacagcttaggatgtacacagtagattgagggagtagttgggatagcaagaaatactattgcttataactcaaccctatatggtttgctcttttaaagtatacattatatataagtgggttttctctaaatataaatattataatgcaaatattttctcttgaataatcagatctgagcctgagttctcatatagcaattatcagctgaagctgaagcatagctgcttctttaaattgtacagactttccagtttactaaaggttttactgttccatatatttcttacactttattcacttaagttaatttttaactgtctaaattttgcaggtatttgaatttccaaaacctgctcttggctctcaaattccaatagtttctgtaaaccgtgaactgttgactcagatatatttttacctggtacatgggattatattagttgtcttatctggcatttaggaataaattgcttaatgaataaacatcctactaaaaccagccttactgcctctgtttttgaatccctctagagcattacttatataaagtaatttttaaaagtatatcattaaattatattataattatttatatatttataatatataaattatataaatttataaatatatctataattttataaattatatcaatatatcataatgtataatatattaatgttaataatatattagtattatcaatatattatatataaatatatttataattttataagttatatataattataattaaattatattataattaaattatatttaattcccatgcttaaaagccttcagtgacttttcattacatctaaaataaaattcaaatgtatcaccttgatttaaaggtgtctatatgatcaagtacttgcttcttctccaacctcaatcactgtgttccaagcaccattaaccttttacagttcttttaataactcaagttaattcacaattaaatgtctttgttctagatcacctggattattgcctggttaaatcttttatattcatgcctgagctttaaagtcacctactaacagagcctttccttaagagacaaccacaaaacactctttatcacatattcctattttattttcattataacacatcactagcttatattttctcattttgcttatttgtttgctgttgcttcccttcaagtaaaatatagcaatatgagagcaagggcttttatgtcttgttcactgatatatcctcatatgtacaacagtgctcaatggtttggcagttaggtaatttatgaccttagctaatgtagtttcagagaaaagatggatgacaaagtttgatgaacatagggcaaagactgaatgcaagttgaataagcagagaaagcatccgttagtgattcaagaaatttgacactgaaagaataggaataagagaaaagagtaactaaaagaggaagaaaaagtaaaatcaggaagaggtggcagatatataatatagttatatacatatgtaacaaaccttcacgttgtgcacatgtaccctaaaacttaaagtattattaaaaaatatatatatatagttatatttctaggttgcactacaaaaagaggttattccaagcagccctcacttccataagtttctgcttttagtcagacaagggaagctctgagtagacttctttctacatctgttgattctcagttgccttcagctcaaaataatccatatgccaaagtggcatatattggtgtggcatattctgatcctcttcaaaatgaatgtaagtttttctatttatgtgtatatatgtatatatatatgtgtttgtatatgtgtatgtgtgtttatatatatgtatatatccattggattcctaaatcctataagcacatgatcaaaatatgtctcattccatttcagaatacttttgagagccatgtaaatccaatgtgttaatacattctgaaagagagtactcaaattcatatagttaatcatgatttaaggaaattagtgtaagaaaaggaaaaagtcacccccgtgggatatcagggtcaagaggaactgaaaggttaacttaatagcatccatgtagggtaagtcctttgaatcttacagttttggagatcagaatcccaaaatgagtctcacttggttaatatcaatgtgttggaagagctgcacttctttctggaggctgtagggaagaatttgttttccttcctttttcagcttctaaaggctgcctttgttctttggctcttggcccctttccatcctcaaagtccacagtggtcagtggagtctatttcatgttgcattaccctgacactaactccctgtgtctttttttgtttgtttttttcacttataaggactcttgtagttacggtgagcccacctgaataatccaagataatctccccatctcatggtcagccaaacagtgaccttcattccatctgcaaccttaatttcaccttgtcatgtaacataacatattcaaaggtttcagggatcaggacatggacatcttcagggctggtgcattattctacctactacactgatagtcaccctatattttattcttcacctttcctttcatatatcctcagctctcagctattagtttgattttttctacttttctctatcaccataactttttgagtactctgtaaactgtcacttgatttatttggtgatatgcaatagggccagaaataatctgttctggaaataaaaattcagtcagttaaatttcttcagaaatcacatacgcaatatacatttgttaaataaattaattaatacaagtatgtattcaaaaattgtatctaaattaatagaaacattagaattaatttgttttcacagctgaattatttcaaaatcactgactacattttcattaagtttagaagtattaagtggattgtttgctgtgtaatacatagattattatgctattaataaatagaaataataactttttcaggctatagcagaaatttttgcagtattttcttttctctagttgatattattagtaatggaaaaattaattggtactctataacttgcttgatcaatggctgtaagttactagaatatcctcaaaaacttagaaatttttatgtaggtcttctttcctcaaaaatcattgcaagagtcttgtagtgattatatgatattcaaaagtaaagctatccactgctgtgtgttcccaggttgtcccttacattttctatagtagaaacatcaaaaatattctaaggagatcttttagaaatattgcttcatttatatttacagtcagttttcaaaaataagattatcattttctttggagatcttgtataagccattggaaccatcatttttttctggtagtagcaaagaaaataaaagaaaacctaccaataatttaaatttaaatagtaatcagtgcagtggctatatcctcacttctgttactttgcttccttcactgagccaaaattccacattcaggttctgtttttgtaccacttaattcctgacaacaactgccatataagttgtggttcttaattgctaacaatagaaactagttggctgattgattagaaagggagtttattctcccattcacaattgctacaaagagaataaaatacctaggaatacaacatacaagggatgtgaaggacctcttcaagacgaactacaaactactgctcaagaaaataagagaggacacaaacaaatggaaaaacatttcatgctcatggataggaagaatcaatatcgtgcaaatggccatactgaccaaagtaattcatagattcaatgctatccccgtcaagctaccactgactttcttcacagaattagaaaatactactttaaatttcatatggaaccaaaaaagagcccatatagccaagacaatcctaagcaaaaagaacaaagctggaggcatcacgctatgtgacttcaaactatactacaaggcttacagtaaccaaaacagcatggtactggtaacaaaacagatatatagaccaatggaacacaacagaggcctcagaaataacaccacacatctacaaccatctgatctttgacaaacctgacaaaaacaagaaatggggaaaggattccccattttataaatggtgttgggaaaactggctagccatatgcagaaaagtgaaactggaccctttccttacaccttatacaacaattaatgcaagatggattaaagacttaaacgtaagacctaaaaccatgaaaaccctagaggaaaacctaggcaataccattcaggacataggcatgggcaaagtcttcgtgactagaataccaaaagcaatggcaacaaaaggcaaaattgacaaatgggatctaattaaactaaagagattctgcacagcaaaagaaactatcatctgagtgaacaggtaagctacagaatgggagaattttttttgaatctatccatctgacaaaagactaatatgcagaatctacaaggaacttaaacaaatttacaagaaaaaaaaaaccccatgaaaaagtgggcaaaggatatgaacagagacttctcaaaagaagacatttatgaggcccacatacatatgaaaaaaagctcatcatcgctggtcattagagaaatgcaaatcaaaactacaatgagataccatctcatgccagttacaatggtgattattaaaaagtcaggaaacgacagaagctggagaggatgtggagaaataggaacacttttacactgttggtgggtgtgtaaattagttcaaccattgtggaagacagtgtgatgattcctcaaggatctagaaccagaaatactatatgactcagcaatcccattactgggtgtatacccaaaggattataaatcatgctgctataaagacacatgcacacatatgtttattgtggcactattcacaatagcaaagactcggaaccaacccaaatgcccatcagtgataggagtggataaagaagatgtggtgcatatataccatggaatattatacagccatagaaaaggatgagttcatgtcctttgcagggacatggatgaagctggaaattgtgattctcagcaaactaacacaggaacagaaaaccaaacactgcatgttctcactcagaagtgggagttgaacaatgagaacacatggatacagcatggcgaacatcacacaccggggcatgttgcggggtgtgggactaggggatggataacattaggagaaatacctaatgtagatgatgggttgatgggtgcagcaaaccaccatggcacgtgtatacctatgtaacaaaccagcacgttctgcacctgtatcccagtacttaaagtataaaaaacatataaattcccagaattcccaggccccaccctagaactactgatcagaaattctcagtgtagggctcagccatctgtgtattaacatgtcctgtagaagattttgatgcatgataaagcttgagaatcaatattttaggaaaattcaatggctttttaaacctgatcaattaaagcaatagctcccctctcctcaaaaaagaaagggagtttattaaatggatattgggtaacttactgggagagctggaaaaatgagttcaagacaagcttccaagagcaacatcgcaaaccatgctatagaagtgacctaatgtggatgtattgacactcttaaaacaaattatgatctcttctcccactgtatctttattgcatgtgagaattactcagagaaggaaaaggctgaaagataagcagcaagcagttcgtgaaacaccccataaaccacatgattaaaaccccataaggaatttgaatattattctcgtggcaggagacttttaaacaggaatggcattatgagattttcattgtagaaagatgactgaggatgcattgtggaaaataggttggaagcaaggtcagaatacacaacaataggatgtttatgtacatgtatgtgcatacatatatgtatatgtatatcctattggcaaccaataggatgtatatgtatatatctatgtatgtgtatatatttctatttctgtctattcatcaatcaatcaatcaactatctagattgttttaagaaattggctcacacaactatggaggctggcaaatccaaaatctgtagggcaggttggcaggctggagacccagggatgattgatgttgctgtcttacatctaaaggcagtctggagtcagaattctttctcagggaacttggtcttataaggccttcaacagaaggccaatccatattatgaagggtaacctgctgtattcaaaatctgctgatttaaatattaatcacataaaaaatatcttcatagcaagatttagactggtatttggtcaaaaactgggtacctaagtggacataaaattaaccactacacaaggagaccagttaaggagttgcaatgtgaaagatttgatagtagcattaagaatgggcaaaaatagatgtactcaagagatgcttcaaagtagaattgactaacataatatgctgaatttggaatagaataacagatgataggcctgaccatcatagtggaaggttttgccactcactgagataggatacagaaaaagcaaagcaggatttggtaggaaagataaccagtttgttacgtgctaagtataagatttttgtggtacatgcaagtagagtgatctactgagtatttagatacattttctgaaatttggggaagaattctgagctgcagataaagattttggaatcataaacatataatggtaattgaaggctgagatggcccaggaggagtgagtaaggtatgaaaagaagtaggtctagaaaagaatgtaggaaaatatataagcagtagagaaaaataatttcccaagggaactttagaagtgatgggcaaaaaaaaaaaagaaattggagagtcttgttattataaaaagccaaaggaagaagaatgtatcatgaagaaaggtttgattataaagtcaaatattgcaatagggatcaaattagagaaagactgaaaagtgatcattgaatttagctactagaaagttgttattcgtgaccttattagccactaggtaataaattcatgtgtttttcataaaaaccctagaagaaaacctaggcattaccattcaggacataggcacgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacatcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagtgcaccagcatggcacatgtatacatatgtaactaacctgcacaatgtgaacatgtaccctaaaacttaaagtacaattaaaaaaaaaaaaaacattaaaaaataaataaataaataaattcgtgtgttttttatggtatatttacccacttggtgttaaaccaatacattaccaagtagtctgtaattgtatttgtaattttagcattaactgctatatattcttataagtaagaactttttttaataattgaaagataaattatagtgttttatataaaattatatactttgagttttgtgaacatttgttataattatataaactaaatgtcacagctgaaaagtatcaagcagcctgtgaaaacatgaattaaactgattaatacattactgctttaagaaatacttaaaagatcttgaaatattttaactcttattaaaaatagtattttctcatgccatttctatgtttttaaaaattgattctatgcaagtcttttggatagtaactactaaaatagcactaggaaactaagctttggatattattttaaaatgagcatctataatatgccactctctaggtagcaaatggaggttagtgatataaacaaaacataaaaccattgttttctttatttttttctgaaatttatatacatttaaggggtacaattgcagttttgttgcatgaatatactacatagtggtgaattctgagttcttagtgtaaccattacccaaataatataccttatacccattaagtaatttctcatccctcatcctcctccttcccacctttctgagtgtccaatgtctattatttcacactttatgtccatgtggacacgttatttaactcccatctataagtgagactgtaatatttcacagtttctgagttgatctaacttaggataatggcctctaattccatttatgttgctgcaaaagatatgatttcattttctatggctgaatagtattccattatatatctctctatatagctgtacctatatcatctatctatctatctatctatcatctatctatccatccatccatccatccatctatctatgtatctatctagctcacattttctttatcgaaccatccattaatggacacttagattgattccatgtatctgctattgcgaatagtgctgcaataaacttataagtggaattatctttttggtataatgatttcttctcctttgggtagatacctaatattgggattgctggattgaatagtagttatatttttagttctttgagaaatatccacactattttccacagagtttgtactagtttattttcccaccaacaatgtgtaagtgttccctttcctccacatccttgccaacatgttattttttgactttctaataatagtcattctgacataagatgatatctcattgtggttttaatttgtatttctctaatgaatagtgttgtagagcattttttatatacttgttggcaatttgtaggtctttgtttggaaaaaatgcctgttcatgtcctttgcctgttttttaatggggttatttgttttactgttgttgagttgtttgagttctttgtagattttggatgtcagtccccagaatagtttgcacgtattttctcccattctgcaggttggctattcgttctgttgattgtttcctttgttgtcagaaggttttattttaattaagccccacttgcctatttttgtttttgttgcttgtgcttttgaggtcttaataatgaatcctttgcctaggccaatgtccagaagagttttctcaagttttcttctagtagttctatagtttgaggtcatacatttaagtctttactccatcttgagttggtttttgtatatagtgagagataggggtccagtttcatgtttctgcatatgacaatccaattttcccagcaccatttattgaaaaggatgtcctttcccagtgtatgttttcattgactttattaagtatcagttgggtgtagatatgtggctttatttctgggttctcgattctgttctattgagatatgtgtctatttttatatcaatatgctgtttgggttactgtagctttgtagtgtaatgtgaggctgggcaatgttatgtcttcagctttgttctttctgcttaagattgctttggctattctggcacttttattggttccatatgaattttaagattttttctaattctgtgaaaaatgacattagtattttgatagaaattgcattgaatctgtagattgctttgggaagtattgtcattttaatgaatctagatcaatttagggaaagttgccatcttaacaatattgagtcttgaacatcttcatttattttggtctttaatttctctttgtaatattttatagctttcagtgaacaggtcttaaaacatcttttgttaaacttattccaaagtatttcttggtgctgttttaaatgaatttttcttaatatataattggtctttgctagtagatagaattacaatttatttaaaaatttgggggctgggcatggtggctcacaactgtaatccagcactttgggcggctgaggtgggcagatcacttgaggtcaggagtttgagaccagcctagccaacatggtgaaatcccatctctactaaaactgcaaagattagctgggcacggttgtgggctcctgtaatcccacttacttgggaagctgaggcaggagaatcgcttgaacccaggaggcagaggttgcagtgagctgatattgagccactgtactccagcctgggcaacacgagtgagactccatcttaaaaaaaattgattttgcattctacaaccttattatttgtttcagtaatattttatggctttcttatggttttcctatataaatttgatgttttctgcaaatagagttgtcttcctttccagcctgcatgctttttatttttctcaccttaatgcacttgatagtacttctagtatctagcatgatagtaaatagaaataatgatagatgattcttgctttattcattatcctaggtagaaagtattgttcctcttgctgttaagaataatgtacaaattttccttaaatgaacttaatcagattgaggaagttcacttttcctagtttactgggagattttattaagaaagcatcttaaactttgtcaaatgctttttctgtatctatcaaaatgattggttttgttttcagttgataggatgacttacattgattgattttttttttttttttttttattatactctaagttttagggtacatgtgcacattgtgcaggttagttacatatgtatttttaaatgttcaaccaacattgcattcctggcataaatcccactggttatattatataattctttaaaaaattttaaaaatatatattttttagagatgaggtctttctctgtcacccaggcttgagttcagtggcatggtcatagctcactaaagcctcaaactcctgggctcaggcaatcctcccacttaagcctgctgagtagctgggactaccagcacacattatcatgcacagctaatttttcaaaaatcttatctgtagagatgggggtctcactatgttggccaggcttgtcttgaactcctggcttcaagcaatcattctgctttggcttccgaaagtattgggattccagaagtgagccaccacacctggttttttttttttctgtctttttcttttcttttttttttgaaaggctctactctgtcatccagatgggagtgcagaggtgtgattatagctcactataaccttaaatttctggacttaagcaatcttcttgcctcaccgtccttactatctgggatcacaggtatgtgccactgaacccagctaattttattatcttttaaagttttgtagagatgagatcttgctatgttgcccaggctggtcttgaaatcctggcctcaaatgatcctcctgccttggccttatgaagcactatagtctttttatatgttgttgtattaaatttgccaacattttttattggtattttttgaatctatattcatgagagatattagtctgaagttttcttgttttatgatatagtttgtcatgatttggtattagagtaaaagtatttttatagaatgagtcagaaaatctttcttcctctcaatttttctgcaggaattttatagaattggcattattttttcctctaaatgtgtcatagattttattttataagtaatggtatcttgacctggagttttctttgaggaaataattttaattagaattcagtttcattaatttgtatagtgctgttaaatttcctacttctccttgtgtaatttatgtctttctgggaatttgtccatttcatttagattgtcaaatttattggcataattttttaaataatatttgtttgttgtctttttaatttctaaagtttttatggtaatattcctttccttataaaaggaaatgtgtgtactttctttttaccttgatcactctggcggaaggtttattaatttcattgaatttttcaaactaggttttggtttcactttttttaaattgttgatctgtttctattttattgatttatctgatcatctttattattgttctccttttttctggttttgaaattaatttgctcttctttttctaccttcttaagatgaaagcttacataatttaagatctttttctttgctaatataggtaataaaagctctaaatttttctcaaagtgctgctttagctgcatctcacacctttgatatatttttattagtttattaaattatctactgttttttatcaatgcttatttagtagtttataatttaattttcaaacatttggagggttttctggatgttattaatttcaaattcaattgtggtcagaaactatactctttatgatttcaatacttttaaatgctttgatacttgttttatagttcgaaatattttatctcttagtaattgtttcttttatatttcaaaagtatatttattctgctctttttgggttgtgtgttttataaatgccaattgggacaagttggttgatagccttttacttatgtcttcttcatttttactgattttgtcttatattagttatcgagaaaggggtgctaaaaactcgaactataattgtgaattcatctgtttctctttgtggttctatcaattttgtattatgtattttaagctctgtaattaggtgtataatttaggatttttatgtttttttaataatttaacccatttattattatgaagtgaccacctttaaccccggtaatgttctgtattctgaaatcaactttactgtatattaatatatctttccacctatatcttaattaatgttagcatggtgtataattttctatgttttaacttttaacctatttgtatatattaacctatttgtatatatttaaaggaggtttctgtacaaagcatatacttaggtctgcatttttgtcttttctcacaatcactgcattttaaatggggtgtttacactgtttgcatttagtgtggtattggtatagctgggtataaatctaccatcttgctctttgttttctatttatcttactagttcttagctccccccaacaatattctgcgttattttttgttaaactttttaatgatttcattttgtctccttcgttggctaattagctgtaatcttcttgctgattgccttatggtttatattaatagtgtgcagctgtaccttatataaatttaccttcaattaatgttatactactttatgaatggtataatagtaaagtttctatttcccctcctattggcctttgtgttattgttaatatcattttacttctacatacgttataaaccacaaatgtactattattatttttgctttaaacagtaaattattttttaaagataacttgtattttatatttacccatatatttatcattttaaatgttcttttttcctttttgtatatccagatactatttgatatcatttcccttttgcctgaagaccctctttcacattccttttagtgcaggtctgttcatgatgaattatttcagttttatgtgtctgaaaagtgtcttcatttcagtttcatttgtgaagaaaacttaattttggtcattatttaaaaaaaattttatctcttctctccctcctctttctcttttttattactcaaattacaactaattaggccatttgacattgacccacagttcaatggtgtgctgttctttctctacccctcagtgatttttttctctgtgttatattttgggtagtttttattgacatattttcaagttcactaatcctcaatgaatttttttaaaaaaatctctagatattctatttgagatagataggtagatagatggatggatagatagatctatcttctgtatatctacttaacatgctcaatctctctaccttcttcaacatatgcagtgtagtataataaatgttttactatctctgtctattatttctatcctgttttatttctgggtctctttctattgatatttctccttgttacaagttatatttttttacttctctgcagtgaatgccatacctcttgaattttacgtttttgagtgctaaaggttttcgtatttctataattatccttgatctttgtttagtatgcagttaagctatgtggaacagtttgatccttttgtaacctggttttaagtactgctaagcagaaccagagcagtctttatcttagggaggaatttttcctcatactgaggtaatattctctgagtactttgtatgtgaattctgagggtttgcacttttgttggtgggaacatgaaaaattcttgcctcaacataaactttatttttggtttgttttcttgatttattcttcaagaaggatgctttttcttcttggtttgttctttcctcagtctcagatagtttcttcaaacttattccttccttagtacttagctaaagatttgaggaagacccttctgcaaatctctagagctctttttgtgtgtcacattttcttctttgctactcaaccctatgaactctagttgtccctggcctccctagactgttaattctgtctccccattcagtaggcctgctagattttatctgggttccccttccttgtgttggagccttgaaattctctctaggcagtaaactggggctatcataagcctcgccttatatattttctctctttcagggatcattgtcatttcctacctgatatgcagtgtcttaaaatttgttacatacattttgtacagatttttaattgttttatgtggtgaataaatctggcccacattcctcattatgaccgtaagtggagactctcatctaatttgtatctttatgcaagcaaacaaatgataagtaaatatacatatatatcagatcatttggtatagaatatgtaagtaaattttgttatatggtgttttctcattcttttttttttaccttcattcctcctccttccttttttttctctctctcttacttatatgttatgtagcatatgtagatgacttgttaccatttattttccagttttctcgtttttttaccttatcatgtttttctgtgtagatgttttatacttttatttagtcagatatatcagtctatttctttatgatctctgagttttaaattatgcttagaagattttttatatgtcaagattatcaacatatttacctgtgtcttttaagtctcatcttatgatttaattatatgaagttattgactcactttgaatttattgtggtgaaaatagtgtttaatcaattaaaaaatcttaaatgaaatgaggtgtatctagattcccaattcttgtttaacttcatggaaaaagctgccatctttcaaattccttattgtcattctttttttcaaattgttggagtattaaacatctgaggtatacaatttaatttacatctactaagagtaagatttttcaactatttataaaaataagggaaaccaaatagcaaaacatctgttgatcaataagttagtttctttgctcattaatattggtgctaattaaaatgttagaatccttgacttttattatattagactcgggagacctggtgttgattgctattgccaacatgaaagtggtgcagctgtcctacagctccaatttttgatcaatgaggtaaggattattttttgactacttaaatcacacactcccccactacacagtgaatcagttaatgtaatcttttaaatactgtgattctaaatgcttaaatatatatgcatgcaatattacttctgattatatttttcacaaaagactgtactcctgtattggttaatttattaaattttaaagaaaaaagattgtatatgccatattctgttattgttactatatagcataatttagtttaattatttaaattaagaaaaaatcctaatgtcttttgattgcttcactggccattaattttttttctatacactcacttcccaccaacttaaattttgtaattaaggcctaacttcatattttatctttatcttccctgaaatgatccttttgcttatatacgtatgggcccttttatctgcatatatctccaaatacatttgttggaatagatatgcatttgtagttatttttgtgtccgtagttattatggaaattagctttctactgtatctacatttttataaaattatggtgatgaggaactctctaaaaacaaaatatgtatttatgaagctcagagaggttgcagatattccattagtagaaggctactttaggctttcttaaatcagatttttatagtggaaattagagtcttctagagcttcttttatattaagtgagccagtcaatgcaaaaatgctttaaaagtttgtgccatgccaaatgcaggcacttagaagattgaactcagtgtctcggaaaaaaatgtttggttattttctcatggcatgacaatgatctttcattcagtgtctgcatatatttgcatatatctatatctgtttatcttcctaagaacttacaattataagtgtgggtaaaatgtctcatagaacttcatatcagaggtaacccaaggcaagaaagatattggcaaatgttcacttttcacttctcttggctcaaagtctttctcagaggactatgagatcctctttattgacaaacgtagcatatttcaccatgtaggcacacttgctatggggtactgaaatgagaaaggaaggtaaagaaaacatttgaaaaatatttcattgtaataactgctcattattatctagaatgtcaggcttctcgaggtctcagtgatactctgtagttccttgttgagggatctcagctttttgccttctgcatggatgtatacttacaggcataatttgtttccatgtgatttgtactgggtctgatcctttgagacttgtcttccaggtcctaagtttgcccctgtggtacataactaagaataaataaagacaagccttcaacctccttgccttgttcacctcatttatcctgaactactcgccctatgtacctcacacaaagctgctgtatcttttcccaaacttcccagtttctgacctgactggtttttctattcttagttttaagcattttcacagatctttatagtgcttttggtaggttcactttgtttttataaatgaacctagacactgtggtgttctgcttactttcatgtgtctgtctctgttggtgctgttatgcttagtggtaccgttcacttctctccgatgataagtcacatctcagttttatcacagaattaagaatactggccgggcgcggtggctcacgcctgtaatcctagcactttgggaagttaaggtgggtggatcacgaggtcaagagatcaagaccatcctggccaacatggtgaaaccccgtctctactaaaattacaaaaattagttggacgtggttgcacacacctgtagtcccagctactcaggaggctgaggcagaagaattgcttgaacttgggaggcagaggttgcagtgagctaagatcgcaccactgcactccagcctggcaacagagcgagactccatctcaaaaacaaacaaacaaacaaaaaaagaatactgagttcctcactagaattatttaggtattactgtaagatattattgaatatatgctactttaataacattgcctttggcatgttttatcttctgtatagcatgtaactatctcttgtagagaatgttttattgttgttacatatcatgttctatcctcaccccatctcaggtgaacttccacctctctgagaaatgagaccagtatactgtattcaaaaaaatcaagtgtaactcatcaaatgcttccaaggaatcctaataaatttctcgtttgtttataggaagcataagtacagtatacaaataaaacaggcaaacaaacacaaaaattatcaaggcttatatatagaatacctcctatttcattgaaggaaattatctgagttcatgttaagatgtatatatcaatatatacatctttgaacatgtatgtatgtaattagatataaatgtgcaaatcatacaaatttctaaatattttcttggatatgatctttgattatgtttctatttttataaagccattcctctctgagactaaaatcacaggtaccaaatataaagagacctatcataggatacatgagcatttttttggcttagaaattattatagaagggcatttagattcctatcttctctcttctaattcctaaagaagaaataaatgctagcaatttcaatatcgttcttcctagcatctaaatgggatatctgtgattgatactgtaaactatgagagattacttctaacaaagtactttggaaaatataaaaagccttttaggtatctctggacaaccaaggttctgaaagatcactcttagagaacacatttaatgctctggatttaggatctgtgaatgggtaagcatcgacattttcagctggttagctgtcattatggtaaaagttctaacattttaaaatgatctgatttaacccagtcaaataaatagtttaagcatatatacaaagtcatacaaacagttattatctgtccacatgctttctgccacattaagaggtagaaaatatcctattgtatgcgaaataggattcatttgtatttggtggtgctgtataaaaggaatcttagtataattttatagttatactaaattctagttggagaaatgttttcttttattatggatatttcctttataattgatgaagcttcttggactataagaagcaaattaaattataccaaatatactttttaggaagaatatacgctttccaaatatacagaaaattcttgcaaaggagaatttttatatgacctgtattcaattttgtaagactgcattgaatattttcttctctgtaaggctatatagtatatgtgtaaacagtagaaacaaaaaccatccctaaactattttttcccaaagaaaaacctttaatggccataacagtgctataataattaatcctctctattggtaaataaatattccttaagctagtctccctgaccgttgaaatgcagtgggtcagttgcctcttctactttcagcattcttacccttcctgattgaagtttatgcacctatccttccttatatttctgagataacaaaagtaactcttcaggtagtaaacattgagtaaattagcttgtttgtgattaaaaaaaccctaaattaagtaaatcacacacttactttatcttctttttgttctagggtgccttggtcagtgcaagttcagatgatacacttcatttgtggaaccttagacaaaaaaggccagccatactccattctcttaaatttaaccgggaacggtaagaacctatgaattaaacaatttcttaatgtacaacaaaattatttcctgagcaagtttttgttaacttgacaggcttttttcctcataatctcaacagctagaaataatttaatgtttatgcttactttcatagtgttttcttttttgtagaaaatgcgtaattgatatagatccagtcacctactaatgcagtgtttattagcttaaggagcttttgggctgagattatggggttttctatgtgtagactcatattatcttcaaagagagataatttgacttcctttcttcctattaatatttacaggccttttatttctttctcttgcatgattgctctgcctaggacttccagtctatgttgactaggaatggtgagagatggcatccttgtcttgttttggttttcaaggggaatgcttccaggttttgcccattcagtatgatgttggctgtgagtttgtcatagatggctcttcttattttgaaatatgttcctttaatgtctagtttgttgaggggttttaacatgaaggacatcgaattgtaccagaagacttttctgcatctattgagatagtcatgtggtttttgttttcagttctgtttatgtagtagatcgcatttatgtatttgtgattattgaaccaaccttgcatcctgggataaagcctgcttgagtgtggttgattagctttttcacgtgctgcaggattcagtttgctagtattttgttgagaatttttacatctgtgttcatcaaggatattggcctgaagatttttttgttgtatttctgccaggttttggtatcaggatgaagctggcctcatagaatcagttggagaggagttcctcctcctcaattttttggagtagtttcagttagaatggtacaagctattctttatgcatctggtggaatttggctgtgaatcattcttgtcctgggtcctttatggttggtaggctttttattactgatttaattttggaactctttattggtctgtccagggattcaatttctccctggctcaatcttgggagtttgtatgtttccaggaatgtattcatttattttaggttttctagtctatgtgcatagaggtgttcatagcagtctctgagggttttttatatttctgtggggttggtggtaatgtcttttttggcatttatgattgtttatttggatcttctctctttttctctttattagcctagctagtggtctatcatatttcttatgtcaaaaaaccaactcttgtactcattgatcttttgtatggtttttttgcctcttagtttccttcatttcagctctgattttagttatttcttgtcttttgctagctttgggtttgttttgtattgtttctctagttcctctaggtgtaatgttaggttgctaatttgagattttatgaatttttgatgtggacctttagcactataaactttcctcttagcactactttagctgtgtcctagagattctggtatgttttcttggttctcagtagttccagagaatttcttgatgtctgccataatttcattgtttacccaaaagtcattcaggaccaggttgtttaatttccatccaattgtatggttttgagcgattttcttagtattgatttttatttttattgcattatggcctgagagtgtggttggtatggtttcattttttttagattttctgaggattgttttatgtccaattgtgtggttgattttagagtatgtgctatgtacagataagaagatggtatattctgttccttttgggtagggcattttgtagatgtctaatagttccatttggtgaagtgttaagtttagatcctgaaaatctttgttaattttctgactggatggtctatctaaaaactgtcagtagggtgttgaagtctcccactattattgtgtgggaatctaagtctctttgtaggtctctaagaactcgctttatgaatccgggtactcctgtgttgggtgcatatatatttaggatagttaggcattcttgttgaattgaaccctttaccattacgtaatgtccttccttgtcttttttgatctttgttagcttaaagtatgttttgtctgaaataacaacccctgcttttttctgactgccatttgcttggtagattttcctctatccctttactttgagcctatgggtgtcattacatgtgagatgggtctcttgaagacagcataccattcagtcctgcttctttatacagcttgccactctgtgccttttaattggagcatttagccaatttacattcaagtttaatatttatgtgtgtggatttgatcctttcatcatgtttctagctggctattgtgcatacttgtttgtgtggttgctttatagggtcaacagtttgtatacttaagtgtctttttgtagtagcttataacagtctttgctttccatatttagcactcctttcaggacctcttgtaaggcaggtctggtggtcataaattcccttagcatttgcttatcgggaaagaatctaatttctcctaggtttatgaagcttagtttggctggatatgaaattcttgcttggaaattgttttatttagtaaggctgaatatagacccccaatttcttctggcttgtaaggtttctattgaaaggtcctctgttagcctgatggggtttcctttgtaggtgacatgccccttctctccagttgcctttcactttttcccttttctttcagccttggagaatctaattatgtgtcttggccatggtctttttgtgtagtatctcacgctggttctctgcatttcctgaatttgtattttggcctctctagtgaggctggggacgttttcatgggtgatattctgaaatatattttccaagttgcttgctctctccttatctcttgcagggatactaatgaattggagatttggtctctttacataatcctttattttttgagtgttttgttcattttctttctctgactgagttagttcagagaaccagtcattgagctctcagattctttcctgaacttggtctattcttctgttaatacttgcaattacattatgaaattcttgtagtgtgttttccactctatcagatcagttagagtctttttttttttttttaagacagagtcttgctctattgcccaggctggagtgcagtggcacaatcttggctcactgcaacctccgcctccctggtttgagcgattatcctgcctcagcctcctgagtagctgggactacaggtgctgggagcccaggtcaagaggcactgcccagtgaagagtagtggaggcatgtggacaagtctggctgcttttccataaagtggctgtgttgtgctagaggtttgtatcggtccccaaccactatatgtcctctcaatcccaagggcaacaggagcaagggctgcagggcagcaaaaatggtggcctgcttgctccttctgtgagctctgtcccagaaaagcacagagctgctactagcctgagagcctaggtagggggtggctagagaccccggtagggagacactgcccagagaaccatagcagggttggggacccatgtagaaaacagtctgctgcttttctgtaaggtggctgcactgtgctaggggttcatggtagtccctaatcactgtgtaccctcctgatcttgagggcatcagtggggaaggttgtagggcaacaaacatggtggcctgcctttcccactgagagctctgtcccagggaagtggagagctggtagtggcctaagagtccagtgtggggtggttgaggttctaggtcaggaggccttgctcagtgagaagtagcaggggtgggggctcctgtgtaaaacaatctggctacttttccttaaggtggctgccttttactgagtgtctacgattgcccctaatcactgagtacactccccagcctgagggcaaacaggagggagggttgtggatgtggtctgcctctccctctagaagcttgtcccagaaaagcacagagctgctcctgatccgagaattctggtagggctgtggtggtctcactagtgtcccaggcccatgggtcttatcctgcaaggtgctgcagagacgaggcctgtagcaccttgcaggataaggtctactgggcctagttactcttcagccacatggattcagcccctttcctggagacgtgagggagcctggcctcctccattgctagagctgcatctgctggtgttgaggtgcctggggatccagcactcctgggagtctgtgagtacctgagtgatggctctgccaagactccacataactctttgcatgtttgtctggaagccctggttgcagggatcatgagaaatctcctgatcctgagtccaaggatgcaaaggtccatgacagaagtgtgaatccctggggactctcactcactcactgttccctgtgatgtgaggactcctctggctccatgccacttctgggtgggcaattgtcctgtcttgctcttctctgttcactgtgggtgatgctgtttccctgataaatccccatgtttccacctggatgttctggttgaagagctagtgtccattcaccactgtttcttctctccatgagagtggtgcttattacccacttctactcagctatctcacgccaaatctctaaacttagtctttttttttaagaggaaaggaatttatattttagaaatttgttgaaactagataggacttatttctttagtcctaattctggttattttagtttaaaataagtaatgtagcagaaatttcaaggatatcaaaaaactttaagatcagtaaagagttgttcagaagagagtgggggccaatattcaacattcttaaagaaaagaattttcaacccagaatttcatatccagccaaactaagcttcataattgaaggagaaataaaatactttacagacaagcaaatgctgagagattttgtcaccaccaggcctgccctaaaagagctcctgaaggaagcactaaacatggaaaggaacaaccggtaccagccactgcaaaaatatgccaaaatgtaaagaccatcaaggctaggaagaaactgcatcaactaacgagcaaaataaccagctaacatcataatgacaggaccaaatacacacataacaatattaactttcaatataaatggactaaatgctccaattaaaagacacagactggcaaattggataaagagtcaagacctatcagtgtgctgtattcaggaaacccatctcatgtgcagagacacacataggctcaaaataaagggatggaggaagatctaccaagcaaatggaaaacaaaaaaaagcaggggttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaaggaagtcctgagtgacctacaaagagacttagactcccacacaataataatgggagactttaacaccccactgtcaacattagacagatcaacgagacagaaagttaacaaggatacccaggaattgtactcagctctgcaccaagcagacctaatagacatctacagaactctccaccccaaatcaacagaatatacattttttttcagcaccacaccacacctattccaaaattgaccacatagttggaagtaaagctctcctcagcaaatgtaaaagaacagaaattataacaaactgtctctcagacaacagtgcaatcaaactagaagtcaggattaagaaactcactcaaaaccgctcaactacatggaaactgaacaacctgctcctgaatgactactgggtacgtgacgaaaagaagacagaaataaagatgttctttgaaaccaacgaaaacaaagacacaacataccagaatctctgggacacattcaaagcagtgtgtagagggaaatttatagcactaaatgcccacaagagaaagcaggaaagatccaaaattcacaccctaacatcaaaattaatagaactagagaagcaagaggaaacacattcaaaagctagcagaaggcaagaaataactaaaatcagagcagaactgaaggaaatagagacacaaaaaaacccttcaaaaaattaatgaagccaggagctggtttttcaaaaagatcaacaaaattgatagaccgctagcaagactagtaaagaagaaaagagagaagaatcaaatagatgcaataaaaaatgataaaggggatatcaccaccgatcccacagaaataccatcagagaatattacaaacacctctatggaaataaactagaaaatctagaagaaatggataaattcctggacacatacaccctcccaagactaaaccagggagacgttgaatatctgaatagaccaataagaggttctgaaattgtggcaataatcaatagcttaccaaccaaaaacagtccaggaccagatggattcacaaccgaattctacccgaggtacaaggaggagctggtaccattccttctgaaactattccaatcaatagaaaaagagggaatcctccctaactcattttatgaggcccgcatcatcctggcatccaggctttgataccaaagcctggcagagacataaccaaaaaagagaatttaagaccaatatccctgatgaacatcgatgcaaaaatcctcaataaaatactggcaaacagaatccagcagcacatcaaaaagcttatccaccatgatcaagtgggcttcatccctgggatggaaggctggttcaatatacgcaaatcaataaatgtaatccagcatataaacagaaccaaaggcaaaaaccacatgattatctcaatagatgcataaaaggcctttgacaaaattcaacaacccttcatgctaaaaactctcaacaaattaggtattgatgggacatatctcaaaataataagagctatctatgacaaacccacagtcaatatcatattgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagagaaagtcaaattgtccctgtttgcagatgacatgattgtgtatctagaaaaccccattgtctcagcccaaaatctccttaagctgataagcaacttcagcaaagtctcaggatgcaaaatcaatgtacaaaaatcacaagcattcttatacacaaataacagacaaacagagagccaaatcatgagtgaactcccattcacaattgcttcaaagagaataaaataccttggaatccaccttacagggacgtgaaggacctcttcaaggagaactacaaaccactgctcaaggaaatagaggatacaaacaaatggaagaacattccatgctcatgggtaggaagaatcaatatcgtgaaaatggccatattgcccaagataatttatagattcaatgccatccccatcaaactaccaatggctttcttcacagaattggaaaaaactactttaaagttcatatggagccaaaaaaatcccccattgccaagtcaatcctaagccaaaagaacaaagtcggaggcatcacactccctgatttcaaactatactacaaggctacagtaaccaaaacagcatggtactggtaccaaaacagagatatagatcaatggaacagaacagagccctcagaaataattctgcatatctacaaccatctgatctttgccaaacctgacaaaaacaagaaatggggaaaggattccctatttaataaatggtgctgggaaaactggctagacatgtgtagaaagctgaatttggatcccttacaccttatacaaaaattaattcaagatggattaaagacttaaatgttagacctaaaaccataaaaaccctagaagaaaacctaggcaataccattcaggacataggcatgggcaaggacttcatgtctaaagcaccaaaagcaatgacaacaaaagccaaaattgacaaatggcatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacacccgttagaatggcaatcattaaaaagtcaggaaacaacaggtgctggagaggatgtggagaaataggaacacttttacacggttggtgggactgtaatctagttcaaccattgtggaagtcagtgtggcgattcctcagggatctagaactagaaataccatttgacccagccatcccattactgggtatatacccaaaggattataaatcatgctgctataaagacacatgtgcacgaatgtttattgtggcactattcacaatagcaaagacttggaaccaacccaaatgtccaacaacgatagactggatgaagaaaatgtggcacatatacaccatggaatactatgcagccataaaaaggatgagttcatgtcctttgtagggacatggattaaactggaaaccatcatctcagcaaactatcacaaggacaagaaagcaaacaccgcatgttctcattcacaggtgggaattgaacaatgagaacacatggacacaggaaggggaacatcacactccagggcctgttgtggggtggggggaggggggagggatagcattaggagatatacctaatggtaaatgacgagttaatgggtgcagcacaccaacatggcatatgtatacatatgtaacaaacctgcacattgtgcacatgtaccgtaaaacttaaagtataataataataaaattttaaaaagagttgttttactgtttctttttctttaccagtaaaatattaacctatttagatcaccatattgattttatctttctctctgtttgtaagatttttcttctaatactttgaatagatctgactgtatacttttatgtggatggacagagtgtttttatttcccctcacaattggaatgttgaaggcaatgttctggccccttttatggactttttgggaggaagaattgattagtggtgatgatttccaatagtgattttattatctcaactgagttagattaattggtagaaacataaaagagcaagctgacagatttgagataagttttaatcacaggaagtttgaaaatgttttaatgcttacattaaagataaatgtgatatttatctcttaagaaagatacatacatattgtcatgtaacatgagaatattcattatgatcataacttattggaggagataaaattatctatcgaagtatggtgaatgggaggttcaggtcctataggagaatttaaccaagcatcttttgggacattctccaaaacatctgatattagccgtttaattctgtaaattttctaagtactcttatgtttatgctaaatgtgtttcagtttataaatttatactataaattttagcttattttattagggcacctacagtctttagtcttacaatttttgaaggcagaatccagccttagattgttaagtaataggctttcattattattattactattattggagtattattattggagacagggtcctgctctgtctcccaggctggagtgcaatggtgtgatcctagctcactgcagcctcaaactcctgggctcaagcaatcctcccgcctcagcctccttagtgctgggactatgggcatgtgctaccatacccagctattttttttttaaagtagagatggtttcttactatgctttttttgagacagggtctcactctgtcacctaagctggagtacagtagcatcagcttggctcacacaaccttgaattcctgggctacagcagtcctcccaccttagcctcctgaggtgtgcactatgatgcctgactaatgttaattttttttttttttttgtagaaacagattctctccatgttgcccaggctgatttcaaattcctgggctcaagcaatcctcccaccttagcctcccaaagtgctgggattagaggcatgagccactgtgcttggcctggggtctcactgtgttgcctaggctagacttgaactactgggctcaagctatcctcctgccttggccttacaaagtattaggattacaagtatgaacctttgcatctggtaaggcttatatattaaagcctttctggtggatgatccttggacttcttacaaatacgattttaaacctaaatagggaagaaaaaatgtcttgatttttgtaatgcatgatctgagtaatgaataaaataaaacattcatattttaggcatagcagtccttgctatcacaatcataaatttatgtaatactggagaaagcatagagttgttttatatggcttttgagtgaaattcaaatgtaggctacgatatacagacccttaaattatctgtacttattatgtatatttaatttttcttactctagtgttctgctacttactatcagagaatttctgaaaactattaactaaactggaaggaagcaatattttgttgaaaactccataatttatgaaatctctggcaaactggatccatctgaattggcttttgcagacccaatttataacccacatttaaaatattttataaaggcaatttgaactggctttgattcttttcaaagtgttgcataactaatatatttactgggtttgacattcaaaaggtacaacagtgtatgcaataaaggatctttcttctattcctgtcccctggacacttacttacttcccctcagcagagctaaacagtgtaattaatttgttttttctttatagacgttcattacatacatatataagcaaatataatatgtaacataattttctttcttatatgtacataagccaaatagaaaaccatatatttttacatatatcatatatagagagaatatcatatttttttgttaaacaaattagcaagacctttaaacaaattagcaaggtctttataatatattataaagagggaaaaaagcgagacaaaatatacatatatatttatatatattttattacacacaatatattgttaaacaaattagcaagatctttagaatatattataaagaaggaagaaagcaagacagaaaactgcataacatgctacataacaatgaaaataaataaactacagttaaatgcaacatggatgaaactcataaatacagtgctgagcaaaagaagccgaaagaaaacttcatatatattattccatttttgtatgcgtcaaaaaacaggcaaaattaatgctacatgttaatgtagcatgttatacagttttgtgtcttgcttttttccctctatagtatattctaaaggatcactctttatatagactttccctatttctttgtttgtttgtaaattttactgaatcatcaggaaactgtttaaatcttaagtgtacaccttgaaataactttgccgttgtgtaacaaacacctaaatcaagatacagaaaattactagattcatagaaactcccctatgttaccttccagtcacttacccccaggtatcctaatttccaactctatagattaattttgcctgtttttgacacatataaaaatggaataatatatatatagttctttgcttttggattcctttgctcagcactgtatttatgagttccatccatgtggcatttagctgtagtttatttattttcattattatgtactattctatttaatggatattctgcaatttgattaaccattctattttagttctctttcttaaacttaacttttgcatttctattttttataacatttctttagaaaatatatcaataatttggtataataataaaaatttttaaattctttttatatctcttttttctatctctcattctctgtctctcactctatcttccaaatacatactatagcctgactcatcatattgttttctgtctcccaagtagcataacaccttgctcttttatttatgttttttgttgttgttgttttttaaaaattttttattatacttaaagttttgggatacatgtgcagaaagtgcaggtttgttacataggtatacaagtgccatggtggtttgctgcactcatcaatccgtcatctacattaggtatttcttgtaatgctatccctcccctacacccccatcacccaacaggaccagtgtgtgatattcccctccctgtgtccatgtgttctcattgttcgcctcccacttatgagtgagaatatgcggtgtttggttttctgttcttgtgttagtttgctgagaatcgtggtttccagcttcatccatgtccctgcaaaagacatgaactaatccttttctatggctgcataggagtccatggtgtacatgtgccacatttactttatccagtctatcactgatgggcatttgggttggttgcaagtctttgctactgtgaacagtgctgcaaaaagcatgcatgtgcatgtgtctttatagtagaataatttctaatcctttggttatatacccagtaatgggatggctgggtcaaatggtatttctgattctagatccttgaagaatcgccacagtctcttccacaatggctgaactaatttacactcccaccaacagtgtaaaagtgttcctatttctccaaatcctctccagcatctgttgtttcctgactttttaatcatagccattctaactggcgtgagatggtatctcattgtggttttgatttgcatttctctaatgaccagtgatgatgagctgtttttcatatgtttgttggctacataaatgtcttcttttgaggagtgtctgttcatatcctttgcccactttttgatggggttgtttttttcttgtaaatttgtttaagttctttgtagattctggatattagcctttgtcaaatggatagattgcaaaaaatgttctcccattctgtgggttgcctgttcactctgatgatagtttcttttgctgtgcagaatctctttagtttaattagatcccatttgtcaattttgccttttgtttccattgcttttggtgttttagtcatgaagtctttgcccatgcctatgtcctgaacagtattgcctagattttcttctagagtttttatgattttaggtcttacgtttaagtcttcaatccatcttgagttaatctttgtataaggtgtaaggaaggggtccagtttcagttttcaggatgtggctagccagttttcccaacaccatttattaaatagagaatcctttccttattgcttgttttagtcaggtttgtcaaagatcagatggttgtagatgtgtggtgttatttctgaggcctctgttgtgttccataggtctgtatatctgttttgttaccagtaccatggtgttttcattactgtagccttgtagtatagcttgaagtcaggtagcatggtgcctccagctttgttctttttgcttaggattgtcgtggctatgtgggttcttgtttggttctatatgaaatttaaagtagttttttttctaattctgtgaagaatgtcagtggtagcttgatggggatagcattgaatctacaaattactttggtcagtatggccattttcaccatactgattcttcctatccatgagcatggaatgtttttccgtttgtttgtgtcctctcttatttccttgagcagtggtttgtagctctcctcgaagaggtccttcacatcccttgtaagctgtattcctacgtattttattctgttagtagcaatggtgaatgggaattcactcatgatttggctgtttgtctattattggtgtctaggaatgcttgtaatttttgcacattgattttgtattctgagactttgcttaagttgcttatcagcttaaggagatttggggctgagactatggggttttctaaatatataatcatgtcatctgcaaacaaagacaatttgatttcctctcttcctatttgaataccctatatttcttttgcttgcctgattgccctggctagaacttccaatactatgttgaataggagtggtgagagagggcatccttgtcttatgctagttttgaaagggaatgcttccagtttttgcccattcagtatgatattggctgtgggtttgtcataaatagctcttattattttgagatacgttccatcagtacctagtttactgagtgtttttagcatgaaatggtgttgaattttgtcaaaggccttttctgcatctttggaggtaatcatgtggtttctgtcattttttctgtttatgtgatggattatgtttattgatttgcatatgttgaaccggccttgcttcccagggatgaagctgacttgattgtggtggataagctttttgatgtgctgctggacttggtttgtcagtattttattgaagattttcacatcgatattcatcagggatattggcctgaaattttccttgtttgttgtgtctctgccagattttggtgtcaggatgaagctggcctcataaaatgagttagggaggagtccctctttttctattgtttggaatagtttcagaaggaatgataccagctcctctttgtacctctggtagaattcagctgtgaatctgtcttgttctggactgtttttggttgttaggctattaattactgcctcaatttcagaatttgttattggtctattcagggattcgacttcttcctagtttagacttgggaggttatatgtgttcaggaatttatccatttcttccagattttctagtttatttccatagaggtgtttatagtattctctgatggtagtttgtatttctgtgggatcaatggtgatatccactttatcattttttactgcatctatttgattcttttctcttcttctttattagtctggctagcggtctatctattttgttgatcttttcaaaaaaccagctcctggatttattgattttttttgaagggttttcctgtctctatctccttcagttctgctctgatcttagttatttcttgtcttctgctaccttttgaatatgtttgctcttgcttttttagttcttttaattgtgatgttagggtattgattttagatctttcccacattctcctgtgggcatttaatgctataaatttccatctaaacactgctttagctgtgtcccagagattctggtacgttaagtctttgttctcattggtttcaaaaaacatctttatttctgccttaattttgttatttacccagtagtcactcaggagcatgttgttcagtttccatgcagttgtgtggttttgagtgagtttcttaaccccgagttctaatttgattgcactgtggtctgagagactgttcgttatgatttctgttcttttgcatttgctgaggagtgttttacttccagttatgtggccagttttagaataagtatgatgtggtgctgaggtgaaagcatattctcttgatttggggtggagagttctgtagatgtctattaggtccacttggttgagagctgatatcaagtcctgaacatccttgttaattttttgtcttgttgatctaatattgacagtggggtgttaaagtctctcactattattgtgtgggagtctaattctctttgtaggtctctaagaacttgcctagtgaatccgggtgctcctgtatgtggtgcagatatatttaggatagttagctcttcttgttgcattgatccctttactattatgtaatgcccttctttgtctctgttgatctttgttggtttaaagtctgttttatcagagacagggattgcaacccctgctttattttgctttccatttgcttggtaaatgttcctccatccctttattttgagcctatgtgtgtctttgcacatgagatgggtctcctgaatacaacactctgatgtgtcttgactatccagtttgccagtctgtgtcttttaattggggcatttagcctgtttacaattaaggttaatattgttatgtgtgaatttgatcctgtcattatgaagctagctggttatttttcctgttagttgatgtagtttcttcgtagagtcgatggtctttacaatttggtatgtttttgcaggtgctggtaccagttgttcctgttcatgtttagtgcttccttcaggagctcttgaaaggcaaagccgccaggaagcttttgtaaggcaggcctggtggtgacaaaatctctcagcatttgcttgtctgtaaaggattttatttccctttgcttatgaagcttagtttggctggatatgaaattatgggttgaaaattcttctctttaaaaatgttgaatattttccccccactttcttctggctggtagggtttctgcagagagatctgctgttagtctgatgggcttccctttgtggctaacctgacctttctcagtggctgaaggaaaaatgttaaacattttttccttcatttcaaccttggtgaatctgatgattatgtgtcttgggattgcttttctcaaggagtatctttgtggtattctgtgtatttcctgaatttgaatgttggcctgggcctgtcttgctaggttggggaagttctcctggataatatactgaagagtgttttccaactttcttctgttctccccatcactttcaggtacaccagttaaacataggttaggtcttttcacatagtcccatatttcttggaggttttgttcattccttttcattctttttttctaatcttgtcttcgtgctgtatttcattaagttgctcttcattcttgacattctttcttccgcctgattgatttgtctattgatacttgtatatgcttcacaaagttctcattcagtgtttttcagctccatcaggtcatttatgttcttctctaaattagttattctagttagcaatgcatctgaccttttttctaggttcttagcttccttgcattgggttaaaacatgctcctttagcttggaggagtttgttattacccatcttctgaagcctacttctgtcaattcatcaaactcattctccatccagttttgttcccttgctggtgaggagttgtgatcctctggagcagaagagtcattctggttcttggaattttcaacctttttgcgctggcttctccccatctttgtggatttatctacctttggtctttgatgttggtaaccttcggatggggttttggtgtggatatcctttttgttgatgttgatactattcttttctgttggttagttttctttctaacagtcaggccatctgctggagtttgctggaggtctactgcagactgtttgcttgggtatcaccagtggatgctgcagaacagcaaagattgctgcctgtttctttttctgtaagcttcatcccaaaggggcacccgccatatgtcagctggagctctcctgtatgaggtatctgtcaacccctgctgggaggtgtctcccagtcaggagttatgggggttaggtacccacttgaggaggcagtctgtcccttagcagagcttgagcactgtgctgggagatctctattcagaactagcagccaggaatgtttaagtctgctgaagctgcgccaacacccgctccttcctccaggtgctctgtcccagggagatgagagttttatgtataagccccagactggggctgctgcctttctttcagagatgccttgcccagcaaggaggaatttagagaggaggtctggctatagcacctttgtggagctgtggtgggctccatccaggtggaacttcctggcggctttgtttacactgtcagcagaaaaccgcctactcaagctgagtaatggaggacgcccctccccccaccaagatagcatgtttcagatcgacctcagactgctgtgttgacagcaagagtttcaagccagtagatcttagcttgctgtgctcggtggggttggggtccactgagctagaccacttggatccctggcttcagcccactttccaggggagtgaatgcttgtctcactggcattccaagcgccactgaggtatgaaaagtaactcctccagctagctcggtgtctgctcaaatggctgccatattttgcacttgaaacctagggccctggtggtgtaggctccggagggaatctcctggtctgcaggttgtgaagactgtggaaagtgtagtatctgagccggaatgcacagtccctcacagcttcccttggctaaggtagggagttcctcaaccccttgcacttcctgggtgaggcaacgccccaccctgcttctgctcctcctcgatggtctgcaccaactatctaaccagtcccagtgagatgagctgagtacctcagttcaaaatgcagaaatgactcaccttctgtgttgatcttgctaggagctgcagaccggagctgttcctatttggccatcttgccagccgctcttgcatttctgtttaacaaatggcttgaaaaattccacaaacacccttgtgagattttgattagaactaccttgaatctatagatcattttcgggagaactgacatgactgtgggagatggcaatattgactctctgtcattgacagtgacagtggtgattcattcagtctgtggacatatgttatattcctttatttgcttagagtctttgctttctccaggtaacatttatagatttttttgtagagatgttccacatttttttaggttttgtcttaaatatttgattttttaaaaaatgtcaactcttattttagacagagaggatgcatgggcatgtttaatgtttattacatggacatattatgtgatgctgaggtttggggtatggatcctgtcgcccaggtggtgagcatagtaccaaataggtagtttttccgtctagtatgtagtttgccttcctccgtcttctagaagttcatagtgtccattcttcaaatgtttatgtctatgtgtgctcaatgtttagctcccacttttaagtgagaacatatagtattgttttctgttcctacattaattcttttaggattattgcctccagctgcattcttgtggctgcaaaggttgtgattttttttttttatggctgcatagtattctatggtgtatatgtaccacattttctttatctgatccactgttgatgggcacttgggttgattccatgtccttgctattatgaatactgctgtactaaacatatgagggcagatgacattttggtagaatgatttattttcctttgggtatatacccagtaatgggattgctgggtcaaatgtttgctctgctttaagttctttgagaaatatttgatattttttaatgcttttgtaaatggtagttgtatatacatattttataatatatattcatacatatttatacattatataaacacacacacatgtcttttgttgttgttaccatattacactagttaggaccttgtattaactatctattgctatataacaatgttaccataaacttagtgacttaacacacatttattatctcatagttcagtgggttaggagactagtcatagcttagttgagtttacaaaaagttttaaaaatgttttttcagagatagagcctcactatgttattcaggctggcctcaaacccctaggctcaagggatccttctttttcagcctcccaagtatctggaatatctggaactacaggcatgtgccaccatgcctggcttatttgagaattaaaaaatatatattattagctgacttttttgttgcagggtctcacaaattaaaattgtggccagggctgtgcgattttctgaggtttgactgggaaaggatctttattcaagctcattttgttgttggtagcattcatatcccttgcatgttgttggattgagggcctcaactttttgccggctgtttggccagaggtgatcctcagttttttgccatatagccctctcaataagccagctcacaacagagcagcttgctgcttcaaaaccaataagggtgtgagtttccttacaagatggaggtcgtaatcatatgtgaacacagaagtgacagcccatgacctttgtcatattctattagctaaaaggaaatcacaggtcccgtgcacactcaagggcaagaatactatgaggtgggactcatggaaactacctttgagtttgtcctctataggcctccagtacagtactgactaaaatggaaaagaacagtggttttcttgtctcattactgattgtagggggaatgttttcattatttcacctttaagtgtgatatttgctggaagatttttggtagacgttctttgtaagattaagaaagtttattttgctcttattttcctataagcgtatatatatatatatatacgcttataggaaatatatatatattttaaatcatgaatgggtgttgaattttatcatatactttctcatgcacctattgagatgagcatgtaatttttccctttttaaatgtgttaatgtggtaagttacatcagttgatctttaaatgttagatgacccttgcattcccagaatacatacaaattttgcgatgtattagcattattatatgtgctaatatatgctgggtttgctaatattttgctaataagttgagattttaatctctatgttcacaaaagtttagtatgtaagtttccattcttttgattcccctgtcaagttctcacttcatagttatgtcgactttatgaaatgaatgggggatgtttccttttttctatactctataaatatttgtgaaattttggtgttccctcttaaaatttggaaaaattcaccagtaaagcaatgtaggcctgggttttctatgtggggcaattttaaatgacatattatatttccttaataggtgtagaaatgttcagatattctgttttttcttgagtcagttttggtaagttgtgtttttgaagaaatttttcctattcatctaatttttcaaatttattagccttaatggtagggcctgtagtagtttactattttcaattcctaatattggttatttttgagttatcttttttaaaaataagtcttctggagatttatcattttttcagtattttcaaagtactgatagaattcttgatttttttcaaatgtacatgtatttttctagtttactgatttttattcttcattgggtttggtttactgtcttttaactagattaatgagatggaaccttacataactgatttcaatattttttcttctttaatatgtgactttagggccataatttttccctgaaaattgtttgagctccatccaacagattttatgtctaatatttattaatgttgaactaaaacttttataatttttcctatagtttcttatttgaaccttgtgttatttagaagttaattagttttcaagaagttgagagttttctatctcttgttagtaaaaaataaaatgccactgtggaaagatcatagtatatggttttagcttctttgacatttgttgagacttgttttatgattcagcacatggacaattttagtaaatgtgcacaaactaattttactattctgttactaggttcaatgtactatatatgtaaatttgactaagttcattaattgtgttgttagatctgtaaattcttactaatttgtttgtatttgttctatctgatattaagagaggaccgttaaaagctcccactatgattataaattttagaatttctctttttagtagtgatgacttatgttttgaatctaagttgttggatgtatacatttattttctgtatatgtatttattactttatcattataaaatatctctttctctgtagtaatatatcttgtcttgaaatatacattgatatttgcatagctagtccatctttactttgtgtttgcatggcatatatatttccattatattattgtcaatgtcttcatagtcatttttaagcatacaattttaaaaaattagtctgacaatattagtcaatttttcttttttgagacggagtctcactctgtcaccaggctggagtgcagtggcacaatctcagctcactgcaacctccacgccctgggttcaagtgatactcctgcctcggcctcccaagtagctgggcctacaggcacacaccaccatgcccagctaatttttgtcattttagtagaaatgtggtttcaccatgttggccatgatggtctcaatctcttgaccttgagatctgcctgcctcggcctcccagtgctgggattacaggcgtgagccaatgcacctggtgacaatattagtcttatacttggtgtacctaacatttaatataatttattgatatagctaggtttttatctgccatatttttatttcagtctttatgtttcttttttattttactttctttttacttaaactttttattatcctatttttctctatatgacattaatatgtattttttcacgctttttgagggattatctttaataactctttttgaggatttcaacatgaatccttcacttattttgatctaaaatagagcatttcttttaccacttctttaataatgacagcaacttgcactttacctctatttaccatccctgttgctctttggattattttttttgtattttattttcacatccgttttaaaccctataatacattgctaatatagtttagtatgttaatattgtttatattcatatatatttatcagcatatgtatttattctttctttttatcctcattccttactatgtctacttgcattctttttcttttgcctgaaaatttttctttattctttattttactgcagctttgttagaacaaattctctctgcttttattatttcactttttaaaatacttttttatttcataatagttgcagatttgtaggaagttgcaaaactagtacagaggttttatgttcaattcaccccatatgttaatgtcgtacatgcactcgtgtgtgtgtgtgtatacttgaatgtgcatagttatatgtaattttatcatgactacactcatgtaacaaccactataatcaagacacaaaatggttctatcaccacaaagattgttcttgtgctacccatttatagtcacttccattgtcatccctatctctcctatttctaacgcctggaattcactaatctgctctccatatttataattttataactcaagaatgttaaataagtggaatcatacaatgtgtaactttttgggattgtatttttacaaagcataatttcctggagattcattcaagttgtgtacatcaagagcttattttatttcttgagtagtattttacagtattagtgactacagtttatttaactattcacccattgaaggatatctagattgtttccattgtgaacttattacaagtaaagctgctatgatcatttgtgtgcaagtatgtttgtgaacataagttttcgtctctcggtgtaatttccaaaaagcgcaattgccgggttgtatgacatttgtttacatttataagaagatgcaaagctatttcctggagtggctgtgtcactttatatttctaccagaaatatgtaggagatctagtttctccatatactaactagaattttgtgacatctaggtcacgtctcggtgccttaggtctcaaagattttctctgattttttttctaaaagtttttatggttttacatttaaaattataactcattttgagctatttttttgtttaaggtatgagattgaggtcaaggttgttttttcttctactatggatgtccaattgctccagcagtatttgttgaagacgattttttcattaaataattgctcttgcacttttgtcgaaactccgtcggatgctgttttagtctttttgatgtaggcatttaatgctatgtactttcctcttagcagcacttttgctgtgtcccagaggttttgataagttgtgtcatgattattattcatttcaaagaatttttaaatttatttcttgatttcattgttaacctgttgtgggaaaatcaaatattggagagactgaaaaaggttcaggaaagtttattaaggtgatcaccggctcagccggacatatgtccagaattctgagccctgaacaaagggcttttcctacttttaaacttcttaaggtgggaactacgtgaggcgagaagtaagttacagaagcaagaaacaaaggcagcattacgacatttcttacatcttgagagaaacatgtcttgcaacctaaacttattggtattgtgaccctgcagccatgcaggaactcactgggcctctaataaactttgaggaatgtggagttgtggagtatagataaggttcactgtccacagagagaagacaggctgttagtattcctttttaacttgagtgtaaggggggtgtcacactttgcagcaactttaggaagattttaaaatttctattactactactattaggttatagttattttcattatttccttcttcattcctcccttttggtgctcgacacaaatgtagattagtaaagagcaccacagttagctatttcttcttgagtgggtacatacccatcttgtgataccagttggtacttttgcaaagccaccaagaacagacataccccacgacccgaataatggctctgctgctgagtttttcttgtcctagatttttacaggtggttttaatattatttagtttactgagatgtgcagcttggcaggcatcaaaatatatggagacaggccttttatgcgagtacgggaatacttctgttttgtttacaagtttactgaccctggtttctgtggggttggtatataatggcattaggggttcgccaattcggactttaaacccgaagtcatagggcaagaactctgggtcataacatagttggggctgctcatttccaggattgcagaccgagtaactagtctagttatagacacaagttcctgtatgagtccctgtacagttgtagtaggtctggtataacagagttttagtcacaccttttctggaccaggcttctatcatacagtgatgacagacatcctggtccccaattataaccataggtgaaagtgtcggtggctttagtattactaatatgattaagcttatactatgcacaggcacccttctaggcaacaagcttggcagcatttgcaaagataacatgacagcaaaataatcagtacaagtaaacatataactatgtttgtacatttaacccgcatttagttatctatcattgacttccttaggctttggccatgcatagactagtcagattctgtttgtgtgactagagcagggctcagtgtttcctcaagcttcagttgtgcatggaccgaccagcctctggtgcagtcagagcagggaagttgtccgtgtcagcagtgacttggtttcactgcaggatcagccatgttgggtggtcttggttttgttgactggtccactggtcctggatggcagctgctgctggtttcagccagctatgatgaacccaaggtatgatacctgcaactttaacagctgtgcggatagacaagatcacaatatggggaccatcccataaaggccctaaagtggttgggttctattgtttgacccagagtctccaggttggaagggatgtactgcatctgtgaggctaacaggtattctttctcttactcacccttatatttcctgtatggcctcacctaaggcttgcatttgccttcttaaggttaattccccagattctcttaaatcaccttttatctgagttatcatcaggggtgcttggccaaacactatctcatagggtgaatacccagttactttagtaggggtttacctggctcagagaaggaccatgggcagcacctgatcccaccttagatgagtttcttggcaaaactttaacagctgtttgagtgtctggttcattcttttaacttttccagaactttgtgggcgataagctgtatgcagtttccatttgatttttaacatctgcattagctgttgtactatttctgtcacaaatgctgggccattgtctgttcctaaagttaaaggcagttcaaatttaggaataatgtcctttagtaagattctggttacttcctgagctttctctttcctggtaggaaatgccttcacccaccctgagaaagtgcagacaaacactagcatgtaccagtagcctctggcttgaggcagctccataaagtccacaagcaggttttcacagggtataactccagtttcttgaatccctgggggccgtgttggccgctgccatggattgttttgggcacaagccaagcattgctcacaaacggcttgagtgatggcagttgggagcagcacatagaaatgtcgtcctataagagtttctaatgcagtttttcccatatgctttccttgatgaaactgctttatgaaccggggggctattgcttctgcgatggcaagcctcccatctgagaacttccactaacatcctttctggtaacttccactctcctgctcaaacgaagccttttcattagaagagtagttagggagttctgttaggggaagctccagtaagggcatggtaagggtttccttttccttcttagttacctctgtcattacagctcttttggcttctctgtctgcctttctgtttcctctagccttgtcacctcctcctgtttgttgttctttgcaatggatgactgctacttcttttggagcccatacggcttctaagagcttctctatttcctttttatttttgatttcctttccttcagtagttaataatcctctttccttatatttggctctgtgggcatgcaaagtggcaaaagcatgccttgagtcagtatagatgtttactgactttcctttggctaagagcaatgctctagtgagagctattagctcagctctttgggccaaagttccgactggcagagggcgggcttcggctactgaattcagtgttaccactgcacatccagcccgtctgacaccttcagatatgaagctgcttccatcagtaaagtatttaacatctgggtctcttaagggctagtccgttaagtttttttggcttgataaaacctcatccactgtttccacacaacagtgataccctgggccacacaatggggctttccgtgctccacccattctgttggcagcagtgtggctggatttagagtgttcacagtctccagggttatgtaggggttttcacacaaaagcccttgatatcttaacatcttagggttagatagccagtgatgccccctctgctccatcagggtgacacgaccatgtggggcacccgaattattaacctttgtccaaatgtgagcttgttagcatcttccactaacagggcagtggctgccaatgccttgaaacagggtggccatcccatagccaccaggtctagacacttggagaaatatgccgtgggccagtaccatgaccctagtgtttgtaccaagattcctgtagctattccttttctttcatggacatacaggtaaaaaggctttgtcatgtctggcagtcctaatgctggggcctggatcaaagccttcttgatgtctttgaaggccatgtcctgctctttttcccacaggagggattcttcccccctgcccccgccccagctttggtagccttatacaatggttttgccaaaagcgagtaatttggaatccaaatgtgacagaaaccatctgcccctaaaagctcctgcacttgtcgcctagtgtcaggtagaggaatgccacacatgttctcttttcactcatgtccaagctcatgctgcccctgagagatgttaaagccaagatatcttgccctttggccacagatttgtgcctttttccttagacaccttatagccagcctcccacagaacacgaaggaggctttctgtgccttgaaagcactcttcttttgtgggtgcagccaacaatacatcatccatgtactgcaacaggacacaggggtcacttggtggcacaaaagccttcaggtctgtctagtgcttcctcaaaaatgattggggggtttttgaatccttgggggagcctggtccaagtatactgtgatgagccccactcaaagacaaagatgccctggctttcaggagctcgttggatgcagaagaatgcatcctttatgtctaagcatgtaaaccaagcagcatccacaggaattcacccaagcattgtatatgggttgggcacaatggcatataatgtagctgcaactttatttatggcccgcaaatcctttactggctggtaatctctggagggctttaacaccggtaccaatggagtgttccaagacaaggcacatctttgcattatcccaaatttaaggagccagtctatatgctttgtaatcccatgggtggcttctgctgggatgggatactgacggattcacactgggtaagtgccccgcagcagttccaccactacatgtgcctgatttatggctagcctgggggactgtcttccacccagacccctggcagcttgagaaataatttcttatacattgcctcattttcccgctggcaaaatgcatctttataaattttgcatctctcatagagtctccattcctttgttgttgggacagtaggggtcattatcatgccttttctttgacctaggtttagagtcgtgcccccttacggtgtaaaggagatttgtgcttgcaatttctggagcaaggcttttcctaacaagggcaccagacaatttggcaaatataaaaattcatgttgaacctgctgtcctccaatcacacatcttgtagatttgaagtaaggcctctgttactcctgtagctccaattatattgacataatttttagacaatggcccaatcgcttgagttactcctgagtgctctgcaccagtattgaccataaagtccactttttggccctctacctccattgagaccataggctccttggggcctaatgaagtggaacccagtctgtctcagtcctcataataatcattgattcctgccactctgattaaatccatatctgacttctgaaccccttgactggtggcagggggttctggccagccgttttgtccttgattgttgcctctatccttttctctctctggacattcattcctccagtgtcccatctgcttgcatttcacacattgatctttctcaatcctaggtcagcccccttgttctggcttagcttactggttttgcctagctagtcctctaccatgactgtgaccatgaccacgtcctctcacaaaaccggtttctcttccaactaaggctgctgccagcaagtctgccttttccttggctctgcatctagcttctctcttggcctcctcatcttgatttacaaacatcttagtagccacctgtataagcttggtaatatgccttcaaaaccttctaacttctgaagctttagctttatgtcttcttgcacctggcttacaaatgccgcattaaccatacactgattacctgcagcctctgtgtcaaatggcgtgtaaagccagtaagacttgcagagtctctcataaaattcactgggactttcatttggctctggtggacctctgagacctttctgatattggcctttttccctgcaggctttattccatttaggagtgcctcttgatactgctccaaactttgtagcccttgagcctggttagggtcccagtttgggtcagcgtctattgggagtgcttattgtgcatactgcctgatatctcctgtgcctgcaggtgcattgttctccagcctctagagagcagcttgtataactctacagtgctcttctgtattaaataatgacagaagaagttgtttgcaatcagcccaggtaggattgtgagttaggaaaatggactgcattagatctataagagcctgaggcttctctgtataggagggagtatgttgtctccaatttaagagatcagtagtagagaagggctgataaacgaagagctgttctgccccttggacttcattctgtgcattcaaataaatttgtttctgtgtttctcggaggggcacctgcattgcttgggcatggcccgacctaaggcagccgacctcatccccttggagttcctcccttggcttttcaggcaagggctctggctcctctctgcatggtgttgctttcttctgagtctgagcctctgtaggcagctggggcagcctcctgtctaagccttgtcagggatggataaattggtgcataggggggtggactttctaactcttcaggtggggcctgtaagatggtttttttctgctttttctatgactccttttctttttctgatgccttgcagtctctttctgtggttcctggttttgtccaggccattagagtcttacagtaggtcttaaagtaggctgcagtgccctgcagccactcagggcaggtctgaattacacttagccaggagtcgatatgtggaaactgatccaggtgcccaggctgttctccaagcctggtgaccacccaaaacactcggccaattatctccctgtctattttccccttggctggccaccctaccttaagagatggccagtctatctcacaaagggttctcagtttctgtggagttaggttaacatcataatcaccattaaaaccttttttaaagtttttcagcatgcactccagtggagtaggctttgatgcttttcctcccatttcctccctcatggcatgctttcactctcagtttcacttttggatccaccagactgggtcctattacaggaggttttgatactacttagcccggagagtgccttaattcctgtcacagctagctgcagctgtggaactggttctatggactgtatgcagtgtcctaggtctggtttttcccatactctccttggagcacacagtccatgataagaggtctgtgcctcccagcgtcacgctctatgttggtctctcctgagaccatctctttcacacactttcacacacttcctctgtccctgaaacagttttcctttctgaccaattcacgagccccacctgcatctggtgtcagttagggtgtgagtttcatccgaatcagcaccctgtcaaaacagaaaatcttctgtctccactcccggatgggtccccagaaatgttacggggcaatcaaagactggagatgtgtccagaattggtgggttcttggtctcactgacttcaagaatgaagccgcggaccttcatggtgagtgttaacagttcttaaaggcggagtgttcggagtttgttccttctgatgtttggatgtgttcggagtttcttccttctggtggattcgtggtctcgctggctaggagtgaagctgcagaccttcacggtgagtgttacagctcataaaggcagtgtggacccaaagagtgagcagcagcaagattattgcaaagagccaaagaacaaagcttccacagtgtggaaggggacctgagcgggttgccactgctggcttgggcagcctgcttttattctcttaactggccccacccacatcctgctgattggtccattttacagagagccgagtggtctgttttgaccgggtgctgattggtgcgtttacaatccctgagctagacacaaaggttctccacgtccccactagattagctagatacagagtgtcaacacaaaggttctccaagtccccatcagagtagctagatagagtgtcgattggtgcattcacaaaccctgagctagacacagggtgctgattggtgtgtttacaaaccttgagctagatacagagtgctgatttgtgtatgtacaatcccttagctagacataaagattctccaagtccccaccagaatagctagatacagagtgtcgattggtacattcacaaaccctgagctagacacagggtgctgattggtgtgttcacaaaccttgagctagatacagagtgccaattggtgtatttacaatcccttagctagacacaaaggttctccaagtccccaccagaggagctagatacagagcatcaattggtgcattcacaaaccctgaactagacacagggtgcagattggtgtgtttacaaaccttgagctagatacagagtgctgattggtgtatttacaatcccctagccagacataaaggttctccaagtccacaccagagtagctagatacagagtgtcgattgatgcattcacaaaccctgagctagacacagggtgctgattggtgtgtttacaaaccttgagctagatacagagtgccaattggtgtgtttacaatcccttagctagacataaaggttctccaagttcccaccaggctgaggagccccgctgtcgtcacccagtggatcctgcaccagggccgcaggtggagctgcctgccagtcccgtgccatgcgcccgcactcctcagcccttgggtggtcgatgggactgggcaccatggagcagggggtggtgctctttggggaggcttgggccacacaggagcccacggagtgggggaggctcaggcatggccagctgcaggttctgagccctgccccgctgcaggttctgagccctgccccacagggaggcagctaaggcctggggagaaatcaagtgcaatgccagtgggccagcactgctgggggacccagtacaccctccgcagccgctggcccaggtgctaagcccttcattgcctgggtccggcagggctggccggctgctctgagtgcggggcccgccaagcccatgcccacccagaactccagctggcccgcaattgccacgcgcagccccagttcccacttatgcctctccctccacacctacctgcaagctgagggagacagctccggccttgaccagcccagaaaggggctcccacagtgcagcggtgggctgaagtgctcctcaagtgccaccaaagtgggagcccaggcagaggaggcgcccagagcgagtgagggctgcaagggctgccagcacgctgtcaccactcagagagaccaaaaaaggtggaggaaagtttattaaggtgctcaccggctcagccggacatatgtccagaaagtctgagccctgaagaaagggcttttcctacttttaaacatcttaaggtgggaactatgtgaggcaggaagtgagttacagatgcaagaaacaaaggcagcattacaacatttcttacatcttgagagaaacatgtcttgcaacctaaacttattggtcttgtgacactgcagccatgcaggaactcactgggcctgtaataaactttcaggaatgtggagttgtggagtatagataaggttcactgtccacagcgagaagacaggctgttaatattcctttttaacttgagtttaagggagggtcacaatttgcagcaactttaagaggattttaaaatttctattactgctactattaagttatagttgattttattaattccttcttcaaacccaaaaataattcaagagcgtattatttaatttccatgatttgtatagttttgaaggttccttttggagttgatttccagttttattgcattgtggtctgagaagatacttgatatgattttgattttcttagattaattgaggcttattttgtggcctgtcatggtctatcttggagaatgttccccacgctgatgagaagaatgtattatgcagttgttgggaagaatgttctgttaatatctgttaagcccatttgttctagggtatagtttaagtctattgtttctttgttgactctctgtcttgatgatctgtctagtgctgtcagtggagtattgaagtgccccactattattgtgttgctgtctattttatttcttaggtctagtactaattgtttaatatatttgggagctccagtgttaggtggatataaatttagaattgtaatatcttccttttagactaatccttttatcattatataatgtccttctttgtcttttttttaactgttattgttttaaagtctgttttgtctgatataagaatagctagttctgctcatttttggtttccattggcatggaacatgtttccagctctttaccttaagtttatgtgagtccttatctgttagatgagtctcttgaagacaacagatattgggttggtggtgttttattcattctgccattctgtatcttttaagtggagtttttaggccatttacattcaatattagtattgagatgtgaggtattgttctattcatcatgttagttgcctaaatactttgtttttttttaaattgtgttattgttttataggccctgtgagatttatgctttaaggggtttctattttggtgaatattgaggttttgtttcaagatttagaactttagaatttcttgtagtgctggtgtggtagtggcaaattctctcagcatttgtatgtctgaaaaagactttatctctccttcattcatgaagcttaattttgctggataccaaattcctggctgacaattattttgtttaaggaggtggaagatgggaccacaatcccttctggcttgaatcccttctggcttgtaaggtttctgctgacaaatctgctgttaaccttataggtttttctttataggttatctgatgcttttgtctcacagctcttaagattcttttctccatcttgacttcagtagtaattgttgtagtcacattgtttagcctgatgattgtgtgccttgctgataatttttttgtgatgaatttcccataagttatttgagcttcttgtatttggatgtctagatccctatcaaggccagcaaagttttcctcaataattccttcagatatgtttcccaaaatttagatttttcttcttcctcaggacaccagttaattttaggtttggctgtttaacataatctcatatttcttggagactttatttttttaattctttttttttcattttctgattgggttaatttgaatgccttgtctctgacctctgaaattctttcttctacttgttctagtctattgttgaaactctccagtgcattttatatttccctaagtgtgtattttatttccagaagttgtagttctttttctttatgctatctctctggaaaattttttatccatatcctgtatttttaaaaaatttctttgtgttgttttttaccttcctctggtatttccttgggtaaactatttcttcaaattgttcttgaatttagttttgattggattgtggtgttttttaaatttctttctgctcttaaggatcaaactttaatgtttgtagtttattttagctgaatttggttcttggtgcttttacgggtgaagactctgtatgagttacttagttatagtctttgtctgctggttttcccagatgctggttgtagtagttatatacttggtatatgggcaagtttactgtctcctagggggttagaatggcagggatctcttgaagcttatcttgttctctcatagtgtatactttttttacttatttaatttttccctagtattttatttactgaattggtgattcaaccttcaggccaataggggtggtattcctggctaggcactggttgtagctaaggcaggttgaggagacatactaccaatggtgggcagaggcccagtatttattaagttggctgggggagctctcaattaggtgtggagaggctttatcagggcaaagagtgggagctacctcagctcccctgccagactagcaggaaagctatcagcctcacagccttactcttgtccaagtgttctggctgttcaaatcagacaggctgtatgggtctatttcaagattctttatttttttctatttttatgtgtctgtccctctgccaataccacacttttaaaattattgtaaccatacagtaagctttaaaattggatatactgattcttccaactttattctttttcaaaattgtcttagttactctagttcctatggctttctacctaaattttagaataagtttttttacttttcaaaaaaaaatcttgcgataatttgataggaattacattaaatctgtatattactttggggagaatttatatcattgcttatgttgagtcttccaattcatgaacatagtatgtctctacatttacttagatcttctttgatttctttcatcatttttttttggcatacaaatcatgtacatgtcatgttagatctatacctatgtatttttttgattgtgagtggtatttttaaattttgtttggcacatgttcattgctgatatatagaaatacaattaatttttgttgactttgtgtcctgcaactttgctgaactcactagtaagtttcaggcagaggcagctttatctgcttgggacccattccattggaccaaggtctgtactaataagggccaatgcttggttaaatactctgctctgaccatcttgaaattcttggtaattttatctctgaatccatgttttttaaatgaagtttcataggagaatggagtacatgtgtaagcaggagggacatgacagtgtgtgtgtatatatacatttgtaatcctgtttttgaggtttattgtaattgggttttgaattttgtcaaatactatttctgcatcaactgatgatttttctgtttcagcttgttatttagtgaacaacattgattgatttttgaatattgagctagccataaatttctggaataagcctctcttgtttttaaatgtatggctgaattctatttagtaatcttttgttaagaacttttacatttgggctgggcgtggtggctcatgcctgtaatcccagcactttgggaggctgaggcaggcagattacgaggtcaagagatcaagacatcctggccaacatggtgaaaccccgtgtctactaaaaagaaatacaaaaattagctgggtgtggtggcgtgctctgtagtcccagctactcaggaggccgaggcaggagaattgcttgaacctgggaggtggaggttgcagtgagccaagatttcgccactgcactccagcctggcaacagagcaagactctgtctcaaaaaaacaaccaaaaaaacaaaaaaaatcacttttacatttctattcatcagggatattagtctgtagttttctttattttactgaatttatctggtttgttctcaggtagtctttatttataaatttgaacgttttccctcttgtattttctggaagagattgttaaaattggtatcaattgttgggtgcagtggctcacgcctgtaattccaatactttgggaggctgaggtgggcagatcacttgaggtcacaagttcaagaccagcctggccaacatggtgaaaccccatctctactaaaaatacaaaaaattagccagacgtgatggcaggcgtctgttatcccagttactcgggaggctgaggcaggagaattgcttgaacctgggaggcagatgttgcagtgagccaagattgcaccactgcattctagcctgggcaacagagtgacactctgtctcaagaaaaaaaaaaaatggtgtcaattattctttaagtgtttggtaaaattctctagccaaatcatgagtgtgtggaaatttcttttttggaaatttggaaattataaattcaattttcttagtagctacagggatattcagcctatttcagttggggttattgtgctagtttacagtttctgaggaattttttcatttcatctaagttgttaaatgtatttgtgtggagttgttatcattttcaaagctgcatggtctgtagcaatactcattgtttcattcctgatgtttgcactgttttttctttttttctcctaaaaaaatctcctactagagatttttctattttatgtaacttttcaaggaaactgctttgtcattcattgattatctctattctttttgttttcaattttgttgatttttgctctttactatttttttttactctgctcagtttgtgtttattttggttttctttttctaggttgttgagacaggaggtaagttactggtttgagacttttcttattattattgtaattttattttattttaagttctgtgatacatgtgtaagacatggaagtttgttacataggtaaacttgtgccatgttggcttgctgcacctatcaacctatcacctaggtattgagccctgcatgcattagctatttatcctgatgctctccctccccgcctaccctcaacaggccccagtgtgtgttgttcccctccttcttccacgtgttttcattgttcagctcccacttataagtgagaacatgtggtgtttggttttctgttcctgtgatacatggctgatgataatggcttcgagctccatccatgtccctgcaaaggacgtgatctcattcctttttatggttgcatagtattccatggtgtatatgtaacatattttctttattcagtctatcattgatgggcatttgggttgattccatgtctttactcttatgaatagtgctgcaataaacatattcatacatgtatctttataataaaatgatttacattcctttggatatatacccagtaatgagattgctgggtcaaatggtatttctggtcctagatctttgaggaatcaccatactgtcttccactctttaaaatggttgaactaatttacattcccaccagcagagtaaaagcattcctatttctccacagtctcgccagcatctgttgtttcttgactttttaatggtcatcattctgactggcatgagatagtatctcattctaattttaatttgcatttctctaatgatcaatgatgttgactttttttttcatgtgtttgtcaaccgcatgtatgtctttttttgagaagtgtctattcatgttctttgcccactgtttgatggggttgatggtttttttcttggaaatttgtttacattccttatagattctggatattagacctttgtcagatggataaattgcaaaaattttctcccattctgtaggttttctgttcatgctgatgatagtttcttttgctgtgcagaagctctttagtttaattacatcccgtttgccaatttttgtttttgttgcagttgcagttgacgtttttgtcatgaaatctttgcctgggcctatgtcctgagtggtattgcctggattttctctaggattttaatagtttttggttttacaaatagaaagagaggaagtcaacctgtctctgtttgaagataacatgatcctatatctagaaaaccctatagcctcagcctaaagcttcttaaactgataagcaacttcagcaaagtctcaggagaaggttacaaaataaatgtgcaaaaatcacagggattcatatacaccaacaatagacaaacagagagccaaatcatgaatgaactcccattcacaattgctacaaagagaataaaatatctaggaatatagctaacaagggaagtcaaggagcacttcaagaactacaaaccactgctcaaggaaatcagagaggacacaaacaaatgtaaaaacattccatgcttgtggataggaaggatcaatattatgaaaatggccatattgcctaaagcaatttatagattcaatgctattcccattaaactattattgacattcttcacataattagaaacaaattctttaaaaatcatatagaaccaaaaaagggcccacatagccaagacaatcctaagcaaaaagaacaaagctggaggcaccacactgacttcaaactataccacaaggctacagtaaccaaaacaacatggtactggtaccaaaacagacacatagaccaatagaacagaataaagatctcagaaataagaccacacatctacatctgatcttagacaaacctaacaaaagcaatggggaaataattccctatttaataaatgttgctgggaaaactggctagacacatacagaaaattaaaactggaccccttccttataccttatagaaaaattaacccaagatggattaaagacttttttctttttaaatgtatttagcactacacatttccctcttggcagtcttttagctatatctgacaaatgtttatatttccaattttattcagttcattatatttttaaaaattttattgtgacttcttagacacaaagattacaataaggcatgatattatcatgttttggtcaatgatggactacatataaaagaggataatgaagctgaaaaatttctattgcctcatgcgttcatagccattgtaacattatagcacaatgcattgcccttttctatatttaaatatttagatacacaaatgtttaccattatgtaacaattgcctacagtattcactacagtaacatacggtacaggtttgtagcctaggagcaataggctatacaagttgtgcattccttatccaaaatgtttgagaccagaagtgttttggattttagatttttctgaatattggaatgttgagattattcctaccaggtgagcatcccaaacctgaaaattcaaaatcctaaatgttccaatgagcatttcctttgagtgtcatgttaatgcttaaaaagttttggatttttaagcactctggattttgggttttgggatactcaacctgtaccatgtaatctatctgtataaaaaggtgtactatctaggttagtgtaagtacttacactctatataagagcgatgtttgcactatgataaaatcacctaatgatgcatttctcagaacttatgcccattgttaagtgatgcatgactgtgtttggaagtgtttttcttatttccaagtacttggagattttattgtatctttcttttactgatttctagtttgattccattgtactcagagaaaatattttatataacttgagttattttaaaattgttgaggtttgtttttcaaccccaggatgtagctcatctttgtgtatgttctgtgtatgctagaaaaataatgtctattttgctgttgttgacagattattctgtaaaagttgattagattctatagggttatgattttcttgcattctatatccttactgattttctctttagttgttctaataattgctgagagagaggtattgaagtctcctacaagaatcatggatttctttttcctcctttcagttctgtcatgttttatttaatgtattttgcagcctgtttggtgcattcacatttagggttgctatatcttcttggtagagtgaccattttattattatttggtgtccctctctatctcataatttcctttactgtgaaattttcattatctaacataatatagtgtcttctttctagtgattcatgtttgcacgatatatctttgtctattcttatactttaaagttagctatgttaatatattcaaagtgtatttcttatagacaagcgtatagttgggtcatggtttttaattcattctgtcagtctatatattttaattaatgtttacattagatataattattgatatattagggcttaggttctccattttattttttgttttttggttgttctatttgttattgctctgcttttttccccttgcctttctgtggtttaattgaacactttttagaattccattttgacttattattagttaattttagtgtatttctttgtatcactttttaaagaggttgctataggtattttattatatacaaacaacttactggaatctactgctgctacaaattaccagtttgaatgaaatgcagagacttttcctttctttacttccctttacttctctcatttataataaattttattgtttttccctatatatattatgaaccacatcagactatgttatttcagctttaaccatcaaatataatttagaagctccggcaacaaaagccaaaattgacaaatgggatctaattaaactaaagagcttctgcacagcaaaagaaactaccatcagagtgaacaggcaaactacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaaatcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacctatgtaactaacctgcacaatgtgcacatgtaccctaaaacttagagtataataaaaaaaaaaaaaaaaaaaaaaaaaagaagctccaagaggagaaggaaaaaaatatataaatacacttagtatatacatagtacatttattatatttttactgtctcttttttcccatacttgatttttaaaagtttcttctattagatatttttctgtttagaaaactccataaagcaattttttattggtcttttaaagaaaaaatttttagttttcctttacctgataatgtcataatttcttcatacctgagggataattttgcttaatatagaattctaggttggtagtttttctttgtttttcattttatacacctgaatagcattctacttcctcctggtctctgtggtttctgatgagaaatctactgtcattggaaattttctcccatagttaaggtgttgttttttctcttgctgctttaaagattttttttttcttttcttccttgtttttatctcagataattggctgtgatttgtctgactgtttatttctctgggtttattccgtttagttttgctcagcttcttgcattttttagccattgtttattcaactgctttttcagtctcatcctcttttcctttcattccgttatcctgataatatgattgatagatctattggttttgtcccataggtttctgaagctctggtatttttttacttatattatttgttttttcagattggtgaataaatattattacatcctctaggccactggctcttatgtctgtccttgttattctggtgtttagcttatccacagaattttaaattttcttcattatattttaagtagtaaaatttgtaattggttctttttacttactttttctttgcttatactttatatttttatttgtttcatatgtgtctgtacttgttgaaaccttttcatgattacttcttttaaatatttgttagcaaattctaatatctatgtcatcttgctgctagtaactattgccttttttcattcaaattgaggtttttctatttcctattataataagtgatttttaaattaaaacctggacattccaggcattgttatgaggtttcagtttttatttaaaccccttttttaggtggttgtatttgacattggtctggcaggggaaggtcagatgttgtgttattaatgataggtgggaattgaagttcaggtgctccatttaaactcactgacatcttagatagggagagacaccttgtagctgctgggtggggtgggatttttggctctccactatgcctcctcttttacccctcttacaaggaagaataagagtacctccttactgctcctcaaatggattctactaacccaattctcattcagaaattgaaatattttatccatatagatgtagaaaatattatttctgttgttcaggagcatgaaaatagacttccatacctctgccagaaatcatggcttttgctcctgtggaacagaaagggaatgagtttagttaattatgattaaaatattttaaagtctctaaaggaggtatatacagatctgaattgtctaaaaatttttgtacctaagagtaatcatttttggtcatttatttgtactaataacattgttgatcatgtacagtttagctttacttcatggggacacaattagtgcctcagatggtatgaattttttttattttttatttttttattattatactttaagttttagggtacatgtgcacaacgtgcaggttagttacatatgtatacatgtgacatgctggtgtgctgcacccactaacgtgtcatctagcattaggtatatctcccagtgctatccctcccccctccccccaccccacaacagtccccagaatgtgatgttccccttcctgtgtccatgtgttctcattgttcaattcccacctatgagtgagaatatgcggtgtgtggttttttgttcttgtgatagtttactgagaatgatgctttccaatttcatccatgtccctacaaaggacatgaactcatcattttttatggctgcatagtattccatggtgtatatgtgccacattttcttaatccagtctatcattgatggacatttggattggttccaagtccttgctattgtgaatagtgccacaataagcatacatgtgcatgtgtctttatagcagcatgatttatagtcctttgggtatatacccagtaatgggatggctgggtcaaatggtatttctagttttagaaccctgaggaatcgccacactgacttccacaatggttgaactagtttacagtcccaccaacagtgtaaaagtgttcctatttctccacatcctctccagcacctgttgttccctgactttttaatgattgccattctaactggtgtgagatgatatctcattgcagttttgatttgcatttctctgatggccagtgatggtgagcattttttcatgtgttttttggctgcataaatgtcttcttttgagaagtgtatgttcatgtccttcgcccactttttgatggggttgtttttttcttgtaaatttgtttgagttcatcatagattctggatattagccctttgtcagatgagtaggttgcgaaaattttctcccatgttgtaggttgcctgttcactctgatggtagtttcctttgctgtgcagaagctctttagtttaattagatcccatttgtcaattttgtcttttattgccattgcttttggtgttttagacatgaagtccttgcccatgcctatgtcctgaatggtaatgcctaggttttcttctaggatctttatggttttaggtctaacatttaagtctttaattcatcttgaattaatttttgtataaggtgtaaggaagggatccagtttcagctttctacatatggctagcctgttttcccagcaccgtttattaaatagggaatactttccccattgcttgtttttctcgggtttgtcaaagatcagatagttgtagatatgcagcgttatttctgagggctctgttctattggtctatatctctgttttggtaccagtaccatgctgttttggttactgtagccttgtagtatagtttgaagtcaggtagcatgatgcctccagctttgttcttttggcttaggactgacttggcaatgcgggctctttcttggttccatatgaactttaaagtagtgttttccaattctgtgatgaaagtcattggtagcttgatggggatggcattgaatctataaattaccttgggcagtatggccattttcacgatattgattcttcctacccatgagcatggaatgttcttccatttgtttgtatcctctttaagttcattgagcagtggtttgtagttctccttgaagaggtccttcacgtcccttgtaagttggattcctaggtattttattctctttgaagcaattgggaatgggagttcattcatgatttggctctctgtttgtctgttattggtgtataagaatgcttgtgatttttgtacattgattttgcatcctgagactttgctgaagttgcttatcagcttaaggagattttgggctgagacagtggggttttctagatacacaatcatgtcatctgcaaacagggacaatttgactttctcttttcctaattgaataccctttatttccttctcctgtctaattgccctggccagaacttccaacaccatgttgaataggagtggtgagagagggcatccctgtcttgtgccagttttcaaagggaatgcttccagtatttgcccattcagtatgatattggctgtgggtttgtcatagatagctgttattgttttgagatatgtcccatcaatacctaatttattgagagtttttagcatgaagagttgttgaattttgtcaaaggccttttctgcagctattgagataatcatgtggtttttgcctttggttctgtttatatgctggattacatttattgatttgcatatatcgaaccagccttgcatcccagggatgaagcccatttgatcatggtggagaagctttttaatgtgctgctggattcggtttgccagtattttattgaggatttttgcatcaatgttcatcaaggacattggtctaaaattctcttttttggttttgtctctgcccggctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagctcctgttattggtctattcagagattcaacttcttcctggtttagtcttgggagggtatatgtgtcgaggaatttatccatttcttctagattttctagtttatttgcgtagagctgtttgtagtattcgctgatggtagtttatatttctgtgggatcagtggtgatatcccctttatcattttttcttgcttctatttgattcttctctctttttttctttattagtcttgctagccgtctatcaattttgttgatcctttcaaaaaaccagctcctggattcattaatttttgaagggttttttgtgtctctatttccttaagttctgttctgattttagttatttcttgccttctgctagcttttgaatgtgtttgctctttcttttctagttcttttaattgtgatgttagggtgtcaattttggatctttcctgctttctcttgtgggcatttagtgctatacatttccctctacacactgctttaaatgtgtcccggagattctggtacgttgtgtctttgttctcgttggtttcaaagaacatctttatttctgccttcattttgttatgtgcccagtagtcattcaggagcaggttgttcaattttcatgtagttgagcggttttgagtgagtgtcttaatcctgagttctagtttgattgcactgtggtctgagagacagtttgttataatttctgttcttttacatttgctgaggagagctttacttccaactatgtggtcaattttggaataggtgtgatgtggtgctgaaaaaaatgtatattctgttgatttggggtggagagttctgtagatgtctattaggtccgcttggtgcagagctgagtccaattcctgggtatccttgtcgactttctgtctcgttgatctgtctaatgttgacagtggggtgttaaagtctcccattattattgtgtgggagtctaagtctctttataggtcactcaggacttgctttatgagtctgggtgctcctgtattgggtgcatatatatttaggatagttagctcttcttgttgaattagtccctttaccattatgtaatggccttctttgtcccttttgatctttgttggtttaaagtctgttttatcagagactaggattgcaacccctgcctttttttgttttccatttgcttggtagatcttcctccatccttttattttgagcctatgtgtgtctctgcacgtgagatggttttcctgaatacaacacactgatgggtcttgactccttatccaatttgccagtctgtgtcttttaattggagcatgtagtccatttacattgaaagttaatattgttatgtgtgaatttgaacctttcattatgatgttaggtggttattttgctcgttagttgatgcagtttcttcctagtctcgatggtctttacattttggcatgattttgcagcggctggtactggttgttcctctccatgtttagtgcttccttcaggagctcttttagggcaggcctggtggtgacaaaatctctcagcatttgcttgtctgtaaagcatatctgtaaagcattgtctgtaaagcctcacttatgaagcttagtttggctggatatgaaattctgggttgaaaattcttttctttaagaatgttgaatattggcccccagtgtcttctggcttgtagagtttctgccgagagatccgctgttagtctgacgagcttccctttgtgggtaacccgacctctctctctggctgccttaacattttttccttcatttcaactttggtgaatctgacacttatgtgtcttggagttgctcttctcgaggagtatctttgtggcattctctgtatttcctgaatttgaatgttggcctgtccttctaggttggggaagttctcttggataataacctgcagagtgttttccaacgtggttccatgctccccgtcactttcagttacaccaatcagatgtggatttgatctttaaacatagtcccatatttcttggaggctttgttcatttctttttactcttttttctctaaccttctcttctcgcttcatttcattcatttggtcttcaatcactgataacctttcttccagctgatcgaatcggctactgaagcttgtgcattcatcatatagttctcatgccatggtttttagctccatcaggtcatttaaggacttctgtacattggttattctagttagccattcgtctattcttttttcaaggtttttaacttctttgcgatgggttcgaacttcctcctttagctcggagaagtttgatcgtctgaagccttcttctctcaactcgtcaaagtcattctccatccagctttgttctgttgctggtgaggaactgtgttcctttggagggggagaggcactgtgatttttagaatatttagcttttcccctctgttttttccccatctttgtgattttatctacctttggtcttcaatgatggtgacgtacagatggggttttggtgtggttgtcctttctttttgttagtgtctgtcaccgcttctctgggctaggaagtgcaattccctgaccccttgtgcttcctgggtgaggcgatgcctcaccttgcttcggctcttgcttggtgggctgtacccactatcctgccccccactgtctgacaatccccagtgagatgaacccggtacctcagttggaagtgcagaaatcacccatcttctgcatcactcatgctgggagttgtggactggagctgttcatatttggctatcttggaaccacctcctcctctaacctttcttcacgcttcttagcttgcttgcattgggttagaatatgctcctttagcctggaggagtttgttgttacccactttctgaagcctacttttgtcagttaatcaaactcattctccatctagttttattctgttgctggcgagacactgtgattctttcgtggagaagaggtgttctggtttttggaattttcagccactttgcactggtttctccccatcttcatggatttatctacttttggtccttgattttggttaccttctgatggggtctttgagtggatgtgctattcgtttctgtttgttagtttttcttccaacagtcaggcccctctgctgcaggttggctggagtttgctggaggtccactacagacgctatttgcctgggtataaccaggggcggctgcataacagcgaaagaaaaaaaaaagcctgttttttcctctggaatctttgtcccagaggggaacctaccagttgccagccagagctctcctgtatgaggtttctgtcagcccctactgggaggtgtctcccattcaggaggtatggaggtcagggatccacttgagcaggcagtctgatggttagtatagctcaaacactctgctgggagtccactgctctcttcagagctgtcaggcagggatgtttaagtctgctgaagttgtgcccacagcagccccttccccgaggtgctctgtcccagggacatgggggttttgtctatatgtcccttatgggggctgctgcctttttttcagagatgccctgcccggagaggagaaatgtggcagtctggccacagcagccttgctcagctctgcccagttcaaacttcctggctgctttgtttactctgtgagcttaaaactggctactcaagctgcaccagtggtggatgcccctccccacaccaagctcaattgtcccaggttgatctctgactgctgttgtgttggcagtgagaatttcaagccagtgggggtgggacccaccgagccagaccacttggctccctgacttcagcacccctttccaggggagtgaacggttctgtcttgctggcattccaggagccactggggtatggaaagaaaaacacctgcagctagttcagtgttttccctaatggccacccagttttgtgctcgaaacccagggccctggtggggtaggcaccatagggaacctcctggtctgcggggttgcaaagaccatgggacaaatgcagtatctgggctggagtgtgcacccttcctcaggctcagtccctcatggcttcccttggttaggggagaaaatttcccgacttcttgcacttcctgggtgaggcgatgccccaccctgcttcagatcaccctccgtgagctgcacccaccatccaaccattcccagtgagatgaaccgggtacctcagttggaaatgcagaaatcacccaccttctgtgtcgatctcgctgggaactgcagaccagagctgttcctattcggccattttgccagctatccccttgtttgccagtattttttaagcttgttgcatatcaaatggaactaattgaaatgtgatctaatacaatggatgccattactgaatatattatacttaagattacatttaattttgtaatcttggttatagaggggttatactgttggtttacgttgaacgtaaagccaagcaatactcccatttttttttctattttaaccattgttaaacagtttttcaatcatatactttagcagttgatgttttttaaatgaaaatgcagaattttctatgtatccctattagtataattttctgttcaacctacggtactgatatcaagaaatgtggaaagcacattatattatctaatatcttgatatgttttttagagttggtttgaaaattggtggagattgtttgatgactgccctttttcagtagaaggggatatgtattttggctcacagtactgcaggctgtacaggaagtgggatgtcagcatctgcttctggtgagcacctctgaaagcttacaatcatggtggaaggagaaggaggagcagagtatcatgtggttagacagggagcaagagagagaggcaggaggtgccaggttcttttaaacaactaggtctcatatgaacttacagggtaagaactccctcattatcgtgaagacagtaccatgccatggtggtgctgtcctcatgataatgagtgagttctgactctataagattagtcatcaaggcagagagatctgcctccatgacccaaacactatacccatttccaacatcagacatcacatttcaacatgagatttggaggggacacacactcaaaccgtattatgaggccagagaaatgaagtggctcagctgtggaatggaatgctaaagttcaagttttgtcgggaatacctttgtagggttggcctggcctgctccacttgcatctgcaaggatgatgggtcctcctgatgtggccaggttcaaaagaccactctggccattgttccctacaaggaatccagtttataattggcatgtctgtagggagcatccactttactcccttcaaaagcctccaaggaagttattgtgaatttttttttccagaaagaaaataattttctccatttcaggcacattatcatggtccccagcatcctcccacctcacagatcctgcaattctggtgcattctggactccaaataaccctgtatatatagagagagatagagattgcctctatctatatacattcgtaagcttccccaaaatgatcttggtatcaataaagggagaattcaggtacatttcaccatcagcctcacagcatggcagccattgatttgtcctgtggcttccttaccagggaaccaatctgcctttatgagaaaaagacaaagatataatagaaaggttggtgggtgactgtctgccaaattggtatcagggttcagtgaacttttatgatatgactatggagttcacccagaggagtgaactttactggacatgattcagagatacctctgcagatacatgatactggagaactgcaagcacctgggctcagtaagatttcagctctttatacacagcctgatctcttggttacaataaaaagagttgaagacagttcagagtggagttcttcaagaagctacaatagaggggaactctgtgattgtaagaattgtagagaaaacttcagtgaacacttatgcccaagaatgaatcaggaagaaattgaaaccctgaacagaccaatatcaatcaatatgacacacatgagagctcagaatagagggaacacttctgagtgtaactggtgtagaaaagacatccatactctgcagaagaaaacctctattggacaggagcttccttagtttaattagtttgcaaaagtcttcaccctgactccaagccttgctgtgcatctgcaagaaaaccctgcaaatttaaggaatgtggaaaagctttcaagtatttgcagtccttaaaaatgccccacttaaaaggcatagagtggcaaggtagatgaaaaaagcaagactcatctctctgctgtcttcaagagacccattgcacacctaacaggacccacaggctcaaaggaaagggttggagaaatatctgtcacacaaatcgaaaacaaaaaagtagttcctattctcatatcagataaaacagactttaaaccaacaaccgtataaaaggataaagaaggacattacataatgataaaggggttaatttgacatgaaaatttaactatcccaaatatatatgcacccaaattggagcacccagatttataaaacaagtacccctagacctataaaaagacttagacagctacacaataagagtgaggtctttaaaaccccattggcagcgttagacagatgcttgaggcagaaaacttaacaatgaaattctggattaaatttaacacttgacctaattgaaactaatatatgtctacataatactccacccatcaactataggatactcactcttgtcttctgcacacagaacatactccaaacttgaccacatcctggtccataaaacaagtctcaataaactcaaacaaactgaaatcatatcaaacatactctcagaaaacagtggaataaaaataatcaataccaagatcttttattaccacacaattacatgaaaatcttaaaaacttgctcccgattgacttttggtaaacaatgaaattaaggcagaaataaaagaaattatttgacataaatgaaaacagagacatgacttactaaaatctctgggatgcaacaaaagcaatgttaagaggaaagtttatagtactaaatgcctgtctcaaaaagtcataaagatctcaaattaatgatctaacatcaaatctagaggaagtggaaaaacgagaacaaactaatcctaaagctagcatcggaaaagaaagaactaaaatcagtgcagaactaaatgaaattaagaccccaaaatccacacaatatatcgacaaaaaaaaaaagttggttctttgaaagaataaatattggtagaacactagctagattaacaaagaaaaaaaagaggaaagatccaaataagcaatcagaagcaacaaaggtgacattataactgatcccacaaaaacataaaatatcctccaagactgctatgaacacctctatgcacacaaactacgttatctagaggaaacggataaatccctggaagcacagcctcccaagaatgaatcaggaagaaattgaaaccctgaacagaccaatatcaagttccaaaattaaatcagtagtgaaaaatctgccaaacaaaaaaaaagctccagacaagatggagtcacagtcaaattccaccagacatacaaagaaagctggttccagttcttctgatattattccaaaattcagggaagagggacctcctttattactcattttatgaagccagtatcacactgataccaaaacctggcaaagacacaatgaaaaaaggacaatacaggccaatatccccaatgaacgtagatgcaaaaatcctcagcagaatactaagaaaaagaatccaacaacacaacaaaaagttaattcaccatgatcaattaggcttcattcctgggatgcaaagttgattcaacatatgcaaatcaataaatcacaacataaaaagatttaaaaaccatatgatcatctcaatttacacagaaaatgctgttgataaaatctaacatctcttcataataagaaacatcaacaaactaggcaacgaaggaatatataccatagaatggtaagagctatttatgataaacacatagccaatatcatactgaacaggcaaaagctgaaagcattccccttgagaactggaacgagacaaggatgctcactctcaacattcttattcaacatagtactggaagtcctacccagagcaatcaggcaaaagaaagaaataaaaggcatccaactaggaaaagaagaagaaaaactatgtctttttgctgatgatataattctatacctagaaaaccctaaagactccactgaaaagctcgtggaactgatgagttcagtaaagtttccggatacaaagtcagtagcatttctatctaccaataatgttcaagctgcaaaccaaacaaagaaaacaatcccatatacaatagtcacaagcaaaaaatacctaggaatacatctaacccaagatatgaaatatctctttaaggagaagcacaaaacacagctgaaagaaatcataggtgacacaaaaaaatggaaaaatatttcatgcttatggattggaagaacaatattgttaaaatggccatacttcccaaagcaatgtaaagattcaatgctatacttatcaaactaccagagtcattctttacagaattagaaaaaaactattataaattcatgtggaaccaaaatagagcccaaatagccaaatcagtcctaagcaaaaagaacaaagccagacacattacattacctgattcaaactatactactgtaagtgtacagtaaccaaaagagcatcatacaggtatacaaagagagatagaccaatggaacagaatagagaacccagaaataaagccacacacctacagccatctgatctttgacaaagtcaacaaaaataaccaatgggaaaagtactccctattcaataaatggtgctgtgatacttggctacccatatgcagaaaaatgaactagacctctaccatacacaaaaattaactcaagagggtttaaagctctaaatatcagacctcaaactataagaatcctagaaatcttgtgaaatatcattctggacattggccttgggaaagaatttatgactaggtcttcaaaagcaattacagcaaaatcaaaaattgacaagtgggacctaattaaactaaggaacttctgcacagcaagataaactgtcaccagaagaaacagatatactacagaatggtagaacatgtttacaaactatgcatcaaacaaaggtcaaatatccaggatctataaggtacttagataattcaacaagcaagaaacacataaccccattaaaaattgggcaaaagaccttaacagacacttctcaaaagaagacatacaagtgttcaacaaaaatgaaaaaataccccacataactaatcatcagagaaatgcaaatcaaaaaccacaatgagatattatctcctacccatcagaatggctattattaaaaagtctaaaaaccacaaatgctggcaaagctgtggagaaaaaggaatgtttgtacacctttggtgggaatgttactagttcacctactgtggaaagcagtttggagatttcacaaacaaaactgagctaccatttgacccagaaatcccattactgggtatatatccatagaaaaataaattgttctaccaaaatgtcacatgtatgttcattgcagcactattcacaatatcaaagacatggaatcaacccaggtgccccttgacagtggattggaggaagaaaattggtgcatatacactacagagtattatgcagccataaagaaaatgaagtcatgttctttgcagctatttggatgcagctggaggccattatcttaagaaaatttacacaggaacagaaaaccaaacaacacatgttctcaagtatacatcggagctaaacattggatgtacttggataaaagatggcaaaaatagacactagagactactagggggcaagagttaatgaattgactgttgggtactgtgcttacctcagcatcactcaatatacccatgcagcacacctatacatgtacctcctgaatctataataaaagttgaaattatttttaaaaaccacaaaataaacatatatgaatatataaaaagataagacagtatagagaatataaagcttagtacatatgacataaaatgcttgcattacaaatgacttctgttggttaagagaaaagttagagaaaattagatgattaggtgattattttaagaacagataaagaaaattaagtaacagtcttcaaaacaaagttcttagtgttttgccacttaagttttagtgaagaaatatgtttgggtatttactgcagacagggtattacgtaagtgaacgaaaataataaatatttatcattcagttctgtcaaattatttttaattatgaatttctgaaggactatgagtgtgtcagatgatatgtgtctgtagcatctacatgctggtacatagtatctgtgaagtgtttattacaatagtaaatcttctatatgtcaatcatcatatgaatttatgactgctcatgaaatcttttgaccatatatttttcttgcctgatccaggcaagataataaaaatgttataattttaacttatatggtaggtaacaaataatatcctgacaaaagaatcaagaaataatagaatacaaacaagtagaaacacatctcatgctcatggatgggtagaatcaatattgtgaaaatgaccacactgccaaaaataatctacagattcaatgcaattcccattaaaataccatcatcattcttcacagaactagaaaaaacaatcctaaaattaatgtgaaaccaaaaaagagcctgcataaccaaagcaagactaagcaaaaagaacaaatctggaggcatcacatgacccgacttcaaactatactacaaaactatagttaacaaaacagcattgtactgatataaaaataggcatgtagggaaatggaactaaatagggaacccaaaaataaagccaaacacttacagccaactgatctttgacaaaccaaacaaaaacataaagtgggaaagaacacccaattcaacaagtggtgctggtataattgacaagtcacatatagagaatgaaagtggatcctcatctctcaccttatacaaaaatcaactcaagatggatcaaagacttaaatctaacacctgaaaccacaaaaatcctagaagatatcattggaaaaactcttctagacattggtgtaggcaaagagctcatgaccaagatgcgacaaaaagaaagataaatagatgggacttagttaaactaaaaagcttctgcacagcaaaagaaaaaatcagcagagtaaacaggcaacccacagagtgggagaaaatcttggcaacctatgcatctgacaacggactatatccagaatttacaataaactcaaacaaatcagcaagaaaaaaaataaaaacaaataatcccatcaaaaagtgggctaaggacatgaatagacagttctcaaaagatgtacaagtggactgggcacagtggctcatgcctataatcacagcactttaggaagccgaggtgggtgtatcacgaggtcaagagatggagaccatcctggccaacatggtgaaagcccatctctactaaaaatacaaaaattagctgggtgtggtggcgtgctcctgtagttccagctacttgggaggctgaggcaggagaatcgcttgaacctgggaggcagaggttgcagtgagccgagatcacgccgctgcactccagcctggcaacagagtgagactctgtctcaaaataaataaataaataaataaataaaaagatgtacaagtggccaagaaacatgaaaaaatgatcaacatcactaattatcagggaaatgcaaatcaaaaccacaatgtgatgccaccttactcctgcaataatggccacaattaaaaaataaaaagaataggcgttggcgtggatgtggtgaaaaggaaacacttctacactgttggtgggaatgtaaactactacaaccactctggtaaacagtatggagattccttaaataacttttgatttaaaaaaaagctgttagaatagataaatatagtgaaaaggtacaaactaagtatggacacatgaaactcaatagaacctgtgcagttagaaccatattcatattttgaggttattttatttctgtaaaaaaaattcaacgtcacattaattaatattgatttaaattctggttgtagttttttgtaattaatttggaatttttgttttatgtgtgtaaagagccataagtgtgaaaaatttatattttattttgtttttatacctaagtaaaatttctaagagtaagtcaaaagtaaagaatataaacaaattcaaaggtctgcccatttttcaaagtgagaaaaatttatttattttgtgttttgatcattaatggcccaattgaaacacaactctctacattagcttttcttgatttttcttactgtaattaatctcttccttctttggagtctatagaaattattacattttagttttatttttcttacttgtctgcttgttttgtctctcctgttagatagtatgatttgaagaaaaacggatgtgtgtgtataatctgggacaatacatttttaaaaatttaatttaaagttctgggatacatgtgaaggacatccaggtttgttaacatatgtaaacatgtgtcatggtggtttgctgcacctaacaaacccatcacatcggtattgagccctacatgcattagctatttattatgacactttccctccctcccaacctccgccaacaggccccagtgtgtgttgttccccatgtattctcattgttcagctcctacttaataagtgagaacatgcggtgtttggttttctgttcctgtgttagtttgctgaggataatggctttgagctccatccttgtccctgcaaagatcatgatctcattcttttttggctgcatagtattccatggtgtatatgtatcatattttctttatccagactatcattgatgggcatttgggttgattccatgtctttggtataatgaatagtgctgtaatgaacatatgcatgtatatatcttcatgatagaatgatttatattcctctgggtatatacccagtaatgggattgctgggtcaaatagtatttctggttgtaggtctttgaggaattgtcacactgtcttccacaatggttgaactaatttacattcccaccaacagtataaaagcattcttatttctccacagcctcgccagcatctgttgtttcttgactttttaatgatcaccattctgactgaagtgagatggtattacattgtggttttgatttgcatttctgtaatgatcagtgatattgaactttttttcatgttttttggacgcatggatgttatctttggagaagtttctgttcatgtctttgcccactttttaatggattctttgttttttttttcttgtaaatttgtttaaattccttgtagattctggatgttagacctttgtcagatggatagattgcaaaaattttctcccattagtttcttttgctgggcagaagctctttagcttaattagatcccgtttgttaatttttgcttttgttgcaattgcttttgatgttttcatcatgaaatctttgcccgtgcctatgtcctgaatggtattgcctagattttcttccagagtttttatagtttggggttttacatttaagtctttaatccatcttgagttaatttttttataagttttaaggaagggatccagtttcaattttctgaatgtggcttgccagttctcccagtgccatatattaaatagggaatcctttccccattgcttctttttgtcaggtttgtcaaagttcagatggttgtagatgtgtggtcttatttctgagatctatattctgttccattggtgtgtctgttttggtaccagtaccgtgctgttttggttactatagccttgtggtatagcttgaagttgggtatcatggtgcctgcagctttcttctttttgcttagaattttcttggttatatgggctcttttttggctccatatgaattttaaagtagttttttctaattctgtgaagaatgttagtggtattttaatggaaatagcattgaatctttaaattactttaggcagtatggccattttcacaatattgatgcttcctgcccatgggcatggaatgttttttccatttgcttatgtcctctctgatttccttgagcagtggtttgtagttctccttgaagagctccttgacatccattgttagctgtattcctagttattttattctctttgtagcaattgtgaatgggagttcattcatgatttggctctctgcttgtctgttgttggtatataggaatggttgtgattttgcacattgattttgtatgctgagactttgctgaagttgcttatcagcttaagaagcttttaggctgaagcgataggattttctatatgtacgattatgttatctacaaacagagacagtttgacttcctctcttcctatttcaatacgctttatttctttctcttgcctgacttccctggccagaactcccaatactatgttgaataggagtggtgagagagggcatccttgtcttgtgctggttttcaagggaaatgcttccagcttttgctcattcagtatgatattggctgtgggtttgttctaaatggctcttattattttgagttatgttccatcaatacccagtttattgagagtttttaacatgaagagatgttgaattttataaaaggccttttctacatctattaagataatcctgtggttttttgtctttagttttgtttacatgatgaattacatttattgatttgaatatgttgttaccagccttgcatcccggggatgaagccagcttgatcgtggtagataaactttttgatgtgctgttggacttggtttgccagtattttattgagggtttttgcattgatgttcatcaggatattggcctgaagtttcttttttagttgtatctctgccaggttttggtatcaggatgatgctggcctcataaaatgattgatgcactagtccttccttttaatttgtttgaagtagtttcagaataaatggtaccagctccgctttgtacctctggtagaattcagctataaatcagtctggtcctgggctttttttggttggtaggctatttactactgcctcagtttcagaactcattatttgtctattcaggggtttaacttcttcctggttcagtcttgggaggctgtatgtgttcaggaatttatccatttcctctggattttctaatttatttgcatagtatgcaaataaattagtgcaaataaactaatttatttgtttatagtattctctgatagttgtttgcatttctgtggggtcagtggtgatatcccctttatcattttttattgtatcaatttgattcttccgtctttattagtctaggtagcggtctatttcattattctttcaaaaaaccagctcctggatttgttgacttttttgaagggtttttcatgtctctatcgccttcagttctgctctgatcttggttatttcttgttttctgctatctttggggtttgtttgctcttggttctctagtcgtgatattatggtgccgatttgagatctttctagcttttcgatgtgggcatttagttctataaatttccctcttaacactgctttttctgtgtcccagagattctagtgtattgtttatttgttctcattggtttcacagaacttcttgatttctgccttaatttcattacccaggagtcattcaggagcatgtcgttgcatttccagttagttgtatgggtttgactgtgtttcttaatcttgagttctaatttgattgctctatggtctgagagactgttatgattttagttcttttgtatttgctgaggaacgttttacttccaattaaatgattgattttagagtaagtcccatgtggtgctgaaaataatgtatattctgctgtttttggatagagagttctgtagatacccagaccaacttaagccagagctgagtttgagtcctgaagattcttatcaactttctgtgtcaatgatctaatattgacagtgaaatattaaagtttcctattattattgtgggagtctaaatctttttgtaggtttctaagaacttgttttataaatttcgttgctcttgaagtgaggcatagaaatttaggatagttagctcttcttgttgaattgaactttttaccattatgtaatgcccttctttgtcttttttgatctttgttggtttaaagtctgtcttgtcagaaactaggattgcaacccctgcttttttctgctttttatttgctggtagattttccctcatccttttattttgagcctatgtgtgtccctgcatgtgagaagggtcgcttgaatatagcacaccaatgggtcttgactctttaccagcttgccattctgtgtcttttaattggggcatttagctcatttacatttaaggttaatattgttatgtgtgaatttgatccagtcatcatgatgccaactggttattttgcagacttgttgatgtagttgccttatagagtcattggtctttgtacttcagtgtggttttgtagtagctggtaacagttttttgtttgtttgtttgcttgtttgttttcatatttagtgcttcctttgggagctcttgcaagatgggcctggtggtgacaaattctctcagcatttgcttgtctgaaaaggattttatttctccttcacttatgaagcttcatttggccatatatgaaattctgggttgagtattctttgctttaaaattgttaaatattggcccctgatcttttttggcttgtagggtttctgctgagaggtctgctgttagtctgatggacttgcctttgtaggttacctggcctttctctctggctgcccttaatattttgtctttcatttcgaccttacagaatctgatattatgtgccttgggggttgatcttcttatggaatatcttactggggttctctggatttcctgaatttgaatgtgggcctctcttgctaggttagggaagttcttgtggatgatatcttgaagtacgttttccaacttggccctgttctccctgtctctttcaggtacttcaaccagtcagaagtttggtctttttacataaccccataggtcctggaggttttattcattccttttcattcctttttcttttttttcctaatcttatctgcctgtcttgtttcatcaagatagtcttcaagctctgaaattctttcctccgcttggtctattcggctatcaataattgtgggtgcattgtgaagttctcatgttgtgtttttcagctccatcaggtcatttatgttcctctctaaactggttattctggttaacagctcctgtaatgttttatcatggttattagcttctttgcattgggttagaacatgctcctttagctcagtgaagttcattattacccaccttctgaagcctacttctgtcaattcattcatttcagccctgcccagttctgtgcccttgccagagaggtgttgcaataatttggaggaggagaagcactctgctttttgagtgttcagtgttttttcattgattctttctcatctttatgagtttatctagctttggtcttcgaggctgctgacctttggatggggtttttgaggggacttttttgttaatgttgttgctgctttctatttgttattcttttaacggtcaggcccctcttctggtttgttgggggtccactccagaccctatttgcctgggtccctcccacacctgaaggtgtcaccagtggaggctgcagaacagcaaggatgactgcctgctactttctctgggagctccatcccagaggggcaccaaccttattccagcaggaatggtcctaaataaggtgtctggtgacccttgttggggggtttcacccagtcaagaggcatgggatcaggaatccacttaacgaagcactctggctgggctttggcagagggggtgcactgtggtgggaggaatcccactcatctgcacttcccaggttctgcagagccatcgggggaaagactaagtccactgatccatggagagagaccatggctgcccctcctgcaaggggctctatcccagggagatcagagttctgtctgtaaatccctagctggagtttctgaaattcctgcagagaggcccccatccagtgaggaggaatgggtcagggtccagcttaaagaggcagtatggccatgatccaccacagccgctgtgctacactgtggagaattcctcctgagtccaaaccgctcagtctccctcgcaccagcagggaaaaagtggcagaatggagctgcatttatggctgccacccctccccccaggactcagtcatcttaggcaacaggcagctgcaatgatggcagctgcccctcccctcaggaacttggtaatcttagtctctagctgagcgaccgccaagaatctgcacagctctgttcttgggacccaaggccctggtcacataggctcacaaaggggatcttctgatttgcaggttgcacagattcgtggaaaaagcatggttttcctggtggtaggtagcacactcaccaccttgcttggctgggagtgggagttccccttgttacttgcagctcccaggtgggccgttgctccactctgcttttgctggctctctgtgggttgtgccaactgcctattcagtcccaatgagagaatttggatacctcagttgccggtgcgggattcacttgcagttttcgttcttctctcgccgttttcattcttctcggtgggagccttcgaccgcagctatttccagtcaatcatcttggtccctcccggcaacaatactttttttataaagagttattcggtgaagattgaataaatggatgaatggatggaaagctaaggatatcttcgattatttaatgatagttaatattgatataggaataagattatttttccaaggcttacatgcagtagaaaaaatccttcatctatcaggtagtggtggtagaaataagttacaaatgaaagtgtaattataaaatacaataaattaagttgtataaaggtattgactaatcatatattagagctagcaaatatacagcagaagtgttagtatatcttttcctttatctatggcaatcattctaagtaatcctgttactctttttgggggggttcagttaaaacctgaaaatctttatctagttgttgtaaccactactcatcagttggacattgaatataaggtgaaacctgtctgatataaaggctctagtttctatttaataaggatgaggaaaaaagtagttactagttcaaggaatagttctagttctgtctcattactgaaacctggtagttcttacacttttcttcttaaccctggaagtgactatgtaatattgaggtttgctttttttctacttgaacccctatatttatgtcttctttaatgggattagtgttttttccactgtccctgtaattcagaaaggatgatcttagtcctctttaaagtaagtttcctctttctacctaagattgaattgaaaattgattcttcattgccttgaaacatgaccatcaagttatttcctgtgcaacattattaaatatctcttggcaacagcaattctagattttaggttttaatcaaaattttccaacatcatataggctacacaattactattgtcaatagtaattgcttatgtaatagcagagcttttaattttttgaatgtagtgtgcagggtactttgaataatatatgaagtttggttcaaagaaacagactgttgaaaacttcagtgaaccagactgagaatataaattggacacactggatgttcacttttattcttttttctttttcttttttttttttttttttgtgacacagagtcttgctctgtcaccaggctggagtgcagtggcacagtctcggctcatggtaaccctatctcctgggttcaagtgattctcctgcctcagcctcccaagtaggtgggactatgggcacccaccaccacgcccggctaattttttgtatttttagtagagtcggggtttcaccatgttggccaggatggtcttgatctcttgacctcatgatccacctgcctcggcctctcaaagtgcttggattacaggcatgagccaccgcgcctggcctttttattcttatataaagaagtacaagacaatatcatattggaaatatgtcattcacattttttttgaaaaatttattggtctgtctgacaagagataactatgaacttatcctccttctcttttgtggagtaactaaaaagcatgattaggccaaactagaaggagtgataatgttgtgaatagaggactctggtaaattcccatatttaatatgtaggagtcatgattgctctggctatggaacaggtcctagagctagtcagagagcccattgtgaagatgaaaacagaacaataaaatgaagggaaaaatacagtgaagctctgactttataagttttctttttactgcttatatgtcaaacatctgaataaaaactaaataatttatcatctcatgtagacatagctaccacttctctgtgaactctgaaatttatgttttgaagcaaatatgacctttatgtatttgaagtaaatattaagtttacgaaatataatatgaaattcatgtatttgaagcaaatatgatcttaaaaatagaaaaaaatgtagcttagtgaaagatgttaattttgtaaccaaacaggaaaggattagaatcccggttttgctgcttattagcggtcttaggcaagtaaacaaaaaaattcagccacagtttcatttttgtaaaacagaaatacatatctgtcttgctgttttcagaattagaaataatgtaaattaatgcccatataggcacttattaatagtgcttattaacattattgtttttaacgctataatattatttatcctatactctcaatgaataactacatgctatacttgagtatatagtacattttattatttatatagctatcactacataatacatgtaaggaaaatataatgctgaccaaatgtaaaatttagatattttaattataattttctttctttcagaattacttactgtcatctacctttccagagtaaatggctttatgttggaacagaaagaggaaatacacatattgtaaatattgaatctttcattctttctggatatgttatcatgtggaacaaggcaattgaactgtaagtttgaacttggatatcactttattggcttaaatacttcatacagttatgtaacatgtaggtcaaattacagttatttgatacgtctattactaatttataatgaatttgagtgaaaagttcagtaaaataacttaaagccataaaagcttttaaaaatagatattacaatattttaggctttccaaataccataaataattaagctttatatctaaaaatgtgatgacaaaatagtaaggcttattctaaaagttatacatggaaatctcacttcattataatcaagcttagtatagcaactttcagtgagaatgaattgtgttatgtaaaaataatcatgatcactgcatatgattttaatgcttgtagcttgttcttttcttgcctcattaaaatattgttcagggctcaaatatcttttaggttacgttatacataggttttttgggtgtatgattgatggcaattaccactttggctttggcactgatatttaagtttctgtacatgtgaaatgtgaaattctccaaatatcaaactctgtggaatttcaagccatctgtattcagccattttgcattgctataaaggaatccctgagacaaggtaatttatatagaaaagaggtttaattggcttatggttctacaggctttacaggaagcatggtgctggcatctgcttagcttccagggaggcctcaggaagcttacaatcatggtagaagttaggagcaggcatgtcatataatgaaagcaggagcaagaggaggagttagggggaggtgccacacactttcaaacaacaagatctcacgagaattcattcactactgcaagaactcacttactatggcaagaactcactattacaagaagagccctaaggggatggtgctaaaccattcaagagaaatccacttcccatgatccaaatacctcccactaggccccaccttgaacatttagggattacaattcaacatgagctttgggcagggacaaatatccaaactatatcaccatctatttgtagtacatacgtaagcaattcttctagtaaaattattaatcagaaaaacaacttttatttaacacgtttatgctctctacatattaggtccttgataagatgtttgacttgaagttgactcattttctgcctcatatatagtctaagttacaaaattattctgcaaaattctgattaaaacaccctatttttgtgaagcttgacgctggaaataaatattttacctaatcttaatgtttcaatatgcatgtatattgcttcataaggaaggttgttactagttatactcttgtcatgatactccttttgtattatgtctgaatgggtcttttattaatgataattctttctccctcattagattaggaactgctccagagcaggatttttgtttattgttcttttcttgttcttcatacttggcttatttctgtgctttccaaagtaaatactaaatgattgatgacattattgaagcattagtatgataaattgttacatatacactgctattgacttacaactttcatttatgttttcaagataattggtgtgagctattttgctcattttgttgttctgtgtgaatatttctaaaaacattaatcctataaataattatgtttccccccaaagttactttattaggtatttgggagggtccttttcccctgtaatcctagtcctataaaagcaataaaagggctgaattttaatagttttacataatattgtttcaggatattgataaaaacatacaggcttagatgaacaagagaagattcagttataaaacttttaaataaattcaatattagtgaaaatatatagatgcatcacttgtgttcaggttgaatgctgctaaagtaattgagaagaatttgttatcttaagcaaattaaacatttcaccactcttgcaatgctgttcttatattcatttatgtaacaaatccttttcatggttcagattactacgtgaactagtgacttatactttattttaatgtgtttatatagtctatacaatttcaagactaatgaagagtttttaaaatgtatattataagggaggctaaaatcaggagaaattaaagagctaaaataaggcatttttatttttcataatatacacatgattcagcattagaatagcatctactattttatatataaacctgtgttttatcgagttgtacatgcctctgaaaatgttcttgaaatatctctgagaaattattagtaaaccacataccatcacttcctgaatgtctcttgattcatttagaccggatttccaaaaatatgttccatagaattctaattccactgtgacagataacattttaaatgccaatttccaatctcctggaactgtcttttcattgctctctacctcttgagatacattagaaaatgtatgtaacttcctgttaatatgtgtcaagtgtatgggacagtaataaaatatgcatttaattaagaagactcatttaataaatataattttagtccatgaattttaataatatattttctaagtaggacaaatgcaagaattatctaaaaaaatatgagattgtttctattttaagtccttattgaaatacttttcatttaatgtttatttttcagcttgtttctatttttagtgaattattctaattgcaattagaggcaattcccaagagtatgaatagttgggtttccaaaatgtatatattggttatttggaacctgggacaaatttttcatttaaacagtgatatttgaagaataccttataaaataacagcatagaactaaactatcattaaaaaatatttatatgggaaaatatataccaggtgatagcatagaaacagctatttctgtagggcagccctaacattttaaaaaaatgtaagctttttttccacatatgattaaaatttgagcatgaaatttataatcaaatcataaaagtgtaagactcatgtttaacatcattcaagcatgtttactgagctctattatatgatagatactagaaacaactatgaacagagaagacataatctctgtcctcctgggacttccagtttaatggaggcaaagttaaataaaaaggcaattacaatatactggtaatataatatggcaattccataagaaggacatctattataatatagacatgggatctcaaagtggtatctgtgaagattgttacatctatgctgagatccaaggggtgagtttcagttagatgagtaaaataccagggacaagaacattccgggcagagggaacagaatatttaaaggatggaatataagataattttctgctctgtgcccagaaattttaagtactgcagtttatagtttgttggaatggctggtggataggatagcaagggataaagctggaaggtaatcaggttttataacatgaaaggtcttgtaagccaatttgataagttcagactttaaagactaatagggagctagattttgacggttgcaagcagatctcaatcaaatctatattttaggagtactaccctgaatgcaggtatggagaaataattggagagaaagaaagactgtgttcttggtaaaaattatgttggtgttgtaggagtggagataaaccaacatattaaagaaatatttaaaagaaggaataataatagggaaaaattaaagatgacttcccagtgtttgccttgagcaatggtgtacaatggtgccatttagtgaaagtgcaagaggttgagtaggttgagagtaaaataataagttcaattttagctccattgaattgtatgtgtttataagactttcaagtggagttggtatagaagaatagcaagaggtgggatatatatggatctgaaggtaatgagagagatcagaatttactgggttgttaaaaccagatgaacagatgaaattgtgcataaagagtatgtagagaaaagttagcaaactaatagccattgaactaattatgactcatagatatattttgtttggccatcagagcatttaaatatgctctgaattatgactttctattatttaaaaattggtagaatgaagataaaaatttggactttttggtgaaacagtcctagtctaacattcctgtatggcaataatcaactgcaaatgagtagtaactttccttatgtaggtgggtaatgtgctatccaggttggtacagttcttattcagcctatttaactcatttgcaatacctgcctgattcctgtagggttttgaatttgtggtcatatattatatgggaatacatggcagtctaggacaggataccatagaatatcaatatttaagatatgggaagataatgaaaagcccataatggaaactaatattaagaaggctactttagtgaatgggagaaagagaactaaatagggataccgagaagaattactgcacatttttttaggtggctagtacatgaaaataattcattgataattctatctaaagaattttttttgtaattttcagaatccaaagtccacagatgcttttttatttttaggtcaatttctcatgaccataagtttttccaggagtgctttgtggttttggaagtttaatgttagggaacaagccagaagaaataccccaaaatgttaataggcattatctctatgcagtgaaataatgtgaaccctttttcctcttcacttttgatgtgttctatgtttgtttaagatagtaaataatgtttcttctagagtctgaaaaagcaactacaaataacggaagtttaatgttagattattttcagaagtagaatattctatagtttaaggatctaaacacaagagtcttgcatgtgatccgagtagtgtttcccaaaacaaatttctgtgatttcattaatatgatcaatgaaaaaggattcaatggactaataattttgtaaagtactgaagatttacaatgcttatttgcatagtacaggctctaagaaattctgtaggggaaataatatttaactttaattcagggtttcccaaagttttaaaatatagaacaactaacttatcgtaaagtacactttggtaagtgttagtgcaatcaaaccaagagacggagaggctatggtttgttggcaattatgaattcctggaggataatttaaagacattaaaccttatcagaggcatttatacctttatagaacactgaatttatgtataaatgatatgttacatataaatgtggaaaaaattaaagaaatatctgtaaactttttatgaagccctgtttaatttcttttcttcctgcatatattctagaatgcaaatagtaactctaatttccaattatcacatcaatcataatacatactatttattgaatgcacactatgttttgccatagtattagatgctgtatgtatcttctaatctgcacaattattcagtaaggtcagtcctaatatttccatttttagatgaaaatatttaagatgaatccactaacaaaattcatcaatatccaatgaatctgtgtttattccccttggtaactctgaggagtcagcaccaggagatcctagaattaatttgtcacttttctctgattccaaatagtttctaagatttaaatcttcttcattgttttgtatagaatctttgatagttttcatgtgtgcttaagaaagaaactgaaactgtgttaatataatcataagaataatttgacactgttaggtcgtggagaaaggctgtggaaagtggagcaataataaaacccttgttatatcagatcagatcatatttaatcatgacataatcattttcaaagtgatgtaagttaaactaggaattataatagaaacatgccagatatgagagtagaataaatttaaagtcagattgatagagagagcccaggtcttttaacaatattctgttagactcataattatctgttatttattatactaaataacctgataagtgtggtataaccaatgaactaggtttcactccaatttgttgtttttctgtaaaagcgttatcactagagtagatttatttttaaatcaaaagtgccactgtacttttctttaggggaaaataatcagaggagatttcgtgtaaaaggaaatcttaaatcaggtatgtactttgcaatttaactgagacagttttacaccattacctttgtagctgtagtgttcttttatctatgtaaataaaaattcaattaaaaaaattcagaggcgcttatctgacaacaaacgtttcaaataataaagaaccccattgttattaggatctttgtgttttaacccgatttttaaagaaaaacataaataagtagtttgcaattagtaaacagaaatgcagttaggactggtaaagtaaataaaaaacttaagtgaatctgagcttaaccctagaatggtgggattttattccagtgtaatcttaatttctttgtttcagtctctagtggtaaggtattttaatgtttggtttttaattactgttttgaattgatttaacagatccactaagactcatccaggtccagttgtacatttaagcgatagcccaagagatgaaggcaaagtgagtattatgatatctttattattagttttattttcctcattcttgaaaaaaggtgtttcttactattattttatatctagtatctagcccagttgatagcattttatattatgtaaaatgaaaatgtgttgaatcaacgaatgagtaaatgaatgaatgaatgaatcatgctactgatggtcccaaattaagtctttagctttactgagagataaaatcggtatttaattctggcattttgagaacgataacatgtagaacaactttaattttcaaatactctatgcttgaatttaataatatgattataatttgcctttgttactcagtttggtaatgaaaaatgaccaatattaaataacataaattagccaatcttgatttcattaacatgtactaatatataaaatgttatcagactacagaaataattcttattcactttgattatttcataatttgcctttgatggtgaggaaacagttgaaaacatgaaaattagatatttttaatattaattaattaatattaataaattatttagtatataggtttggttctttatttttaaaggatagaaactgaattagcctatcaaaaatcaaacctgaaaggcaagtccacccacccaaggaataaaattggatcccttcaaattgatccacaagtacaatgtaattccaatcaggtgccgtcagagtttattttttaagaattcaaaaggtgattttaaaatttattaagaaaagaaaatgtatacgaatagccatgacatttttgaaaaagaaatacagtgttatattggtacaggggtacacaagaggaccaatgtatctaaatagataaatccccaaatagttcaggtatttgggaaaatgttatatattttaaagaagatgtctgaggacataattagctattgaataaatggtactggataattggttcttcactttgaaaagaatagtaagacctctgcctcatagatacataaagaaccaatgtttaataaacattaaaattacaactcagaaagtattcaaagatgcttgtaggatagggttgttagttactgtggagtagggacactcttgggcaaaatctaaaaactttagggcatatgctataacaagaatctcataataagagataggcaacaaagtgggaggtaatatttcctacatgtcaaaaataatgaacatgtaaaatatataaagaacttgtactaaatcctcatcttgtagtaagaaatcaatatataatatctaatgactaaatcagaaaatagcaatataaacatatttagacatatgaaaataagcctaccaaaaaagatgattttaagagttgatgttgttgcctcttacttctagagagaaggatttggcagtgaggaggaaacagtctcactagtaattagggaaatacaatatacaatttgtcaacatcataccgacaaaatgttaaacactaaaaatattaattttaaaatatcagagaatggaaaaagcactgggaaatagccatctaaatatatgtatatataccaggatgagcaattaagcattatcaacatttaaaacatatattcgtttttggaatttgttatgacctagaaaattcatttccgatatctatactgtttatgtgactaatggtgcaaactattaaaatagtctaaatgtctcttaatagaatattgaataaatgaatgctgatgtattcatactgtggaatgctgtgttgatatggaaagttctttaagacgcattttttaaaagaaaagttgcagaacagtaaggtataaaaccacttgaacattgcctttatatttgtacttatatattcaaatgcctaagaaaaaaaaaagcctgaaagaatatagacaaatctgggagaacactaaagattggaattggggaaaatggtcaaagttattcttattttatttgtgttgttcaaatttttatgaaagaatataatgtggcaattgtttaattacaaattaaaaggactgcaaaataaatgaatattggcatcagaaaactataggtttgagttgtggctctagcatttattagcatataatcttgaataaatcactttacttcttgtatatcagtttttccatcaatagtcttttgtcacagaagtttttttattttaatatatgcagttttatcagtcttttcatgtgattcttgctttttgtttcttattcagtaaatatttccctaccagagagaaaatacaattctatttttttctattggttttaagaccttgcatttcacaattagattttaatcttcatgtaatttatgatggtttgatatagtagacttttatttgcacatgtaaataattcatttattgtatagtgaatctatttttcactgatttatacacctcactcatatatcaagttccaatatttggattggtctcctaggcttaaccttttgctgaattatttatctactattgtactaatgacatactttattaattataataacttacaaaatgtcttgatatctggtaagctggtcccttttctttttctgaattatcttggctatttctgactcattattctagtatatgaattttggaatcagcttatcaagctcaatgtgattctcaattgggattttgtttgaaattcgagtgtataacttatagaaaatttacatgttaagatatgggtgttccatctataaatatgtttactttggctttcatttgttttgctatataactataaatttttttataaaagtcttttatatcttgtgctagctcaattcgataagtaccttatagaatttattgctcttgtgacttgtgacttaatcttcttaaagaagtttcataactgattatctttagattatcaaatattattgattttttaatattttgtattcagttgcatcattgaatgttttgtttttaatagctgtccttagattctctggaatattctatttataaaaactgaaaatatagacaaattttcttcctttccaatatttatggttatatatatcttttttgttttattgactaggaccccagtgcagtgttgagtaaaaatggttttagtgggaacttttttttgtttccaacttcaaaggaaatgcctccacgatttcagcattaagtaaaatggttgttgcaggtccttgattgcttttatgaagttaaaaacattccacctatttccaatattctaagagtttaaaattatgaatagtgtcaaattttattgaatgctttctacatgtatcaagattattatttcttaatttgttaatttgttgaattatgttaatagattttctaactttaaacatatttgtatttctgggataaattcaacttggaaggggaaagcttcccttggaagctaattggtgaagtgcaagaaggaacaaactgctaaagttaaggttcctacaaaatcaagataatatggttgggcgcagtggctcacacctgtaattccagcactttgggaggacgaggtgggtggatcacctgaggtcaggagttcaagaccagcctggccaacatggtggaaccctgtctctaccaaaaacacacaaaaaattagccttgtgtggtggcatgcgcctgtagtcccagctacttggaagctgaagcaagagaattgcttgaacccaggaggtggaggttgcagtgagctgacattatgccactgcattccagcctgggcaacagagcaagactccatctcaaaaaaaaaatcaagataatgtcatagaatcagaaaataggccatctttcccccaatatatcatttataaagaaactgtgcattggtctatcgaatacaaaagggtactcttgagctgagagatgcctgtattgatttgatacagcattgagtgaatctgcttgaattctcttagcttctcttgtctcccaaacaaatgctctcccaaacaacggctgtttgcttcacttcatgtttggcaaaattaattgagctattcccaggtctctggctcctttcattaattctggattcagaagatgtgctacaacataaggcattcaatctggcttccataacacacaccaaaggggtcaaatgacacaattctgaagagagggggtgttaacctcccatggagaaaaccttgaccaatgttaggcaagagacaagtaataaattcttcctctcttcctccttattatttggctaatttgagtcatagttttctcacataaacttttggagatttcttgcaagaccatgctacacctgaccagtgatgtctcttctgcttctccccatgaaatagtagagtgataatgaatcatctttcttttattattacaaccctgagattgcactcctcccttaaacactaggactaaaccctgcctcaagctttttttgtacacacttctggttaagataacagttactacaattattctcgataagggactgaaaaatacagccacaaaccaaatctggcatgctgcctgttttctcaaaatgttttattgaacacagccatgctcattcattaacatatgtctgtggctgctttcttgctgtaagagtaaagctgagcagttgggatgcaaagcctaaaatgttcactatctggcctttacataaaaagtttgccaactcctgtcctagtctgtaaaccctcagtattggatttttgaagttaggttgtctcctgtctaaaataagcaaacctgttgaaggtaccaggtgaaatgaattaaactcttccatgcagtgacatcacagttactttaaaaatgttcttctgtgattagggactaatctttctctgctagaaagataagataaagggagataaagtagtcatggtgtttaattgatatggggtaatgataattacataatgatgatgaaataaaataacttcctttgagggcacttgtgttagtttcccattgtcaaaataaattatcataaattcaatagcttaaaacaaaacaatttattatctttcagttctgtaggccagaagttcaacacaggtctcactgggcaaaaatcaaggtatctgcagggttgcattcctttttagtaattctagaagataatctgatttcttggctttttcagaggctgcaaaattccttggcttgcagcccctttgtctatcttcaaatccaacagcatagtatctctctgactcttcttccgcaattgtgcctctttctcaccacaactgggaaacgttcttcacttttataaaatattttatgttgttgttgttgttatgtaaagaacatattgacagattccaaagattagagtgtgggtgtctttgggagtcctttattcttcctacatcatctcagaacaattaattactgatttaccaaatcccagaagtcctctaaagtagatttaaaggaactcctacctcatgtagctctagggaagactgtgctaaaaataggcccaggagctgcttataaggagaccaaatacataactttgataggtctcatttgttaaagtcagagccctgataaggaaagagtatgacctttgtatattagtttcctatggctgccataacatatgaccacaaagtggatgacttaaaacaaagaagtttattttttcctagttctaacaaccagaagtctaaaactaaggtgtcagttaggccgtgctccctctgaagactctaggggagacttcttccttgccttttccagcttaggtggctcctgatgttccttgacttgtggcagtataacaccaatctctgccttcattttccattttcacatgatcttctctatgtcttctcctctttttataacaacaggagtcattggatttagggtgggcctaggatgggatttagggcccaccctaaatccagaatgatttcttcttgaaatccttaactaattacatctgcaaagattctatttctgaataaagtcacattctgaggttctgggtgcacatgaatttttgagagcactattcaaccattaacctgggatggaaaaatttatatagataagcctgagaatattgtaaaccccagcaacccccaatttcctcaaacacttctggtcagcagaagtacctctttcaccatttctggaggagaacagtttcccttttctgggtgaccgtgtaatgacttcacctaaaataatttcctcgtatgatgatgtttttccccacaagaccacctccagtatcattacatccaggcaaagaaccagaatcagatctcagatctcagcacagcctaacacagaagcataaatcttcctcaaggaataaataaactatatttgaaagaaatagaatacctaccaaaggaattgaggatatgactaatactgccattcaccaatgaaatgtgtttagagtggtttttaaggacttgaacttgggggctgcctagaggagggtttatttttatgggggcagttacttatgattttggattcggtgctttggcagggacacttggatatggtcctagtagtaatttgctggcatggctccttgaagcctagactaaaaaaaagccatatagtaaataaagtagagatgtcagagtctttgggtatggtattaaagaagggatcaggggatgataatgttaaaatgaatgtattatgtttgttctggcaactcaccttttgactgtgttccctaggaggcttctgaggagactgtcttcacttaacctaataagaaatgccctagaaaggaaaatattagcatatttgagaagcttggtagtggttgtcccttttaaggcccttgttgacagtaggagttgatgcaagagagccaggttccataatattcatggattgtagaggccaggtcacaaaatttaaccatctggcaatatgggcttaattaccataataagcagcaaggctggagtggcaatgcaggaatctatggtaatggctaatataccatgatgtttataggagcaaaataaggtgggaagctgactgggatgttgtttgccttgtatgatcagaaaaaaattaagagtagtttaatttttgacagtcaccatcaaaatggaaaatcacaatatctcatcaggttttcaaatataagttagtttgcagattcagaatctattgattaaaaaaggagctagttgtcactgaaaaagaatcctgaaatgctctaataagtacatatagtaattatagaaacatctgtgattgtttgcaggagtaactgtttagttttcaggactgttagatatagggtcagagcagacattaatactgggaaatttttaaaaaagcaattatggtcctccagttagaggcgagacatatggaataaatacccagttgatagacggagttttggcccaagtctaatctcacagtagatctagtgggtatgcagacatacccagttattttctccaaatgtataatttgacagatatgcttagtagctggaataatactcatattggtttgcttaccctgtaattagaggcacatagtgggaaaggaaaatggaatctcctgaaactgtcttcctctgccaatattgtaatcagaagcaatacagcatctctgaaggaactgcagagattattagcacaattagacttgaatgacataatggtagtggtcaccaatacatattgttgagttccattgtgtaggttttgcaaaaaaaaaaaaaatagattgaggttggtaatagtacatcgctataaaaataaccaggtgacagtcccaatcacagctgcctagcttttatgtgtatagatcaacacaacctatggtacctaagatacagttacatatttagtgaaatctttttttcacatggatgtgggatggaccccatattcatcaacagaggggaatgaaagaaaggactgcagtgtaaattcaaaatctttctccaggactatgttatttttcatgctctcagtcataatataattctcagtaatcttgattgtctggacattctttggaaagtataccaattcacttttttgcctatgtaatgctaactggatctagtgagcagacctggcgagtacctttataactcataagattcatgtttcagaggatgggaagaaaataccacaaagatccaggggcctgtaccagatatgaagattttgagggtcttagggtctggggcatacagagcatctcctctaaattaaagcataagcaattttacttcccctaagaaagtgtcacatcacttgatggggcttttggatttgaatcatagtttataatgtccttgaaattactgaaccaactaatttttatatcacccaaaagtctgccagttttgagtgaaagcctagagaaaaagctggtagtgtttgtctcctaagtcaaagatgctttgcaagctactgtactacttgggatgtatgattttatagatctgataaaacttaatgcacctggtagataaaatgttctattggaaagccctctagaggagtcatagcagttactatccattttcaaagcaactcctgacatgctcctgggcccttgtagagactgaaccatggaatgccaaatgactatgttacctgtgctgtccatcatgagttacatattatattcactgagtcataaaattgggtgggagacatggtatatttaggatgttagccttgacttttcaaaagctattagtgaattagatgtacaccgagcccagaattccatctgttgcaaaaatgcctccctcttgacctacatatataatcttatgggattggaaggaaatacctaaaaccaattgacagaggaggaaagaagttatgcctgcttcatagacaagtcagaggattggttgccattagctggttacagactgttgctcaattacatctctactaagggctaaccctgaatgaccctggtaaagaaaatcatcacaattggtagagccaatagcagtatactgtattatgcatttcatatgaataatgacacgataatttaaaattcagaaaaattttcttccacttgaaaatgttaaaactcttcattaaacaactattagatcaagtagaaaatacaaatcaaaataggtgaacatataaacatcaaaatagtgatatatatatcagaatttatggaatataatgaaaataattatcaaaaacaatttgtagtctttaaatcatatatcaatagaattataaattaaaatacataaatctaatatgaaacacagaaagctagaaaaacgattaagaaaataaagcaaaaggaaacagacataaagagataagagcagaacttcagttagttctgattgtaagctatgttataaattaatcaacatgctagttctttgaatagaacataaacaaaatatgcaaaccaacatccaacctaatcaagaaaaacagggagaaaacaaacttacacagaataatacacgaaacaagaggaaatcatactaaaactaaggacatttttaaacttttgagttaaatcattttacacagctctaagcaggtagatataaaagcctacataaaatgggtaatcccatagggaaattattaacagtgataccaatggagacagaaagtttaagaaaatgagaaagttattaaattactactcccacccaaaagtacaagtcacagatgactttataatggaattttatgaatttttcaaatattagataataccaatgctacatagactgttcttaaaaaaagattgccaagctatggccagtgggacaaatatggcctgcctgttattattttaaataaagttttattggagattgtgtagtctggaaagcctaaaatatttactgtttggcctattacagaaaaactttaccaacccctgttctgagtatagtttcaaaaaagaaaaaaattcaaattgtttttatgaagcaattataagagtgataactaaacctaataaaagttgcataaaaagaaaactggttttattggatgtattaataccaatggaaaaggagtgatatcagcaaagtggcagaataggaagcctgggctttcattcttacaaacacacagattcagctacaattcacatataaattccctttgtgagaaatgacaatgtaattgaaaagtttctgaaccccaggagaacatgaaaccagattcattaacaccagtaaggaaattcaggatgccctcttaccagaaaccttgctcctggtgcagtgccatatggtcaaggagagatttcctaggttgcagcttcacctaagggaggtaagaactttgttcatgtgtttagcacctcaatttttccaaaggggctccccagagaattggcttctgtcttgccagtcttggagcactgacagctctgaaacagcctagctgcctagacaagaatggaggcagcaaattgcgctgataaacacttctgaccctccctgccctgctgcttagcacagaggacagatgaaaaatcccagctctcagcttaccccttaggttgaaaagagtggatctgtgcatccagtgccccagcttctttgggggtgccaaaagaactagcacacatctcaccagtcctgaagctctgatgggtctggaacatctagctacctggggagaaccaaggtggtggcttgagctggtagatgccatagctaccccactggggtcagcacagagtgagaagataaagaccacagatgcctgtatctccatgggaaaggaaagagtagatagaagtcctcagaatctctgtctaggccaattggtggggtacttctctatgagaacatttcaggaagactgagagagatgcctgctttgcctaaagtgcagaaagcaacatagagagtcaaggaaaatgaagaatcagacaaaaatatttaaacaaagaataagataatggaaaccaaccctaatgaaatagatttatatgacttacttgatagagaattaaaataactcttaaaaagagactcactgaggtcaataatgcaattcatgaacaaaactagaattttcaggaaagagaaaatatttaaaagtactaaacagaaggcatggagctgaagaacacaataatagaactgaaaaaaaaatcactagaggggtcaatagcaggctacataaagtagaagaaaggatcagtgaacccaaagacaggtaactagaaataattcagacagaaaagcaaaaggaaaacagaatgaagaacagggaagaaggcttacgggacttatggggtacaattaaagtgggccactgtgtattatagaagatccataatgagaagaagcatatcaaggaccagaaggcttatttaaacaaatgatgagagctaggtatggtggcttatgcctgtattccctgcagtttgagaggctgatgtcagaggattgcttgagcccaagagtttgagaccagcctggacaacatgacaagaccctgattttatgaaaaagaaaaaagatgtaatgattgaaagcctctcaaatctggggaatgtagatatccaaacccaggaagcccaaagaacaccaaataaaatgaacccaaagaaatctatgttcagatatgttattatcagactgtcagaagtcaaggacaaagaaaggatttttaaagcagcaagaaaaagtggattgtcacatacaagggaatctttataagataatccacagtttttagcagaaaaattgcaggacagaaaggagtggtgcaatatattcacatcctaaaagaaaaaaaatactgtccatcaagaatagtatattcaacgaaactgtccttcaaaaatgtaagagagataaaacctttcccagacaaacaaaagctcaggaagtttaccaccactagatttgactcgcaagaaatgctaaagagttctttaagttgaagcaaaagggaagcaagatagctgttgtattagtccattctcacacttctagaaagatactatctgagactgggtaatttataagcaaaagagatttaattgactcacagttctgcatggctggggaggccttaagaaacttacaatcatggcgcaaggcaaagaggaagcaaggcatgtcttacatggtgacaggtgagagagcaagcaaaggggaaatgccccactttaaaaccatcagatctcatgagaactccctcattatcaagagaacagcaagggattacatgatccagtcacctgccaccagttcccaaccttgacacatggtgattacaatttgagatgagatttgggtggggacacagagccaaaccatatcagctctcttagtccatttttctgttgattgtaatagaatacttaaaactgagaaattcataaagaaaaggaatttatttattacatttatgaaggctggggagtctgaggtctagggaaggcatttggtgagaaccttcttgctggtagggactctgtggtgtcccgaggtggtgcagggcatcacatggtgagggagcagagtgtgctaatattctagctcaggtctttcttctcttatacagccactagttctcctcctatgatgcttcattaattcattaacccattaattcattcattaggacagagctttcatgattgagttacctcttaaaggctccacttgtcaatactgctacattggagattaaatttctttttttttaattatactttaagttctagggtacatgtgcgcaatgtgtaagtttgttacatatgtatacatgtgccatgttggtgtgctgcacccattaactcgtcatttaacattaggtatatctcctaatgctttccctccccccttcccccaccccataacaggccctggtgtgtgatgttccccttcctgtgtccaagtgttctcattgttcaattcccgcctatgagtgagaacatgtggtgtttggttttttgttcttgtgatagtttgctgagaatgatggtttccagcttcatccatgtccctgcaaaggacatgaactcatccttttttatgactgcatagtattccatagtgtatatgtgccatattttcttaatccagtctatcattgatgggcatttgggttggttccaagtctttgctattgtgaatagtaccacaataaacatacatgtgcatgtgcctttatagcagcatgatttataatcctttgggtatatacccagtaatgggatggctgggtcaaatggtatttctagttctagatccttgaggaatcgccacactgtcttccacaatggttgaactagttaacagtcccaccaacagtgtaaaagtgttcctatttctccacatcttctccagcacctgttgtttcctgactttttaatgatcgccattctaactggtatgagatggtatctcattgtggttttgatttgcatttctctgatggccagtgatgatgagcattttttcatgagtctgttggcttcataaatgtcttcttttgagaagtgtctgttcatatcctttgcccactttttgacggtgttgtttgttttcttttcttgtaaatttgtttgagttctttgtagattctggatattagccctttgtcagatgagtagattgcaaaaattttctcccattctgtaggttgcctgtgaggagacattcaaaccatagcaatggtgaagtaagactcttcagtgatagtcaccctatacaagtcaccataatgtagaatcagtgggagtgctaagcttgttttgctgcaactatatggtcccatctgggggtgatggatcatcaggaattagattagtgacagatcatcaggaattagatactcacaaggagcatgcaacctagatcccttgcatgtgtactttacagtagggttcacaatccaatgagaatctaatgctgcagctgatctgacaggaggcggagctctggtggtaatgcgagtgacggggatcagctgtaaatacagatgactcttcacttgcttacctgccattcacctcctgctgtgtggtctggttcctaacaggccacagactggtactgtggccagggtttggggaactcctgctctagaccaccttggtgtcatgaaaatccacaacaccatccaatgggctgaagttccagtctgcattaccactggttaactacagtggcctcaagcccccactaatcctcagtggcaggcgggctgtagctactgaaggccttagcatgtccaggtgccagacaggaacccatggccatggtggaatgaacttgagttctggcctgcatgaccgctgaccgactacagtgcccttaggccctgaagaaacctcagtggcaggcagattatagctgctgcgggccttaggcatgccctggtgccattctcatcttagtagcagtggactttgggtataagttcagcaaccagaagataactcatgtctccctttttccaacaccaggcagcacagcacagagagaaaaatcattcacttggcgaaggaaaggaaagtataagcatagaggtttgctgtagaacccagtatagtgcccaccacagtaaaactcaatatctggcagatccctccccaccacagctcctgactctagactgatatgcacaggcagagcctctagacctgccctggtgtcagttaggaacccatgggccccagcaaagcagactcagaactcaaccaacatcacttcttgcctacttcagcagccttgagaccagaataaaccttagttgcagtgcttaatatcactaatcattagggagatccaaatcaaaactacaataagctaccatctcacaccagtgagaatggctattactacaattttttaaaaataacagatgccagcaaggttggagagaataggtaacacttgtacactgctggtgggaatgtaaattagttaagccattgtggaaagcaatctagaggttttccaaagaactgaaagcagagctaccatttgatccaagagtgtcattgctggatatatagccaaagaaattataaattgttctaccataaagacacatgcgtgtgtatgttcattgcggtactattcacaatagcagagacatggaatcaacctaagtgcccatcaatggtggactggatgaagaaaatgtgctacatatacaccatggaatactacatagctatttttaaaaatgaggtcatggccttttcagcacatagagggagctggaggccattatcctaaccaaattaacacaggaacagaaaaccaaatactccatgtgctccttataaatgggagctaaacgttgtgtacacacagacacaaagaagggaacagtagacactggtgcctattttagggtggagggtgggaggagggtgaggattgaaaaactacctatcaagtattatgctaattacctgggtgacaaaactatttgtacaccaaaccctgataacatgcaatttccccatgtaccaaacctgcacacgtaccccttaaacctaaaataaaagttgaaaagaataaaaaaaatgttggttttttaaaaatataaacaaaattggtaaacttttagctacactaagaaaaaagaatgaagaccaaataaataaaatcagagatgaaaaaaagttacatctgataccacagaaattcaaaggattggcagactcttatgaacaattttatgccaacagattggaaagcctagaagaaatagataaatacctggataccaaaaccaggtaaggacataataaaaaagaaaactacaggcaaatattcctgatgaacatagatgcaaaacgtttaacaaaatactcaaccaaattcaacagcacattaaaaagatcattcattatgaccaagtgagatttattgcaggaatacaaagatggttcaacatattcaaatcaacaaacataatacatcatattaacagaatgaaggacaaaaaccatatggtcattttaatacacggagaaaaggcatatgacaaaagtcaacattcctttatgatataaattttcagtaaattagatagaaggattgtacctcaacccaataagggccacaattgacaagacccacagctaacctcatactgaatgggaaaaagttaaaaactttttttctgacatccggaacaaggtaaggatgtccactcttagcagtcctatacaacataatactggaagtcctgaccagagcaactaggcaagtgaaagaaatataaggcatccaaatttgataggaggaagttaaattgtccctttttgctgatgacatgattttatacatagaaatccctaaatactccactaaaaggcttttagaatttataagtgagttaagttgcaggttataaaatcaacatgcaaaagtcagtagtatatgtatatgctaatagtaaattatttgtgaaagaaataaacaattctatttaccatatccattaaaaaaactgggaataaatttaaggaggtgaaaggaggtctctacattggaaattataagacattgataagagaattgaagaagacacataaatggaaagctatcccatattcaaggattaggagaattaatatagttaaaatatttttaccactcagtgtgatctatagattcaatacagtttctatcaaaataccaataccattcttcacagaaatagaaaaaacaccacaaagtttgtatggaaccataagagactctaaataaccaaagcagtcttgaccaaaaagaacaaagccgaaggcatcacattacctgacttcaaagtataccacaatgctatagtaaccaaaacagcatggtgctggcataaaaacagatacataggctgatggaacatattagagagcccaacataaaaatccacacatttacagccaattgatttttgacaaatgtgccaaaagcttgcaataaagaaaggaaagtctccttaataaataatattgggaaaactgtatatgcatatgtggaagaatgacatgagacactcttttctcactatattaaaaaattaaaatagattaaataattaagtgtaaatccttaaactattaacctactggaagaaaacaggggaaatgcttcatgacatgggtatgggcaaggagttttttgaataagaactcaagagcacaggcaacaaaagttaaaatagacaaatgagattatatcacacacaaaaatgttcgcatagcaaaggaaacaacagagtgaaaagacaatctacaagtgaaatgttagttatagaaaaataaatatgttcttactcatattggagggttaaacagaaattctgctcacagaattaaagtagcattgtcgttattagaaactaggaagagtagaagtcaaggagaagaaagggagaagttggttaatggacacaaaattacatctatatggaaagaatgagttttagcattctgtagcactataggttgaatatgattaacaattatttagtgtatatttataaaagctgaaggagaagattttgaatgttcataacacaaataaatgatgaatatttaaggtgatggatatgctaattatcatgatttggtcattacacattgttcaaatgtaaaaaagcactctctcttataaacatgtacaattactatatgtcaactaaaaagaaaaagaatgacacatgtcaaatttttaaaaaccctatgagaggagtaccattacacatgaaacaattaaggcggaatatgaattaacttacccaagatcgtgttgcttgtaagtatcagaattagtgttcaaacctaggcaatgtggctcagagtcaatgctcttaacaatcacactataagaacagatataataaatatctacttacctggaggatataaattctatttttattccgagttctgaatcaaaatggtaattcaaaggcaatgagaacattaacctcatcaccatcatttaggctcaaaagaaaatggtacatattctattgcaaccagtcaggattaattctcaaatgtatgaaacttgaagagggaggacaatgcaaaggaaaccgtacttagtagcagaatagttattactataagcagacttcaaagtatgttggacaaaccatcacttatgctgaaagtgacaataaaagacttgggaaaaaaagaccacctacagaatgagagaaaatatttgtcaactatacattcaagagtataagggactcagacaactcaccataaaaaaccaaacaacccagttgaaaaatggacaaaatagacatgtatatgcacatgtggaagaatgacatgaaacactcatttctcactatattaaaaaattaaaatagattaaataattaagtgtaattcctcaaactatgaatgacaagagacatttttcaaaagaagacatattataaatggccaacaagtatatagtgaaatgctcaacatcgctcatcatcagggaaatgcaaatcaaaaccacagtgagctatcacctcacctcatttagaattgccattatcaaaaagacaaaagataataagtactggtgaacatatggagagaaggtaatgtaaattggtataaccattgtagaaaatagtatggagattcctcaaattaaaaatagaaataccatatgtgatccagcaataccactacttggtatataactaaatgaattgcagtcaatatatccaagagatatctgcattcccatgttcgtcacaacattattcacaatggccaagatatggaatcaatgtaattatccatcattggataaatagataaagaaaatatggtatatattcacaatggaatactattcagccatataaaatgatgaaatcttctcattcgcgacaacatggatgaacctggaggacctacgttaagggaaataagccagaaacagaaagacaaattccatatcatctcactcatatgtggaattttaaaaaattgattacattgaagtagagagaggaaagttacttaccggcagctgaggtggttaatgaggaggaatggatgaggacatgttggtcaaagaataacataattacagttatgtagcaggaataaattgtaagatatctaatgtattacaaggtgattataggtaatgatatattgcactgttgaaaaatatagagtgtagatgttatgtgatcttatcacaaaatgataactatgtgagggaatgcttttaactataataagtttaaccattccacaatgtatatatatttcaaaatactgtgttatatgtgataaaaacatacaatgttatctgtcaatataaaagaaataaactttttaaagactgaaaaaataccgaaattgaaagaaaagtatgttaaacagcaatgcaatagcagaaggaagtgtgaaacttaggccagacatggtggcttacacctgtaatcccagcacttgtgaggccaagccaggcagatcacctgagattgggagtttgagactagcctgaccaacacggagaaaccctgtgtctactaaaaatacaaaattagctgggggtggttgcacatgcctgtaatcccagcgattcgggaggctgaggcaggagaatcacttgaactcgggaggcagaagttgcggtgagctgagattgtgccattgcactccagcttggtcaacaagagtgaaactctgtctcaaaaaaaaaaatgtgtaaaacttattgctaagggtaaatatacaaacaaattcagaatactgtagtgtgagatgatgatgggtacatcacttaattctattaggacagtgcaaaagtaattgcagtaaagtaattcaaaggatacaattagtaaaaataactctaactgaaaattatgttagaagatacaccatataagtagatgaaaattgtgacaacaatactataaagtatgtgttaggggaagagaagtttaagtgtagagttttggtatactattgaacttaaggtgttattgcttaaaatagagcattagattttatgtaagtcctaaggtaaccacacacacaaagaatgcctaagaagttacacaaaataaaaagaaatcaaagcatatcaataaaaaacataaaggaagacagcaagagaggaaaggacagacaaaagggttataagacaaacagaaaacaactaacaaaatggcaaatcattccctgtcaataattattttaaatgttaataaattgatctccccaatcgaaagatacaaagtatctgaattgatttagaaaaataaaaaataaaaaacaagacccaaccatatgctgtctacagtaaactccctttccatttaaggatatataaagactgaaaaacatgtttcatgcaaatgataatttatgcaaatagtaaacaaaagtgaggagggatggctattattattgcagacaccatagactttaagtcaaaaattatcatgagacaaagaaggacaataaaaaggtctatccaccaagaagaaaataatgattataaatatatacacatctgatatcagagcacctaaatatataaggcaaatattgtcagaactgaagggagaaatagatagcaatgcaatcatagtaagagacttcagtactctactttcaataatagacagattatccagatatattaaaaggaatcagcgggcttcaataacactatagaccaaatggacttaacatatatacagaactttccacccaacagcagcaagatatacatttttctcaagcacacatggaatattctccaaaatagataacacgttaggccatgaaacaaaccttaatacatttaagaagattgaaatgataccaagtatcctttctgaccacaatgtaataaaactagaaatcaatagtggaagaaaactccaaaatgtataaatatatagaaattaaacaatacatccctaaacaaccattgcctcaataagaaatcaaaaaagaaattagaaaatatcttgagacaaaaatgaaaacacactctaccaaaaattatgggatgcagcaaaagcaatactaagagggaagttctagcaataaatgcttacattaaaaaataagaaagacctgcaaacttacaactttacctcaaggaactagagaagagcaaactaagcacaaatgtagtggaaggaaggaaataaacattagaggagaaataaatgaaatggataaaaaaatcaacaaaactgagagttattatttgaaaagatcaacaaaattgacaaactcagctacactaagtaaaaaagatttaaaattcaaataaataaaatcagaaatgaaaggagtgatttacaactgatgccacagaaataaggatcataagagactaataagaacagttatataccaacaaactgtataatctagaaggattgagtaaattcttagaaacataaaacctgccaagacaaaccatgaagaaacagaacgtctaagaactagtatagagattgaattagtaatgaaaaaccttttaacgaggaaaagctcaggatggcttcactagtgaattctaccaaaaatttgaagaaataacatcagtccttaaattaaaaaaaaaaaaacaacttgaaaaggggaaaacattgtcatcagcattaccctgacaccaaaactagacaaatatatcacaagaaaataaaactgtaggtgaaaattcatgatgaaatagatgcaaaaatcctcaacaaaatactggcaaactgaatccaagagcacgttaaaataatcatgcatcatgatcaagtgggatctatctctgaagtgcaaggatgattcaacacataataataacactttctgattttaagctaaattacaaggctacaataattaatgtagtatgacaattgcataaaaacagacatatagaccaatggaacagaatagagagcccagaaataatccatacatatgtggtcaactgatctttgacaagggtgccaagaatacacagtgtagaaaggataatattttaaacaagtggtattgagaaaactggatatccacatgtataagaatgtaattagacctttttcatacatcttactaaaaacatcaattcaaaatggattaaagacttaaacataagaccttaaactctgaaataaacataggaccttaaactctgaaatatgtagaaaaaacgtagaagaaaagcttcatgacgctggttttgacaatgtcatggctctataaacttaacactgaaagtaactacaatgaaaacaaaaataaacatgtaggacaaggtcaaactaaaaagcttctgcatagcaaaagaaacaatcagcagcgtgaaaacacaatgtagagaataggagaaaatttttgcaagccatgtatctgtaaagcgttaatctgcaaaatacataagaaactcatacaactcaatagtaaaaaaaaaaaaaaaaaaatctagtaacccgattttaaaatgggcttaagtcttaaatagacatttctccaatgtctatactataaagcatgtgtcaggggaagagaagttttaagtgtagagttttggtatactattgaacttaaggtgttatcagcttaaaacagagcattagattttatataagtcctaaggtaaccacacacacaaagaatgcctaagatcaggtatatggaaaagtgcttaatgttactaatcattagagaaacgcaaatcaaaaccaagaatagatactaggatcattattatgtgtatgtattttaaaccgaaagacaccttttgacaaggatgtgaagatattggaacacttgtatggtgggactgcaaaatggttcaaccactatggaaagcagtgtggaggttcctcaaaaaattaaaaatagaactacctatataatacagcagtcccatttctggatatttatacaagagaattgaaatcaagatctcaaagagaaataaatcataatatttttggcaatagccaatatgtggaaatggcctaaatggccattggcagatgaataaacaacatgtggttacccagcccttattagggtggaagagtatcccttcgtgtacctataatacacgtggtatttctacaatggaatacttttcagccttaataaataaggaaattttacagtatgtgacaacatggataaacctggaggatattatgtgaagtgaaatgaccagtcatagaaagacagattcttcactattcaacttatatcaggtatctaaaatagtcatatatatagaatcaaagagtgtaatggtggctgatgggctgggggaggttgaaatgcagagatactaatcaatgaacttaaagtttcagtcaagcaagcttgattgatgtataaactttagaaatctgctgtgcaacattgtatctagagtcaccagtaatgtactatatatttataaatttgttaatagggtagatctcatgttcagtgttcttactacaataaaataaaatattaatggaaaaatcttaaataaaatattaggagacagaatcccaccagcacattaaaaaataattaattatgactagtggtgttttactccagggatgcaaggatagatactattacaaaatccatcaatataatttatatcgctaataggtctaagaacaaatgattatctttatgatgctgaaaaagtctttgaataaaatttagcacccattgtatttccagttttgataatcagatcagtccttccactgggagaattctatactctacaaaaatataatttaaaacatgtcatcaaattattttcagcaaacaaaatttgcaacaattcatcaacatcaaatcttactaaggaaaaacctaaaagacttgtttaagcaaatgaaaatgatctattatataagaacagagatgaagaaaagaataaagaaccacaaacgtgttaaactaaggaaatattttataaaaataataatgacttcttgcagtgtaatatattgagaattatgatacaagttgggatgacgttcactaaatttaattgccaatgtctttatgatggttaattttacacaccaaactgactggattaaggaatactcagagagttggtaaaacattatttttagtatgtctgtgaaagtgtttccagaataaatgaccatttgaattagtaggctgagtgaagaatatctgccctcaccaatgtgagtagacattatccagtttattgagcttaggatagaacaaaaaagacgaaaggtgaatttgctctctctactggaactgggacatctatcctttcctgcttttgaatatcagctcaaggttctcaggacttcagacttttctttcccaggcctctcccacttctctggttctcaggccttcaaacacagactaaattacaatcccagttttcctacttagtcagcttatagagagcatattgtggaacttctaatcctgcataattacatgaaccaatttgcataataaattccttcttatatagctatacagatatatatcctattgattctgtttctctggagaaccctgactaatacagtccttataatttccagaaagtagcacaagtactaatttacattataatttgataagtcatgaaaaatttttattctggtgggtaaaatataataaatgtatgtataatggataagttaatagagtggaaaattaggataagaaaaaactactaaccaactcccttcccaaaaagagggaggacacattaacaaatgggacaaatacaagataagtaggtagctttgttctaaaatatgtcagcaattatattaaatgtaaactgactaaataggctaattaccagacaataatttgcaaactgctaaaacaacaatatgctgttacaagagatacattttaaacttacagatgtagaaaagtttaacgcaaaactgcaaaaggatatagtatgtaaaccataaccaaagaaaacttgtgtaactatactaatatcagaggatacagactttaaggcaaaaacttttttaaggataatattttataatagaaattggttaattcagcagaagatgtaataatcctaaatttgtatatgcctaatgatgacatagatttatagtatacaggtagtgcttactttgcatggtaccacgttaactaaaacatgtgcttatctgaattgtgttttcattttgcatggaatcatgatgtgtgtgtatgtataatttgatagaactaaaaatatttttaaaattggacagaactaaaatgaaaaatactcaaatctacaattgtagttggagattttaacaaacctcttccagtcactgagaaaacaaacaaacaaagaaataattagtgtggataaagaaaattaaaaccacatgattaacaacttaaccaagttgacacatataatacattatgtatatagtactagcagaccacacattattttcaagtgcttatagagtatttgccaaagttgtatatttgctgaaccaaaaaacatgccaataaatttcagaggattaaaataatacacaatatgttctctaaccacaagagaatttagcaagattatcaataagaaaaagataaatgaaaaatcccctaattgtttagtcattaagtactacacttctgaatagcttctatgtcatagaagaaatcagtataaaaattagaatatattttaaacaaaattgcaataacaatgtgacatatcaaaaacttgtgcaatgtagctaaagctgtgcctccaggaaaatttatagtttatattacatttcttaaaaagtgaagaaaagctgaaaatcagtgatcttagtatccaacccagtaagctagataaacagtgaattaaacccaaagaaagtagtagaaagataacaataaagatataatggttaattttatgtgtcaacttgactgggccttgaggtaaccaaatattggtcaaacatcattctaaaggtttaggtgaggatgttttggttgagatgaatatttaaatctgtagactgagtgaagcaggttgccattcctaatgcgagtgggtctcatcaatcagctgaaggcctgaatagaacaaaaaggctaaccctttttcaagtaagagagaattcttcctgcctgactgcttttgaactgagacatcagctttttcctgcctttggactctaactgaaacatcggctcttcctggttcttgagcctgctgaccttcagactggaactataccattggttctcctggttctcaggtcttcagactcagactggcacaccatcagctctcctggatctcctgcttgccagctcaccctgcagatcttgggacttgtcagccttcataatcacgtgagccaattcctcataataaatatctttttctatacatagaaaaacatctcttggttctaatttttcggagaaccttaattcaaaagatgagagcggaaattaaaagaatagaaaacaaaaatttagtacattaacaaaacagttatttgaaaatactaacaaaattgatgcatctctggcaagtctgatcaagaatgaaagagaaggcacaaaaaatcacaaccaatttatgctccccctagtagtacagttggtttaacttttcagaatcagtcaatgcaattcacagaaataaggagaaaaatatatggcaataaaaatagctaataagcagcatttaataaaatttaccttctcttcattataaaaatctcttggtacactagggaaagaaaggaatttcattaatatgaactttgttaattttcccaaagctatgaaaacatcctccttaatgatgaattaatatttttcctcctgaaatgataaatgagacaaagatggctatgatttattcctttaatttaacattgtacagctattcacaatattggtcattagatgagaaggaaatggaactcatatacattttgtgaaaatgaaaacatgaagtggttggtataaccactttggaaaactgcttggcagtatctattaaagttaaacatactaatatcctatggatcaatatacatttaacagaaatgcatatatgtatttaccaaaagatatgtacaaggttgttcatggcagtattattacatcaactgtaaaatgaataaattaatttgtggtagtgccatagccaaacaatgaaatgctattttaataatgaaattaaattaactaatgctacaaatataatagaaatagaagcaagaaagagagcaatatgtattgtataattctacctgtctaattcgaaacaggtaacagtagcctatggtgttagaagtcaggatagtggttatttttagagaggagagtgggaatattaactaggtaagagtacgaaataggcttctgtgaatggcttgtattgtttttcttgtattacttgtcttctattgtgttttttaacgtggattgtagtttcatgggtatgtttacttcatcataattcattaaatatacatctataatctgtgtacattatatatatttcaacaaaaatatttattttaaaattaaacacctattcctaataaaagaaatgtataacatataaatcaatttatacttctttaaatctctctctctctctttctatgccctctccctccctccccagaattcaggatcttatttaatggggaaacactagaggcatagccaccaaagtcaggaagaaggcaaggatgcttagcctctctactatttttaatactctaggatgatttttagcaaagcagttagataaatacaaacaattagagacataaaaattagaaaaaaataaagtagtctctattttagattatatgataatatatctggaatggcaaagagaatcaaccttaaaatgaatacaaacaaaataatttagaaaggtgtatactaaaatctaactatagaattaataccctattagaaaaggtaatgaagagaagaacccatataaaatagcaataagaaagttaaaataactaggtataaaattaacaagaaaatcaatatgtggaaaactttcaaacttcctaaaagatataaacatatactcgaataaataaaaggtggtatcctttgctcttgaataaggtggctcattatttttaattctgctttctgagatttacttttttctttacttttcaaagtcaaatgcttatatcattaaaacattttcagtttttcttctctacgtacatatttacaaaaccataaaatttcctcttaagattcatctgtgtcttgtgaggcatttttgttcagttctgttttatatatttcattatgatttcttctttgcttattaattacctacagatatattttttagttttcaaaatatttttgtcatgacttctaattttattttactgtggttagaatataatatctacaattttgattttttggtatttaacaattaatttgttattcaccaaatacctatttttttcagacactagtgtaggttctaatgatatcatggtgaagaagtaaccctacttctttgcctttatggtacttgcttctattgtgagagacattttctgtttaaaaaatatgtatatataatttgtggtttgggcattgttcctgttttggtgtggtcaaatattgcagagtgctcttatttttgtcttggttcctcatggtcacagagtggccttgtctaatgtctcctggatgtcagggggattcttttctcttttctaattctctaactgattctaatatcatgttttctaaatcataatcttgtatacttatctcaacagtttatggtgtttttgaggttcagtatgttatattttgtgatttactggggctattgctagcaatgttttataagcaaatcaacttttatctttcagatatttactttaataaaatataatagtgttttaggatattattttattaaatcttggggctcaaatttagaaagattatattattcattttattgcttaagttatattttctaaactttttaggctaatgaatctccttgccaatatctccttgccaagagtctcatacactcaataaagttggttttattggctgggcatggtgactcatgcctgtaatcctagcactttgggaggccaagaggggcagatcacttgaggtcaggagttcgaaaccagcctggccaacgtggtgaaaccccatctctactaaaaatacaaaaattagccaggtgtggtggcagatgcctgtaatcccagctattcaggaggctgaggcacagaatctcttgaacccaggaggcggaggttgcagtgagcagagattgtgccactgcactccaccctgggtggcagagtaagactctgtcctctgtctcaaaaaaaaaaagaaagaaaagaaattggtttcatcgttcatcattttctcttgtatgtaaaaaaaatcaatttgaagttaaaacatatcttagtacacttagtacagtcatatcaattttattttaagaaatattactcaaatatgtatttagttttgacattttcacttagcaagtcatatatgccatttacttcaagttaacatgtaaaaagctcaattttttgtcatttttaacatttattgtgtgtggtttaataaccaagcatttttgttatagcttcaaaaataaatgtatattgctttaatgaactgatatttgaaaccttttgtgtttttactgcgaaaactactagctggtttacttttgttattttttgtgtctcattgtaagatgtcgagataagtgataaggtctcaggatgctctgcaggcttaggttatcaccaccactatattttctgttcttaccaatggttttttgaagttattgatacatctttatccagtgtataagaattttcatcagaggaatactactaatgtatttgaagaaaatcatcttaaggcaaatctgtcagaaatatatcattattttaacattggctatttttatccttcctcttattttttttccctaaccaatgataggttaaattttctgtcattggtaacaaaaaaataggaaggatacaaataataattgtgaatcatttaacagcaaaagttatcagtatggctagcattgtttagcttaatgactgagtcttaaagatgatcatattataatcatgatatgttctaaaattcttctattttaaagaaatattttattaatcatcttatttattgatttaaaaataaatattaatctttttaatgacgtgaatctctagaataactttataatcttcagagggttcataaaacatcagtttaaaatattgaattcggtcaaagagaaaataggatttggtagaagaaatttgaagccaaatttgaagccacatttctcaagtgcataggactgaatggcatatacatagttcattaatcttatcccatttcatgttttatttcatcttcgttttctatcccatttttcttttcttccaattttcatacttattttatatcatgtcatatatatttatattcttccttatttcctctttgaaattaggtgatttattggtaagtgttcatattgaagcagagtttgccattttttaaatgtagaaaacctatattcaagttctagaaaaatttattctaaataaggatgttatgtggtatgattttactttattaacattaaactttatttgaagcaagttaaaattaatgttagaattaagaaaatgattgttctaatgttttccagctgctaataggttatgaaaatggtactgtagtattctgggacttgaaatctaaaagagcagaactgagagtttattatgatgaggtaagtgatttctaccgacatgtttgaaagagtattgtgacgttatgcctgtttactacttttaagctttgcactttaccagtatgtttagccttggaaagttgcctgattctgacccagtgcttcacactgtcttttagtatttgtgtaagttccatctctagatttttcttttaagaggaaattctgccttgactgcctatttcggggccctcttgtggcatcttatatactttgcatttgttaatagatcctgccttgtcaatcttatatacttgggtgcctgtcacctgtactatatccccaactttgtctcaactgcttttcctttctgtaggctccatgctacgttgtgcctcattgtccttaaggtctctaaagacactattcacaccttccttagaaaattccttttcagtggcaagaagttcaagtcagtttgaaaggtcttgtcttctaatacttgccttcttagaataaagaaaaattttgtaaatagtaatacttattaagtgaccagatattaataagtgacacttattaaatgaccagatcttgaagtaagttttattgtatgtaattgagacttgattaagtttgtatttaggggaagcaacaaactcctattcatcaaggaataatctcccagttgacacttcagttgttcaaatattaattccgggccattaattatttttccattcagaagaggctaataagaagaccgtaaaactgggggcaacagattaaaagggaaattaccttttgtacctgtggaaacaaaggtgatcatctgtgctattaattcaatttgaaaatggtgggagtaggaagagataggaggaaaatatatgtcaaaaatttatgtccagtaaaacctaatcttatataggaaaagtgccaaataatttaaagcagcactgaaataattagaaaatgaaacacacacacatttattttagaacacttccttattttatcattggagggataaaaaaagtctccagatgaacctgtagtcaccctagaatactttacatgttctctcccatccccctcataacagttaattttttaagtttcggtgcttaaagatataagccttcacctatttcataagctgcacaattcgttatcagtcattctcatagtggtaaaaaaatgtttagaaataaaataaaatggcagctgggtaattttttcacaattggtgaaaaataatctgataagtaatatcatgcagttatgttctttataatcaaattcttcagcatcttgaatcataagaaaagaaggtcttagggagctaagctaggagtttccttttgttatacaaatcataaagatggggatggatagtgctccttctcttccctctctcaacactagcagctaaataagaatacaaacaccatgggaatatttagccagttggaattagaataaccagctcaaaagaaaacccagaggaaaatgctgaatcatctagctttcctatggccttaaaaagtatggaagaaacgttttgagccttaaaaagagagtaaaatttcagtgaaattttaaaataaggatttgcagctgccttagtacaaatatatgtaatttatacctagaagttattgacatctgatatatgtatgtaaatatatcatctttatctactttaatgtgtcattatatgctctattgttttaacagagatagttaaatacttcatttcactaccaaacttttcagcctctcctcagcactttacctctcatatctagaaagcatgcttaatacttacctgaaatgttttttcttaagtcaccaataagctcttcattactacacacagtgacctcttccaagcctttaaattcctcactaaacctgtggctttacctcagtttctcctccttaaaataatttattcacttgtctgtgtctttccacctcatttatcatgcacctttttccataactgatttttcccttagctctcctttacgttattgatattcttcaggatattatgtctttaccctcatttcttctctctctaatttatactttctagtgtttatattatctcttatttcaaatattacctttatgctaaaaaaagaacatccatatatctgtagcctttacctccctcttgaactctagatctaaatatctaacaatatattagataaatccagcaaaatatcccattggcactgaatttgtatttaaatatctaaacctccttctatgttttcttctggtttttaagtcttgtttagttaattcagtttagacccctcaaagtaatatttgtctcttccatcatcgtgttgtatatgcaatcaatttctgcaggctttctgattctgattttatattgtctcatttatttcctcttttctaattcccacttccaatgtcctagtttaagttgttatcttttgcctggatgactataagagcattttaactaatcacaaccacttttcctttgatgtcttacctcttcaatatatccttcattaacaagattatcattttaaaacagattatggaattctctacaacagaacctttgaatagctctcaattgtcgacaatacacagtccatattgcttgacttgagatttaaggtcctagtgctatcattcctctttagttaaatttacaacatccttctacacattccccacatttcagacatattactcactatcttccatatataacacttattgcttatctctgagcctttgctccttctaacttctcatcatgaactgccttctttcctcttctgtatatcaaaattctgttaggtctttagcccctgtaaaactatttagacaatttaactagcctcttcataaatagccattgatgaatggatattgttatccagttttttggatttccttcttctttcatgtgttcaagaaactcagtctcagccactgagttgataaaactagctagtattttatgtttaaaattctgttttctatctcttaaaattctttttggattagttgtattatatttgtttttttcagtaagccctctgagcccccctccctttttttgagaaaagagaggggtagaatctaataaatagaaattgaatatttatccatcaagttagatcaaatgctagctactcagtaatgcactatatgagaccctgatctctaataacaagttggttttacatgcttgcttttctaaacaataaatatacttctttaatagtactgacttactttggctttatttagctattgtttttatatctgtcctctccagtagatagaaattcagtgaaataagaaagtttagggttgagagtgccttttctgcctccatctttgatggcaaaacagtttgagacaactttaagttaaatgaggctcatcaaagttaacatgtaggggaggcaagaagatgtgactttcccttgaaccacctacagaagggagaagaaataagcagaggagaagagaaaaaaagtattttatctctaacttcctctgctggaccctagcaaaaaagaaatctctgcttagtaatgaaggccacagagtgagagaaaacacaagtccaggatttcatgttgctttttccacttaatcaaatcttattttcttgattatatgtgtaataattactttagccatcagttatctgcaactctaataatactgattgtttagaacttttatcagttatgtatgtgtaacttagtttggaaattttagttgtatgtgtctgtgtgtgaagtttcaaaaaataaatatgattagtattcacttatattaatcttctctctcttgctgttttataagtgtctttaaggaaaagatgttgtatgcttcttttctgcctttatgtctactagaatttttcttatagtacttagtactttacccaagttctgtatgtactttattaatttagaaagaataccaagggtgtggaaatgcatatgacattaattactaattcagtcaacagatatttattgagtacttactttatgctggtcactatgctagcattgggaatacaatagcttgggaaaatgaaatacagtcagccctccgtatccataaattccatatccttggattcaactaactataataggaaatattttaaaaacaaaaaataattttaaaacaatataataatttataataatacaaataaaaagacagtatagtataactacttacatatcatttacattctattagtaatctagggatgattttaagtatatgggaggatattcataggttgtatgcaaatagtatgctgttttatataagggacttgagcatctgtggattttagaatctgagggagtgtgggagttctctaactaatccccagtggataccgagggatggctgtaattacttttgaatcttatctgactcaaaactacagagttaacctgaaaatataaaagaaaatttaaacctttcttgctttaaattgatttaaatagtatatgcaagagggcaatacagtgcaatgattgagaacgtttttcgtagttagaccttggttttgagttctgtgacttgagcaagtatctcaatctctcaaggcctgtttcaccatgtgtaaattgaaaaatcaatacactttttataggattaaatgaaataatgtgtataaaatgcttgccttggggtttggcacatagaaagccttcagatggtagctcttacttaaattattcttttaattggctatgtgaggaggaaataggacttcatcttaccagaaattatagtctgatatgggtcagaaaaattatgttttttaagtgttgttagtataataattttatatcagaatagtttttctttggaatatagaatgatataacctatctacttttttccccctctacttgttttaattgttattttattaggctattcattcaattgattggcatcatgagggcaaacagttcatgtgcagccattcagatggtagtttgactttatggaacctgaaaagcccaagtcgccctttccagaccacaattccacatggtaagatgtatgctttcaaaaggaataaacactggcaattcagtgccttgacttgaagtaagagagatggtattaatgcgtttggtagaaaaaagtaataggacatagcttctggttctaaacatcccttttataccacctacagatcccaacattgtaccccaaactttccatacttcccttcttcctaccaacccacatccctgttttgtaagctgtagttatgtactgtcccaaccaaaaattggataatggatggttgatatatctggggcagaggagataatataggaaattttgtcacttttaagggctgaggagccagtgagagaatggcactatttagatgtgactttcagagttaattcctatactactttatagtctgttgttttctagattctcccacttgtttccatttctgccatttgattccagtaagttatgaagactgtggttttaattttaggttttacttttcttattgccttccacattgagaagagcattttaatcctaaatgaggattttaatcttaattgaggatttatattggatctgtatacctaatggggaagaataagcaattcaaatgtataaatatatataattcagatgactaaattatttgataatattggtgatgatctgagttctatgtttacctcatatcattgattatttgtaataatagatatgtcagaaactaacagttgatcaaacatattctatgttacagtttctgagcgttcgttatcatgtcacatttggaaagtagtggtatgttttctgtaatgggtgacccatagatcacaagcattcttagaattatttcatgctgtttgtctgccatttttttgtaccatagttacatgctccatcagtaaatgatcaaattattgcaacattcttccaggatgtaaatgttttagtctttagctggtttacttagagattactttacatttagatgcttacttagagatgctttatttagagattgccattacagaaaccttgggtagatattagctatacataccactcaggattaactatttatttctacgataggggataagttctgtccacacacccccagctaacccccaatactcatgccttttatatgtaaaagtataatatgagctagtcataaattttctacttacttccttatgttcttctcaaatatcagtttctattagttcttttggctagactggacatttgatacttttattttttttaccatatccatatttatttcatcagtttggattgttttctattattctgcttttctgttgaaataaagttctgtttacaggttgttcaacacatcagccttgatgtcttttataacatataaaacaggaatagattatattcctgttgcctcacaataacataagcaccagtgattttgataatagaggcatttattgtcatctattgacattctttgggtttatttttttcccttttgttttagccatttttattttctaaaataaaacttttctctaagtaccactttagatatatcctataagtctttaaatgtaatattattaatcatatataattttcattaatatttagtttgagatattttctataattcctattataattctcctttgacccattagttatttagacatgtgctttctaatttctaaacattttcatttttattatttgtgttattattattaataaaagatgggtcttactatgttgcccaggctggtcctaagcttctggaggcctcaagtgatcctccctctttggcctcacaaagtgctaaaattataggtgtgagcaaccacacccaacctcaatttctaagcatgttttttatgatggattttaaaattgtagccagagaatatgacataactagttctacaaaatctactgagatttgctttataatcagtgcagagccaattaccatagcattctaagtgtgcttgggaagaatgtacattttcttttttttttttttttttttgagacggagtctcgctctttcgcccaggctggactgcagtggcgctgtcttggctcactgcaagctccgcctcccgggttcacgccattctcctgcctcagcctcccgagtagctgggactacaggcgcccgctaccatgcccggctaatttttttttgtatttttagtagagacggggtttcaccgtgttagccaggatggtctcgatctcctgacctcgtgatccgcccgcctcagcctcccaaagtgctgggattacaggcgtgagccaccgcgcccggccgacattttctaattgttacataaaggtcaaacttgaaattgtgtttttcattttgtatggtttaaattgttgctaattttttgttctgatatttcaattcttagagaagcgagttaacatttctcttataatggattttcctttgtaattctgttcatttttgttttatgtattttaaaaaacaaataggtcagggtagttgatggtgttttccagattccctgtaattgaactgatacttgtctagtgctatcaattgctgagagagtgctattaaatttcctaatatgattatagaagtgcacgcttctcagtttaattctgcccatttttgctttatttattttggggatctattattaggcatccattacatatcctataaagagcatagtccaccttttgtatacacagattcttcacccaaagattcaacaaaaccaaagatcaaaagtgttctgagaaaaaaaattaaaaatacaaaaatttaaaataatacaaataaaaagaaacaatacagtatcacaactatttgcatagtgtcacactgtattgcatataagtaatctagagatgatttaaagtatacaggaggatgtatgtagattatatgcaaatattatgccattttatataacagacttaagcatttgtggatttgggtataggagggggagtcctggaatcaacggatactgggaataaccatagttgagtcttgtgcttttatctagtcagagttcaatctattaatattaaatgtaagtactgatgagattgaattttggcctaccactttattatttgttttgtgggtcccgtcatatttttccctctttcctctttttgccttcttggaggttatttcaatattttctagtagaattccattttaatttaaatattaatctaagcattttattttcacatattttttattggttgctccagggattacaatatacttccttaactattcaaagcctattagagctaacattgtaacacttcacataaaatttgcaaatcttgtaaccatgtagatctatttctcttcccctactgtcctttacgctatggttatcatatagtacatccaaatatattgttataatttttgctttaaatcatcatgtctttttttaattaagaggaaaaacagtcttttgaattttctttgctatttatcattttcatttgttcctgaagatacaagaacattatttaatttttcttgtaggcctagtggaaatgaattcacatagcttactttatctggaagttcagttttgttttgttttgcttttgcttttttttttttgctttccttttttggaggccatttttcctggatttagattcctgaagtgacactttgtgtgggcatgtgtgttttggttttaaggtgatgaacactttacatgatcttctgccttccataatttctgaatgaggaatctgtagtagcttgaattttgcttcctctttatataatgtgtcacttttctccaattgctttcaaaattttgcggggtatcttttattttcagcaatttgactactttatgtctaggcttggtttcttcaagttcattctgttaagggttctaccaagattctcatatatatatatatgatatataatttgctggatcatcagctgttttactcaagattagcactgttgatggcattgttcttatagctggttgctgctgttgctgcaaacatcgatttttcctattcaatgatttcaaatatgtatttatggtttcaaatgtgtatttttcaattgcagtgctaccagttacatatgcaatcatacacacatacatatacaacacatatctatatatatgacattaaaccaaatcctatcaaatacttaatagtgaaaattttgctcagaagcaggacaggggtgtccacaattaccgcttttatttaatattttcctggaaatactagccaatattattagacttgaaaatgaaatatgatatttaaaaatttagaaagagtattcaaaattttagtttcttatgatgcaattagacaacacaaaacaaaaatgaattaggaaaactattacatgtaacagtagaattctgtacacaaaacaaacaaaatataatggatgaatagaaccattttagatcacagcacccacaagaatacatgggaataagccttaatgtacatgtgaagtattatttctaatacagaacatacaagagaaaacttgaataaattaaaaacatatcatatgtatgcatactaaattcaatggtatgaagacgttgatttcccacatattactttgtaaattcagtttgttcccaagaaaaataattacagggttttccctgacaaaaatgtgcaatggggaaagggttccctatttaataaatggtgctgggaaaactggctagtgatatgcagaaaactgaactggactccttccttataccttatataaaaatcaactcaaggtggattaaagacttaaacgtaagacctaaaaccataaaaaccctagaagaaaacctaggcaataccattcaggacataggcatgggcaaagacttcatgactaaaacaacaaaagcaatggcaacaaaaggcaaaattgacaaatgggatctaattaaactaaagagcttctgcaaagcaaaagaaactgccatcagagtgaataggcaacccacagaatgggagaaaatttttgcaatctatccatctgacaaagggctaatatctagaatctacaaggaatttaaacacatttacaagaaaaaaatcaaacaaccccatcaaaaagtaggcaaagaatatgaacagacacttctcaaaagaagacattcatgcaaccaacaaatatatgaaaaaaggctcatcatcactggtcattagagaaatgcaaatcaaaaccacaatgagataccatctcacaccaattagaatggcgatgattaaaagtcaggaaacaacagatgctggagaggatgtggagaaataggaatgcttttacactgttggtgggagtgtaaattagttcaaccattgtggaagacagtctggcgattcctcaagaatctagaaccagaaatagcatttgacccagcaatcccattactggatatatatccaaaggattataaatcattctactataaagacacatgcacatgtatgtttattgtagcactattcacaatagcaaagacttggaaccaacccaaatgtccatcagtgatagactggataaagaaaatgtggcacatatacaccgtggaatactatgcagccataaaaaagaatgagttcatgtcctttgtagggacatggatgaagctggaaaccatcattctcagcaaactaacacaggaacggaaaaccaaacactgcatgttctcactcataagtggggaattgagcagtgagaacacatggacacagggaagggaacatcacatagtagggtctctcggtggatggggggcaaggagagggaaagcattaggacaaatacctaatgcatgccgggcttaaaacctagatgatgggttgatgggtgcagcaaaccaccatggcacatgattacctatgtaacaaacctgcactttctgcacatacatcccagagcttaaaatttaataaacaataaaacagaaaaataattacagggtttttaaaattagatgagcaaatatgtagcaaagataaacacagtatgaaaattatttaaacaagaagtactggttaattacaggcagtttggaaggtttgatgccctgaatgattcttactgaaataaataaaacgttgaatatatcatgtttttttttttaattttaaatgtcactgagatggtaagcatgagaataaggaatctaaagactccaaaagagaatgttaaactagaaactctgagagataagtgacgatagattttgttctaaattttctgctatactttggagagcttaaactttgttctttaaaaaacaggtttattggggtatagttcacaacagcaatttaaagtataagcttcaatgattttttaatatattcatagttgtgcagtcatcaacacaattcttttaatcgtttaataaatttagaacattttcatcactccccccaaaaaccccatacccactagcagttcatttccatccccactccttcatccctaggaaatcactaatctttttctatctctttataactccattaaaaaatgagtgaaggatctgaatacacatttctccaaagaacacataaaaatggccaacacgtatgtaaaaaggtgctcaacatcatttatcatcaaggaaatgccaatcaaaaccactatgagaaatcatcttacacctattaggatggctgttatcaaaaagaaatcatctcacacctattaggatggctgttatcaaaaagagataacaaatgttggcaggtatatagagaaaatggaatctttgtaaactattggtgagaatgtagattggtacagtcattatggaaaactaatagggtatggaggttcctaaataaattaaaaatagaactaagatagaaacccagcagtttctcttataggtatatacccaaaggaaatgaaatcaccaccctataaagttatctgcactcccatgttcatgacaatattcacaatagccaagatatggaaacagcctaagtgtctgttgactgatgcatgggtaaagaaaccaaggtatttaaatacaatgtaattttatgcagccttaaaaaggaaagatatcctgtcatttgccacaacatagctgaacctggaggacattatgctaagtgaaataagctagacacagaaggaaaagtattgcattgtctcacatgtgaaattttttttaaaaagtcaaatatactgagagaataaaacagtggttaccaggggcaggagagcctgggggagaaaacagggagatgtaggtcagaggatacaaagtagcagatatatagaagaaaaagttgaaatctaatccacagcataaggactaaagttaataaaattgtatttgagatttctgctaagaattttagctgtttttgccaccaaaaaaatggttaaatatgggagatgatggatatgttaacttgcctcactatagtaacatgtttaccatctatgtacattccataacgtcatgttgtataccttaaatatatacgataaaatttacttttaaaaatgaagtgtttcggctgtaggtaaggttaaaaaaagtgtatgctttaaaagtttggaagttcctttagtttatatatgaatgttttttcatcttttgctaatctctgaatgcctccattacacccacattattgaaagatgttttatctgcatatatataattccgcattgggaactattttcccccagcactatgatgatattatacaatgtttgccaggctaccattttattgttggaagtgttcagtcacacaattttcattcttttgtggtgattcatcctttctgtgacttctattacaattttatccgtacctttgatgttttatgatttcattgaagtggtttaggttggacatctctttccttatcctgcttttgttgtaggaaaaactggttcttataacacgaccatgaaatgttaggctcgcagacactttgaagggtgagaagagcagggtttattgggtgaaaaggaaaaaaagggaaacaaggactctcagcaaagcgagagtcctgctaacaggcttcctgtctcacagattggaccccaggttaccactcccaaacagaagaggtcaggctcctccccactgcaaatggtgcgaacttcccgaggctccaccccagtgtgcattcctcccagtgggcaggccggttggagattctccgggcacccctttatacttggcttgtctcattttggaatacattgggtttttttgatttatagatttatattttttatttgttatgaaaagttaccgctattttctctttaaatatcgcccctgttccattctattctcaaatgtattttagacatattaagattttcacttttttttttctttttttgagacagggtctggctctgtcacccaggctggagtgcagtggtgtgatcccaccacagaggtgtaacctctgcctcttggactcaagtgatactccctcctgagtagctgggactacaggtgtgtgccaccacacccagctaatttttatactttttgtagacacaggttttcgaatgttgcctgggctggtctcaaattcttgggctcaaatgatccttcaacctcagcctcccaaagtgctgggattacaggcatgaccaccgttcctggctttcatatatttcaatataatgtttgtttctgtctccttgcttttctgtactgcattctgggtaatttttttcagatataacttctttcactaattttctcttcagctatgtatattctgctttttgtgaaattaattttcttaatttctataattagtttttgtttctaaagttaattttgcagattataattttacatattcataatttgcaaatctaataatcttttggtctttgggataatatcctttatttctttaatcattacatacacatgtcttctatattctgggtcctactattctaatgtctgcatttattggaagtataaagctgtttactgtttctgctgatttttatcatagtgtctaacttccttttagtgtaatgatattgggttgaaaggtcattgctcaatattaatacatagagtaggattagattgaggattttgaaagtttttcagagagagtcttctcttgcttctctgacttacttagagatgaaacgacaaaatatctgcaacttattctcaaatagctcagaagtgaaataatagcatataaagagaaagaatatgataaggcaattgtggaaataaagaactagagaacttgggtaaatgatatagaagagattttttaagtaaattttccttaattctatatcaaaataaaactgttcagaaaaaaaacgaaggagcctaaaaatatgccagactagaattagcagtcttttgaggataccatttctgaaataaaggaggatatgactcttggagtccaagtggtaaagagaaacaaggaagcaagcattgaaaatagagggtcctccagaaacaaaagaaaattacaaaatcagaacacatatcaacacctccacacacacataaatgaagtacaattaataaaactgtactttgccaaaatgagaagttgctctaaacctaagaaatatagtaagctaacctaactgcttatgtgttaattctgttccataaagaatacacatttcaaattaacaaccattggaatccatcctcatataaagatggtataaaagaaaaaagtaaatagaaaataaagatattttagctgctaaaaattctcatcaaaaacaacaacaggtagtttagatttcaccttctagatgtagacctggaaagagtatagatcccactttagggaagtggcgtctgcaatttttctgaggcttgagtaggctgttttcccctcagagtgtaaacaaagccaccaagaagttcaaactgggtggagccctccttaactcagcaaaacatctgtagccagactgcctctccagattgcttctctctgggcagggcatctctgaaaaaaataagacagcagccccagtcaggggcttacagataaaaccctcatctccctgggagagagcacctgggggaaggggtggctgtgggtgcagcttcagcagacataaacatccctgcctgctgactctgaagaaagcagtggatctcccagcacagcgttcgagctctgctaagggtcagattgcctcctcaagtgggtccctgacccccatgcctcctgacttggagacacctcccagcaggggccaacagacacctcatacaggagagctctggcaggcatctggtgggtgcccctctgggacaagcttccagaggaaggaccaggcagcaatcttcgctgttctgcagccaccactggtgatacccaggcaaacagggtctggagtggacctccagcaaactccagcagacctggagaaaaaggccctgactcttagaaggaaaactgacaaacagaaaggaagagcatcaacatcaacaaaaaagacacccactgagaaaccccatctgaatgtcaccaacatcaaagaccaaaggtagataaatccatgaagatggggagaaaccaggacaaaaagactgaaaattccaaaaaccaggatggctcttcttctccttctccacatgatcacaacacctcgctagcaagggaacaaaacttgatggagaatgagtttgacaaattgacagaagtaggcttcaggaggtgagtaataacaagctcctctgagctaaaggaggatgttccaacccaatgcaaggaagataagaaccttgagaaaaggttagaagaattgcttactagaataaccagtttagagaagaatataaatgacctgatggagctgaaaaacacgacacgagaacttcgtgaagcatacacaagtatcaatagctgaactgatcaagtgtaagacaggataacagagattgaagatcagcttaatgaaataaagcgtgaagacaagattagagaaaaaagaatgaaaaggaatgaacaaagcctccaagaaatatgggactatgtgaaaggaccaaacctatgtttgattggtgtacctaaaagtgaaggagagtatggaaccaagctggaaaacactcttcaggatattatccaggagaacttccccaatctagcaaggaaggccaacattcaaattcaggaaatacagcgaacaccacaaagatactcctcgagaagagcatccccacgacacaattgtcagatttaccaaggttaaaatgaaggaaaaaacattaagggcagccagggagaaaggtcaggttacccacaaagggaagcccattagactgacagcagatctcgctgcagaaatcctacaagccagaagagagtggggaccaatatgcaatattcttaaagaaaagaattttcaacccagaatttcatatccagccaaactaagcttcataagcaaaggagaaataaaatcacttacagacaagcaaatgctgaaagatgctgtccccaccaggcctgccttacaagtgctcctgaaggaagcactaaacatggaaaggaacaatcagtaccagccactgcaaaaacataccaaattgtaaggatcatccaccctctgaagaaactgcatcaactaacaggcaaaataaacagccagcgtcataaagacaggatcaaattcacacataacaatattaaccttacatataaacgggctaaatgccccaattaaaagacacagactggcaaattggataaagaataaagacctatcagtgtgctgtattcaggaaacccatctcaggtgctaagatatacataggttcaaaataaagggatggaggaatatttaccaagcaaatggaaagtggaaaaaaagaaaaagcaagagttgcaatcctagtctttgataaaacagactttaaaccaacaaagatcaaaagagacaaagaagggcattacataatggtaaaggaatcaatgcaacaagaagagctaacaatcccaaatatatatgcaaccaatacaggagcacccagattcataaagcaagttcttagagacctacaataagacttaggccccacacaataatagtgggaggcttcaacactctactgtctatgttagacagatccatgagacagaaaattaacaaggatattcaggacttgaactcagctctggaccatgcagacttaatagacatctacagaactctccaccccaaatcaacagaatatacattcttctcagcaccacactgcacttattctaaaattgaccacataattggaagtaaaacactcctcagcaaatgcaaaagaacagatatcataacaaacagtctctcagaccacagtgcaatcaaattagaactcaggattaagaaactcaatcaaaaccgcacaactacttggaaacttaacaacgtgctcctgactaccagtcagtaaataatgaaattaaggcagaaataaataagttatttgaaaccaatgagaacaaagacacaacatagcagaatctctgggacacagctaaagtagtgtttagagggaaatttatagcactaaatgcccacaggagaaagtgggaaagatctaaaattgacaccctaacatcacagtaaaaagaactagagaagcaagaggaaacatattcaaaagctagcagaagacaagaaataactaagatcagagcagaactgaaggagacagaaacatgaaaaacccatcaaaaaaatcaatgaatctaggagctggtttttgaaaacatcaacaaaatagaccgctagtcagactaataaagaagaatagagacaagaatcaaatagacacaataaaaaatgataaattgtatatcaccactgatctcacaaaaatacaaactaccagcagagaatactataaacacttctatgcaaataaaatagaaaacctagaagaaatggataaattcctaaccacatataccctcccaagactaaaccagggagaagtccaatccctgaacagaccaattacaagttctaaaattgaggcagtaattattagcctaccaaccaaaaacaacccagcaccagacggattcacagccgaattctcccagggtacaaagaggagatggtaccattccttctgaaactatttcaaacaatagaaaaagagggaatcctccctaactcattttatgaggccagcgtcatcctgataccaaaacctggcagagacacaacaaaaaaagaaaatttcaggccaatatccctgatgaacatcaatgcaaaaatcctcaataaaatactggtaaaccgaatccagcagcacatcacaaagcttatccaccatgatcaagttggcttcatccctgggaagcaaggctggttcaacatatgcaaatcaataaatgtaaaccatcacataaacagaatcaatgagaacaaccacatgattttctcaatagatgcagaaaaggccttcgatgcagaagaggactttgataaaattcaacaccccttcatgctaaaaactctcaataaactaggaattgatggaacgtaacttacaataataagagctatttataacaaacccacagccaatatactcaatgggcaaaagctgtaagcattccctttgaaaactggcacaagacaaggatggcatctctcaccactgctattcaacatagtgttggaagttctggccagggcaatcaggcaagagaaagaaataaagggtattcaaataggaagagaggaagtcatattgtctctgttagcagatgacatgattttatatttagaaaaccccatcgtctcagcccaaaatctccttaagctgataagcaacttaagcaaagtctcagaatacaaaatcaatgtgctaaagtcacaagcattcctatacaccaataatagagagccaagtcatgagtgaactctcattcacaactgctacaaagagaataaaatacctaggaatacaacttacaagggatgtgtaagacctcttcaagcagaactacaaaccactgctcaaggaaataggagagaacacaaacaaatggaaaagcattccatgctgacggataagaagaatcaatatcgtgtgaaaatggccatactgcccaaagtaatttatagattcaatgctatccccatcaagctaccattgactttcttcacagaattagaaaaaactactttaagtttcatatggaagcaaaaaagagcctgtatagccaagacaatcctaagcgaaaagaacaaagctggaggcatcacactacttgacttcaaactatactacaaggctacagtaacccaaacagcatggtagtggtaccaaaactgatatatagaccaatggaacagaaccaaggcctcagaaatagcacgacacatctacaaccacctgctctttgacaaacgtgacaaaaacaagcaatggggaaaaaattgttttgggaaaactggctagccatatccagctaactgaaactggaccccttccttagacattgtacaaaaattaactcaagatggattaaagacttaaatgtaagacctaaaaccataaaaaccctagaagaaaatctaggcagtaccattcaggatgtaggcatgggcaaaacttcacgactaagacaccaaaagcaatggcaacaaaaggcaaaattgacaaatgggatctaattaaataaaagggcttctgcacatcaaaagaaactaccatcagagtggacaggcaacctacagaatgggagaaaatttttgcaatctatccatctgacaaagggctaatatctagaatctacaaggaacttaacaagtttacaagtaaaaaacaaccccatcaaaaagtgggcaaagggtatctacaggtacttctcaaaagaagacatttatgcagccaacaaacatatgaaaaacagctcatcatcactggtcattagagaaatgcaaatcaaaaccacagtgagataccatctcaggccagttagaatggcaatcattaaaaagtcaggaaacaacagatgctggagaggatgtggagaaataggaatgcttttacactgttggtgggagtgtaaattagttcagccattgtggaaaccctgtggtgattcctcaaggatctagaactagaaataccatttaactcagctatcccattactgggtgtatacccaaaggattttaaatcattctactataaagacacatgcacatgtatgtttattatagcactgctcacaatagcaaatacttggaaccaacccaaatgtccatcagtgatagactggataaagaaactgtggcacatacacaccatggaatactatgcagccataaaaaaggatgagttcatgttctttataaggacatggatgaagctggaaaccattctcagtaaactaacacaagaacagaaaaccaaacaccgcatgttctcactcataattgggagtcgaactgtgagaacacatggaaacacagggaggggaacatcacacaatggggcctgttaggggatggggggctagcagagggatagcattaggagaaatacctaaggtagatcacaggttaatgggtgcagcaaaccaccatggcacgtgtatacttatgtaacaaacctgcacgctttgtgcatttatcccagaacttaaaatataataataataataataataataataatgataatagaatagtgctctcacttcagtaacaacaaaaaatgctggacaaactttaaattaacaacttttattaaacttatcagagaactcaggttgtagggcaaacaactatagtttactttcgaacaacatgagtgtgaggggcaccaactccccaccatgcagtaaaaaatctatgtataagttttgactctccaaaaacttaacaactaatagcctactgttgaccagaagctttacaaataacataatcgattaacaactattttgtgtattatatgtattatatactgtacccttagagaaaagaaaatgttattaagaaaatcataaggaagagaaaatacatttagaatactgtactgtatttatcaatatcataagtttgtgttatctctttacaagatgaatcgtgtctgaaatggtggacaactgcagctgcagaccttgatttataatatacaccatgcaattcagttttttctcataatgtcatgacttttttctgcttgttaggaacatttccagcatcagtagtggcactttgtatgggttccatgacgcaatttaaggtttttgatattgcactaaacatgatgaaaaatatgtaagaaccggagggatcaccttttactgtgatatgcaatatgctggagagatgaactgctcatactgagatgactagggtcacatggcattttaagcagatatttgcaacacttgagcttgctgcaatagcaataggaggtggctttgaaattatttcagagttgtagtgtggattatagttaatattataccgttatggtttaatactgcatctttacagttttttgcatttctcttgactgcaaatggcacctgtacattctgtaaatatttgtgtatataagttttaataaattttaacttctatgatagatttgtatatattttatggtagtaaatgataatatagactagtatctatatattttctacatattcatggcatagcttttccttagttttttctgatattttaggctaaagctgtttgtctgcctgttttttcagattgtcttaaatctccaaaaacttccaatatacttatagaaaaaagtttgtgcataagttggcccatgcagtctaaacccatgttactgaaaggtcaactgtaatttgaaatctggggagagaaaggtgccaatttgggagaaacaagacctgaatcttcgcttgcttagggcggacacccttggaggccactaaagccaatagaaagattttgcaaaaatttttaaatgaatttctgaaagttgaatatggactaatatgaaggtataaagccccctggggctacagacataaggtctttgtaccgtctttcagcattttcctccatgaccttaccaaccaaccacagggaaaatcagagtcaatccagggaaagcttccttcagggttcttgctggagaaaggaaacagcagccaaagccaaatgtcctctatttattttattgacaaaagcctgtagaggaagaagagtaacaaaactgtcaatttagggcactggatgaaattcactgagctggggaaagggaacaggaaaaaaaacccagacaaccctacctttagaggaatggaaggaatatatgccaggcctgcacaactactggaagagggagagaaacacttttgaagtttatcctgcaaagaaactgtgttcacagtacaaataagagaacactgtatctactgtccacacaccagtttgccaaaatttaaactatatgacatgtaacaaggaaaaataacaatagatacaactggacaaactgtaggagacagattctctctggggaacaaagactgagaaaaaccctctggcaaatagcccatgccctaaataccagacatctctagagaaatttgaaggtttggtgcactgaaggtaaccatagcaacaataaactccaaacccactgtaactactggctagattaatgctaacacccacactaaaggcctagaaaaaaatatgttcatctccaagcataaaaatatttatctccatatctcttgtcctgtacatgttcaacattccacataaatttatgaggcatatgacaaggcaaacacacacagtctcaagaggcaaagcaagcatgctgatacattttaaattttaagttttaaaatgtaaattttaaaccctgggacaatcactaaaagtttttcaagtataaatgttaagtaaatagtggagatgaaatagaaccattaaaatgctcaattaaacccatagaaggcagaaaaggagggaaaaaagaaataaagaacaaatagaaaataacaaatatggtagattttaaatacaagtatatcaatattcattttaatgcttaaacatgccaattaaaagacagtgattctaacattcaattttgaaaaaagcaagactcaactacatgttgtctacaggaaacaaactttaaatacaaaactatagataagttgacagtaaaaaaaaaaaagatatagcttacaaatgccaaccaaaagaaagctagtgtagctgtactaatttcaacaatgtagatataaaggaatattattagagacaaagagtggcataacccaataataaaataataataaaggcatttctcaagaagacataataatgctaactgtgtatgtacctaagacagctcttcaaaatacatgagacaaaaatttatagatctgaaaggagaaatagacaaatccacagctatatttggaaacttcaaaactaatctctctgtaattgatagaacaagtgggcatgatattggtagcctgaaccctatcaactgattgacctaactgacatatatagaacagtcaacacaagagtagcagaatgcacaccatttttttaaaagtggaaatgggacactaatccaaatggattagaaaagatctaaaatcagtaagcaaggcttacttaaaacaagaagatgaaatcaaacccaaagcaagaataaagaaagaaataaggattgtagcaactgtcaataaaattaaagacaaaaagaaaacagataatcaatgaaaccaaaagagagttctttgaaaaggttaaaatcaataaacatctagccaaactggccaaaaaaaaaaaaaaaaaaggtgaagtattgaaaaactgtcatttaacactcccaaaataacaagcattttcagatatgaaaagtaatctcaaatcaaaaatttaaaaattatgacagaaatgggcaacaaaaccttaggaaatatgaaataaaaatcaactgacttcaagaaagtaagtcaataaaaagacaaaatcatctcaaaaataaagataaaattacaaagaacaaatgttctcatctaacaacccaataagggtgactgagaaaaggcatgagaacaaccaataaaacaaacatgaaatgaaggagtttttttaaaaaaaagcagagcagaaagtaataaatatagaagatcagcaaagaaaatataacaaaagtttaattgaagtatctagaaagaagaacaaagcactaaacagaagtaatatttaaaattataattgagatagctttttgtaaataaaaactctgaatctgtatatttgaaagacctactttgtgtctgggaaaattggtaactcattttttaggaaatttctacttttaagacaaaggggaaaaaaatctgctaggccaatatgcaaaaactagatcatttataaaggaaaaaatatgggtggcatcagaattctcacccacaatgaagcatcacaacatatattaaatataacaacgaacaaaacaaagacactgtaaaataatatggcatggctgagcccacgtcatcaactataaccataagtttagataggcttaattcacctactaaaataaaaatatgtttactttttctcatcaaagaacacaatcaacaatatgaaaagacaactcactgagtggggaaaaatatttctaaattatatatctcataaagggtgaatatccagaaaatgtaaagaattcctacaactcaacaacaacaactacaaataactgaatttttaaagtaggcagccaatttgaatggacatttcttcaaagaagatatgccagttagccaattagcacatgaaacgatgctcaacatcaccaatcattaggaaaatgtgaattaaaaccgtaatgaaaataccacctcacatccattaggatgattactgtcaaaaacaaaacaaaacaaaaactagaaaataacaaatgttagcaagaatgtggagcaactggaacatttgtgcactgttggtgcaaatttaaatgatacagcttctgtggaaaacagtatggtggtttctcaaaaaaattaaaagtagacttactatttgatctaccagtttcacttctgggcatatgcccaaaagaaaggaaagcagtgacttgagatatgtgtatactcatattcattgacacgttattcataagagccaaaagaagcaagcaactgaattgtccttcaacagatgactggataaacaaaatgtggtatatacatcaaatggaatatgattcagctttgaaaaatagggaaattctgaacatgctacaacatggatgaaccttgagaatattatgctaagtggagtaagccaggcacaagaagacaaatactgtatgattccatttatataaggtacctatactatcaaattcacagaggcaaaaaggagaatggtggttgccagaggttaaggaaaaaggggatataaagagttattgttaatgggttcagagtttcagttaaggaagacaaaaagttctggagattaatggtggtgattcttgcacaacaatgtgaatctacttactgccactgaactgtacactgaaaaatagttgattttaaattttatcttagttgtattttactacaatttaaaaaactacattttctagtctcccttacaggtaagttggccatgtttccgtgttccagtgagtgaaagatgatggcacattacatctgttgaaatacatatggaatattttttaattggctatatgttaaataacaaggaaaatcttaataaattttataaagtaggcatgataaagcatcttttgatgacactgaagtacaataaaattaatttaaaaaataaatgatcttctactggtttatataaaaactctttttaaaacaacataaaataaaaggggaaacaagtttgcagagtgtgagatggggagaatctgcctctgaatgcacatctccactggggaatctgaaaatccagatcacaggagaaggctttaaccttacctggagctggaatggatttagggaatggtgcaaaatatgaaagtagaagtagcattgagaagagccatataggcattctcagtctccagctcaagcccagggaagccatccctgactatatcttacaggcaccctgagggaaggcagccagcagaattagggaagagtcaggcagccagcagaattagggaagagtcacagggtgaaagaagcttccagcagaatcttgttttaatttatagtgggaataaaccccctttaaaagaatctgtggcacaaatgggaactgtggcagatacgagcacaggtgtgggcacttggcattacaggaagatggggaggggcatggcctgaaagctgtgcttgctttctcagtgggaaagcttatgacctggggcaggtgctcaccaaaggatacctccccacatcaactgagtaaattaaaaactggagaaaaagaaaataaataaataaattgtacaccatgagagaacgagataagcttcaagagatccctgccattccaattccataggagacagtgaactcacccacacaccaagaacataactacaataaccaacatcaggaaaagccagtgcacagagactttataactaaggaactgatacaaagtcttcacctctaaagcataaaaaatcaaaataggcaaaaataaacataaaagtatgatccataagagggaaaaaaagtaattctaagcaaaaaataccgtacataaacagtccagtcaaaaattcaaaaacaatttgaagacataatctacccaaatgagaaggaaccaagaagtaattctgataatatgacaaaacagggttctctaatacccctaaatgatcacactagctctccagcaatggatccaacccaagaagaaatctctgaactgccagataaagaattcagattgattattgagctactcaaggaaataccagagaaaggtgaaaacgaacttaaagaaattaaaaaatatatgtaggatatggatgaaaaattttccagataaatagatatcataaagaaaaaacaatcacaacttctggaaatgaaagacacacttagggaaatacaaaatacagtagaaagtttcaacaacagactagaacaagtagaagaaagaacttcagagcttgaagacaaggctttcgaattaacccaatcagacaaaaacaaagaaaaaagaattttaaaagatgaaccaagtctccaagaaatataggatcatgtgaaatggccaaacctaagaataattggtgttcctgaggaagaatagaaataaaaagtttggaaaatttatttgaaggaataattgaggaaaactttcccggccttactagagatctagacatccaaatacaagaagctcaaagaactcctgggaaattcatcacaaaaaagatcatcaccaaggcacatagtcatcaggtggtccaaagtcaagatgaaggaaagaatcttgagagctgtgagacaaaagtatcaggtaacccataaaggaaaacctgtcagattagcagcagatttgtcagcagaaactttacaagccagaaggaactggggtcccatctttagcctacttaaacaaaatacttgttagccaagaatttggtatccagcaaaactaagcttcattaatgaaggagagacgtaaagtctttttcaaacaaatgctaagagaatttgccactactacaccagcagtactggaaatgctaaaaggagttttgaatcttgaaacaaaacctcaaaatacaccaaaatagaaactccttaaaccgtgaagctcatagggcctataaaacaataatacaatgaaaaaacaaacaaacaatgtatttaggcaataacttacataatgaatagaacagtacctcaccagctgggcacagtggctcaggcctgtaataccagcactttgggcaggccgaggcaggtggatcacttgagttcagcggttcaagaccagcctgaccaacatggtgaaaccccgtctctactgaaaatgcaaaattagctaggcatggtagctcatgcctgtaatctcagctacttgggaggctgaggcaggagaatcacttgaacctaggaggtgcggttgcagtgagccaaaatcgtgccattgcactccagcctggacaacaagagtgaaactctgacttgaaaagaaaaagaagagaagacaagagaagagaagagaaaagaaaagaaagagaaagagaaaagaagagaagagaaaagaagcagagggtaagggagggaaggggaggggagaaggaaaggaagaaaggaaacagtacctcacatctcagtactaacattgaatgtaaatggcctgagattgtgccattgcactccagcctgggcaacaagagtgaaactctgtcttgaaaagaaaagaagaaaacaaaagaagagaaaagaagagaagagaggagaaaagaggggagggggaggggaggggagaggagaggagggaacagtatctcacgtctcagtactaacattgaatgtaaatggcctgaacctgggaggtggaggtatcagttagctgagatcgtgccattccactccagcctgggcaacaagagtgaaactccatcaagaaaagaaaagtaaagagaggagaggagaggagaggagtagtacctcacatctcaatactaacattgaatgtaaatggcctaagggccccacttaaaagatacaaaatggcagaatggataaaacctcaccaaccggctgggcgcagtggctaacgcctgtaatcccagcactttgggagaccaaggtgggcagatcacttgagatcaggagttcaagaccaacctggccaacatggtgaaaccccttctctactaaaaatgcaaaaattagctgggcatggtcgtagatgcctgtagtcccacctactggagaggatgaggcaggagaattgcttgaacccaagaggcagttggaggcttcagtgagctgagattgtgccactgcactccagcctgggcgatagaatgagaccctatctcaaagaaaacaaaaaacaaacaaaaacaaacaaacaaacaaaaaacaaccaagtgttcaccatctttaagagattcacctaacacataaggactcacataaacttcaggtaaaggggtggaaaaacatattccatgcaaatgtaaaccaaaagcaaacaggagtagctattcttatatcagacaacatagacattaaagcaacaacagttaaaaaaaaaaaaaagaaggaaaatactacaatcctaaatatatatgtacctaacactggtgctccaaaatttatgaaacaattactactagacctaagaaatgagagagatggcaacacagtaatggtgggagacttcaatactccactgacagcactacacagatcatcaagacagaaagacatcaaagaaacagtagacttaaactatatgctagaccaagtggacttaacacatatttacagaacattcaacccaagtgcagaatatacattcttctcatcagcacgtggaacattctccaagatagaccatatgataggccacaaaataagtctcaataaatttaagaaaatctaaatcatataaagtatagtcttagactatggtggaataaaactggaaatttattttaaaaggaatcctcaacattaacaaatacatggaaattaaataatctgctcttgaattatctttgggttaataaggaaatcaagatttaaatttagaaattatttaaactaaatgataatcattacacaacttatcaagacctttgggataaagcaaagctgtgctaatagaaaaagcttacagcattaaatgcctacatcaaaaagtctgaaagagcacatctcaaggaactagagaaacaagaacaaactaaatccaaacccagcagaagaaaagaagtaacaaagatcagtgcagaactaaatgaaattgaaacaaaaaatatgcaaaagataaatgaaacaaaaagctggttctttgaaaagatacacaaaattgatagaccattagttagattaaccaagaaaacaagagagagcatccaaacaagctgaattagaaatgaaaggagagatattacaaccgataccttagaaaaacaaaagatcattcaaggctactattaatgacagaccaatatccctgatgaacatagatgcaaaaatccttaacaaaatactagctaaccgaatttaacagcatatcaaaaagattacacatcataatcaagtgagtttcataccagtgatgcagggatagcttaacatacatgggtgaatacatgtgatacatcacataaacagaatttaaaacaaaaattggtggggaaaaagtacttgacaaaatccagcatcccattaatatgaaaacactcacaaaattggcatagaaaggacatatgtcaaagtaataaaagccgtctaagacaaacccacagtcaacgtcatactgaatagggaaaagatgaaagcattcgccctgaaaactagaacaatacaaggatgcccactttcaccacttctagtcagcataataccggaagtcatagacaaagcaatcagacaagagaataaaatgaaaggcatccaaattggaaaagaggaactcaaactgttgctggacaccaatgatatgattgtatacctagaaaaccgtaaagactaatccagaaagttcctagatttgataaatgaatcagtaaagtttcaggacaaaacaaatcagtgtacacaaatcagtagcactgatatacaccaacagtgaccaagctgagaatcagatcaagaacacagccccttttacaacagcaagcaagcaagacaaagagagaaagaaaaattgaaagaaaggaagaaagaaagaaagagaaaggaaaagaaaggaagggagggaggaaggaaagaaagaaaaaagaaagaaagaaggaagggagggagggaggaaggaagcaaggaagggcaaggaaacgaaagcaaggaaagagaaagtctcctcaagtaggtccctgacccctgtgcctcctgactgggagacagcttccagcaggggttgacagacacctcatacaggagagctccagctggcatctggcaagtgcccactaagatgaagcttccacaggaaggaagagacagctatctttgctgttctgcagcctccgctggtgatacccaggcaaacagggtctggaatggacctccagcaaactccagcagacctggagaagaggggcctggctgttagaaggaaaactacaagcagaaaggaatagcatcgacaccaacaaaaaggatgtacacccaaaaaccccatacaaaggtcaccaacatcaaggaccaaaggtagataaatccatgaagatgagaaaaaaacagtgcaaaaaggctgaaaattcaataaaccagaatgcctcttctcctccaaaggttcacaactccctaccagcaagggaacaaaactggacagagaatgagtttgatgaaccgacagaagtaggcttcagaagatgggtaataacaaactcctccaagctaaaggagcatgttctaacccaatgtaaggaagttaagaaccttgaaaaaagttagagaaattgctaactagaataaccagtttagagaagaacatacatggcctgatggagctgaaaaacacagcacaagaacttcatgaagcatacacaaatatcaatatccaaatagatcaagcagaagacaggatatcagagattgaagatcaccttaatgaaataaagtgtgaagacaagattagagaaagcagaatgaaaagaaatgaacaaagcctccaagaaatacgggactgtgtgaaaagaccaaatctacatttgattggtgtacctgaaagtgatggggagaatggaaccaagttggaaaacactcttcaggatattatccaggagaacttccccaacctagcaagacaggccaacattcaaattcaagaaatacagagaacaccacaaagatactcctcgagaaaagcaaacccaagacacacaattgtctgattcgccaaggttgaaatgaaagaaaaaatgttaagggcagccagagagaaaggtcaggttacccagaaaggaaagcctatcggactaacagcagatctctcagcagaaaccctacaagccaaaagagagtggggaccaatattcaacattcttaaagaaaagaattttcaacccagaatttcatatccagccaaatagtttcataagcaaaggagaaataaaatcctttacagacaagcaaatgctgatattgccaccaccaggcctgctttacaagagctcctgaaagaagcactgaacatggaaaggaaaaaccactcctggccactgcaaaaacataccagattttaaagaccatcgacactctgaagaaactgcaacttgtaaatttgtttgagttaattgtagattctacaattgtagatattagccctttgtcagatgagtagattgcaaaaattgtctcccattctgtaggttgcctgttcactctgatggtagtttcttttgctgtgcaaaagctctttagtttaattagatcccatttgtcaattttggcttttattgccattgcttttggtgttttagacatgaagtccttgcccatgcctatgtcctgaatggtattgcctaggttttcttctagggtttttatggttttaggtctgacatgtaagtctttaatccatcttgaattaatttttgtataaggtgtaagtaagggatccagtttcagctttctacatatggctggccagttttgccagcaccatttattgaatagggagtcctttctccatttcttgtttttgtcaggtttgtcaaagatcggatggttgtagatatgtggtattatttctgagggctctgttctgttccattggtgtatatctctgttttggtaccagtgccatactgttttggttactatagccttgtagcatagttcaaagtcaggtagcatgatgcctccagatttattcttttggcttaggattctcttggcaatgtgggccctttttggttccatatgaactttaaagttgttttttccaattctgtgaagaaagtcattggtagcttgatggagatggcattgaatctataaattaccttgggcagtattgccattttcacaatattgattcttcctacccatgatcatagaatgttcttccatttgtttgtatcctcttttatttcactgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgcttgtgatttttgcacatcgattttgtatcctgagactttgctgaagttacctatcagcttaaggaggttgtgggctgagacaatggggttttctagatatataatcatgtcatctgcaaacagggacaatttgacttcctcttttcctaatgaatacactttatttccttctcctgcctgatagccctggccagaacttccaacactatgttgaataggagtggtgagagagggcatccctgtcttgtgcccattttcaaagggagtgcttccagtttttgcccattcagtatattgactgtgggtttgtcttaggtagctctgattattttgagatacatcccatcaatacctaatttattgagagtttgtagcatgaagcattgttgaattttgtcaaaggcctttcctgcatctattgagataatcctgtggtttttgtctttggttctgtttatatgctggattacattttttgattttcatatgttgaaccagccttgcatcccagggatgaagcccacttgatcatggtggataagctttttgatgtgctgctggattcggtttgccagtattttactgaggatttttgcattgacaaacaaccccatcaacaagtgggcaaagggtatgaacagacgcttctcaaaagaagacatttatgcagccaaaagacacatgaaaaaatgctcatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaagtaccatttgacccagccatcccattactgggtatatacccaaaggataataaaagatgctgctataaagacacatgcacacgtatgtttatggtggcactattcacaatagcaaagacttggaaccaactatgatagactggatgaagaaaatgtggcacatgtacaccatggaatactatgcagccataaaaaatgatgagttcatgtcctttgtagggacatggatgaagctggaaaccatcattctgagcaaactattgcaaggacaaaaaaacaaacactgcatgttctcactcttaggtgggaattgaacaaagagaacacatggacacaggaaggggaacatcacacactggggcctgttgtagggtggggggagcggggaggggggagggatagcattaggagatacacctaatgttaaacgaagagttaatgggtgcagcataccaacatggcacatgtatacatatgtaacaaacctgcacattgtgcacatgtaccctaaaacttaaaatataataaaaataaaaaatgaaaaatagaaaaaagaaccatgaatgataaaaaaaaaagaaaaaaaataaactgcatcaactaacaggcaaaataatcagctagcatcataaagacatgatcaaattcacacataacaatgttaaccttaaatgtaaatgggctaaatgtcccaattaaaagacatagtctggcaaattggataaagagtcaaggcccattggtgttcagtattcaggagacccatctcatgtgcaaaaacatacataggctcaaaataaagggatggaggaatatttaccaagcaaatggaaagaaaaaaaaaaagcagcggttgcaatcctactctctgataaaacagactttaaaccaacaaagagacagagaagggcattacataatggtaaatggatcactgaaagaagaagagctaactatcttaaatatatatgcaccgaatgcaggagcacccggattcataaagtaaattcttagatacttacaaagagacttagactcccacacaatgttagtgggaaaatttaacactctactgtcagtaacagacagatcatcaagagagaaaattaacaaggatatccaggacttgaactcagctctgcaccaagtggacctaatagacatctacagaactctccaccccaaatcaatagaatatacattcttctcagcaccgcatcacacttactcccatattgaccacatagttgaaagtaaagcactcctcagcaaatgtaaaagaatagaaatcacaacaaactgtctctcagaacacagtgcaatcaaattagaactcagaattaagaaactcactcaaaactgctcaactacatggaaactgaacaacctgctcctgaatgactactgagtaattaacgaaatgaaggcaaagccttcattcataccaaagcctggtagagacacagcaaaaaaaaaaaagacttttagaccaatatccctgatgaacatcgatgtgaaaatcctcaataaaatactggcaaactgaatccagcagcacatcaaaaagcttatccaccatgatcaagtgggcttcatccctgggatgcaaggctggttcaacatacgcaaatcaataaacgtaatccagcatataaagagaaccaatgacaaaaaccacatgattatctcaatagatgaagaaaaagcctttggcaaaattcaacaacccttcatgctgaaaactctcaataaactaggtattgatggaacatatctccaaataataagagctatttatgacaaacccacagtcaatatcatactgaatgggcaaaaactggaagcattccctttgaaaactggcacaagacagggatgccctgcctcaccactcctattcaacatagttttgaaagttctggccagggcaatcaggcaagagaaagaaataaagggtattcaattaggaaaagaggaagtcaaattgtcccagtttgcagatgacatgaattttatacttagaaaaccccattgtcttcacccataatctccttaagctgataagctcattgtagattctggatattagccctttgtcagatgagtaggttgcaaaaattttctcccattctttaagtttcctattcactgtgatggcagtttcttttgctgtgcagaagctctttagtttaattagatcccatttgtcaattttggcttttgttgccattgcttttggtgttttaaacatgaagtccttgcccatgcctatgtcctgaatggtattgcctaggttttcttctagggtttttactgttttaggtctaacatttaagtctttaatccatcttgaattaatttttgtataaagtgtaaggaagggatccagtttcagctctctacagatggctagccagattccccagcaccatttattaaacagggaatcctttcctcatttcttgcttttgtcaggtttgtcaaagatcagatggttgtagatgtgtggtattatttctgagggctctattctgttccattggtctatatctctgttttggaaccagtaccatgctgttttggttactgtagccttgtagtatagtttgaagtcaggtagcgtgatgcctccagcttttttcttttgacttcagaatgtcttgacaatgcgggctttttttggttccatatgaactttaaaatagttttttttgtttgtttgttatttgattccctttattacattaaattatacatttgactcatttttccataatgaataatttgcgtgtgaataaaatgaccaacttaaaataaacaaataaaaagtatgtattcactaacagttatattataaataagtacattcataatcaatctctcattattcctgttcctctctttcatagaaagcacttataagtgtaatcgattatatctttaagcatcttggcattctgaggtttatagattaattggggaaaactgtccattttaataagctttggttttttgtcccttttttttttaatttttttagtatttattgatcattcttgggtgtttctcggagagggggatttggtaggttcataggacaatagtggagggaaggtcagcggataaacatgtgaacaaagtctctggttttcctaggcagagggccctgcggccttccgcagtgtttgtgtccctgggaactagggattagggagtggtgatgactcttagcgagcacgctgccttcaagcatctgtttaacaaagcacatcttgcaccgcccttaatccatttaacccttagtggacacagcacgtttcagagagcacggggttggggataaggttatagattaacagcatcccaaggcagaagaatttttcttagtacagaacaaaatggagtctcctatgtctacccccttcaacacagacacagtaacaatccgatctctctttcttttccccacatttcccccttttctattcgacaaaaccgccatcgtcatcatggccccttctcaatgagctgttgggtacacctcccagatggggtggcggccgggcacaggggctcctcacttcccagacggggcagccaggcagaggcaccccccacctcccagatggggtggctggctgggcggcggctgccccccacctccctgacggggcggctggccgggcgggggctgccccccacctcccggatggggcagctgccgggcggaggggctcctcaattcccagatggggcggctgctgggcggaggggctcctcacttctcagacggggcggccagtcagagatgctcctcacctcccagacggggtggcggcggggcagagacactcctcagttcccagacggggtcacggccgggcagaggagctcttcatatctcagacggggcggcggggcagaggtgctccccacatcccagacgatgggcggctgggcagagacgctcctcacttcctagacgggatgactgctgggaagaggcgctcctcacttcccagactgggtggccaggcagaggggctcctcacatcccagacgatgggcggccaggcagagacactcctcactttctagacagggtggcggccgggcagaggctgcaatctcggcactttgggaggccaaggcaggcggctggcaggtggaggttgtagcgagccgagatcacgccactgcactccagcctgggcaacattgaacactgagtgagcgagactccctctgcaatcctggcacctcgggaggctgaggctggcagatcactcgcggtcaggagctggagaccagcccggccaacacggcgaaaccctgtctccaccaaaaaatatgaaaaccagtcaggcgtggaggcgcacgcctgcaatcccaggcattcggcaggctgaggcaggagaatcaggcagggagtttgcagtgagtcgagatagctgcaatacagtccagcctcggctgggcatcagagggagactgtgcaaaggggagagggagagggagagggagagggatagggagatagtttttttttccaattctgtgaagaaagtcattggtagcttgatggggatggcattgattttcacaatattgattcttcctatccgtgagcatggaatgttcttccatttgaagaattctccaacccgaatgtccatcagtgatagactggattaagaaaatgtggcacatatacaccatggaatactatgcagccatataaaaggatgagttcttgtcctttgcagggacatggatgaagctggaaaccatcactcagcaaattattgcaaggacagaaaaccaaacacagcacgttctcactcataggtgggaattgaacaatgagaacactgggacacagggtggggaacatcacacacaggggcctgttttggggtgggggatggggggagggatagcattgggagatatacctaatgtaaatgatgagttaacgagtgcagcacaccaacatggcacatgtatacatatgtaacaaacctgcacattgtgcacatgtagcctagaaccgaaagtataattaaaaaaagctgataagcaaattcagcaaagtctctggattcaaaatcaatgtgcaaaaatcacaaccattcttatacaccaataacagacagagagccaaattatgagtgaactcccattcacaattgcttcaaagagaataaaacacctaggcatacaacttacaagtgatgtgaaggacctcttcaaggagaactacaaaccactgctctaggaaataaaaggggacacaaacaaatggaagaacattccatgctcatggataggaagaatcaatatcatcaaaatggccatactccccaagttaatttatagattcaatgccgtctccatcaagctatcaatgactttcttcacagaattggaaaacactactttaaagttcatatggaaccaaaaaagagcccacattaccaagacaatccaaagccaaaagaacaaagctggaggcatcatggtacttgacttcagactatactacaaagctacagtaatcaaaacagcatggtactggtaccaaaacagagagatagaccaatggaacagaacagaggcctcagaaataacaccacacatctacaaccatctcatcttcaacaaacctgacaaaaaccagcaatggggaaatgattccctgtttaataaatggtgctgggaaaactggctagccatctgtagagagctgaaactggatcccttccttacactttatacaaaaattaattcaagacggattaaagacttaaatgttaaacctaaaaccataaaaaccctagaagaaaacctaggcagtatcattcaggacataggcatgggcaaggacttcataactaaaacaccaaaagcaatggcaacaaaagccaaaattgacaaatgggatctaattaaactaaagagcttctgcacagcaaaagaaactgccatcacagtgaataggcaacctacagaatgggagaaaatttttacaatctacctatctgacaaagggctaatatccagaatctacaaagatcttaaacaaatttacaagaaaaaaacaaaccaccccatcaaaaagtgggcaaagatatgaacagacacttctcaaaaaaagacacctatgcagccaacagacacatgaaaaaatgctcatcatcactggccgtcagagaaatgcaaatcaaaaccacagtgagatatcgtctcacaccagttagaatggcgatcattaaaaagtcaggaaacaagaggtgctggaaaggatgtggagaaataggagcacttttacactgttagtgggagtttaaattagttcagccattgtggaagacagtgtggtgattcctcatggatctagagctagaaataccatttgacccagccatcccattactgggtatgtacccaaaggattataaatcatgctaatataaagaaacatgtacatgtatgtttattgtggcactactcacaatagcaaaaacttggaaccaacccaaatgtccatcaatgatagactggatttagaaaatgtggcacatatacaccatggaatactatgcagccataaaaaaggatgagtccattttcctttgcagggacatggatgaagctggaaaccatcattctcagcaaactatcacaaggacagaaaaccaaacaccgtatgttctcactcataggtgggaattgaacaatgagaacacttggacacaggacagggaacatcatgcatgggggcctgtcatggggtaggggtcagggggagggatagcattaggagaatacctaatgttaatgataagttaatgagtgcagcaaaccagcatggcacatgtatacctatgtaacaaacttggacattgtgcacatgtacactagaagttaacatataataataataataataataataaaaagaaattttagatgcttgctttagtaaatgttttattgaaataaaatgacatatcctacaatttacccatttaaagtatatgattcaatgattttgagtatattcagtgaagtttgtaaccatcaccaaatcaatgttacgatattttcattactctaaaaagaaaccacgtacctattaccagttactcccctttctctccaaaccttgcaaccctaggcaataactactttagtctctgtgtgtatgaatttgtttgttatagtcatttcaaagcaataaaaccatacaatatttggcattttgtcactggcttttttctcttaacaaaattctttcacgattcattcatgtcgtatgagtactttattcctatttattggtgaataagattccattttatcatattttatttatttatttttcagtgctttttgaggcctaggcaggaggattgcttgagcccaggagttccaggctgcagtgagctatgatcatgccactgcactccctgccttgaaaaaaaaaaagtaactttgtgtttaacatttagaggacataacagactgctataagaagtggcctcatagaatgagttgggaagtgtttcctcctcttctgttttttttggagggtttgtgaaaaattgatactaattcttcctcaaatgttgggtagaattcaacagtgaagccctctgggcctgggctattctttgtgagagatttttccaattacaaattcatttcattacttgttttgtctattcatatcttctaaagtcagttttgatagtttgtgtttttctaggaatttatccattttgtacaggttatctgatttgttggaatattgttattaataatactccattacaatctttttaattctctgagataggtccctcttttcactctttttttttttttttttttttttttgagatgaagtctagctctgtcaccaggctggagtgcagtggcgagatcttggctcactgcaacctccgcctcctacgttcaagtgattcttcagcctcggcctcccgagtagctgagactacaggcacacgccaccatgcccagctaatttttgtattttttttaatacaaaatttagacgggatttcattatgttggccaggatggtctcgatctcttgacctcgtgatctgcccacctcggcttcccaaagtgctgggattacaggtgtgagccaccgtgcccggcctttgctcttgattataataatgttagtttctcttcttgtcttggtcaacctagctaaagttttgtcaaccgttttgaccttttcaaagaagctgcttttttccagctttattgaattatgagacaaaaattgaatatatttaaggtatacaactcaatattttatataaattaacatccatcgcgtcacataattgtcattttcttccttctcccctcccctgcttcaccctcgcaaccaccattctactttctctaagtgtatttccacttttgcatatgtgagataatgcaatatttgtctttctgtgtctgaattgcttcacttagcataatatcctccaggttcatccaagttgtcataaatgtcaggatttactttattataaaagctgaataatatttcagtgaattagtgtgtgtatgtgtatcacattttctgctttagtaaactaatagattgcgtgactcatccaaggacgaagtcagtgagcagtggggacaggactacagctcaaatctcctggttcccatcaacaatacctgctttccaatccctaatgatgccattaggatgggagaatggtggaacctgcagggaagagaaggagactgggcacacagtaggatccaagccctggccctgccccctgggacacatttgtcactctattgcttgttttctttgctctgcaaatgctttttagtttgattcagtcccacttaactttgtaatatattttgaaatcagaaagtgggatgcctccagcgttgttattcttgttcaatagtactttggctatttggggtcttttgtggtttcatgtgaattttaggattttttttttctatttctgtagagtatttctttggtattttcatagggatttcattgaatctatagatcagtttggatagcatggggattttaacaatatcaattctttttttttttttaagacagtctttctctctcacccaggctggagtgcagtggcacaatcttggctcaccgcaacctctgcctcccgggttcaagcaattctcctgcctcagcctcccatgacatgcctggctaatttttttttgtatttttagtagagatgggatttcatcatgttggtcaggctggtctcaaactttttacctcaggtaatccacctgcctcgacctcccaaagtactgggattacaggcatgagccaccgcacccggcaatattaattctcccagtccataaaaacggaggtctttccttttatctgtgttcaaagaaccaacttttagattatttgcttttgtatatattttttctttaatacttcattaatttgtgctataatctttatttccttttttctgtttgctttcagtttagttttttttatttttctatattttaatgtgaatggtgaggatattgatttgaggtaattttgttttcttttttccttgttttgagacagggtcccattctgtcacgcaggcaggagtgcagtggcatgatcatggatcacggctcactgcagcctcaacctccctggctcaagtgatcctcccacccgagcctttcaagtagttgggactacaggcctttgctaccatgcccagattattgattgattgattgattgattgattgattgagacagggtctacctatgttgcccagtctggtctcaataccctggactcaagcaatctttccaccccagcctcccaaagtgctgggatttcaggtgcaacccactgggctcagcctttttttcttttcttttcttctcttttcctttctttaacatacttgcttatggctataaattttcctctcagcattgcttaagctgcatactggagtttttagtatgttatatcttcgtttcattcttcacaaagtatttttcgtttctttcgtttgttattcagtcagatgttagtatagccactgaagattccttacggctgctatttccatgttatgtccttttttatggtttgctttaaacttttttgtatctttgatcaaagcgtgtctcctgtagaaagcatatagttggatactatttgcttgttttgtgcagtcatactatatcttccttttgattggaatgtttaatcaattcacatttagtgttattgttggtactgttagattgatgtctgtaaatttagtttttattttccatatgttcatgccttttttccttgtactcctcctttactgattttttaacattaaatgaatatttttaaaaaatttaatttctatttatttatttatttactttaagttctgggatacataggcagaatgtgtaggtttgttacataggtatacatgtgccatggtgttttgctgcacctgtcaacccatcatctaggttttaagccccgcatgcattaggtatttgtcttaatactctccctccccatcacccctaccccacagcatgccccagtatttgatgttcccctccctgggtccatgtgttctcattgtccaactcccaattatgagtgagagtttggttttctgttcctatttaaatttgctgagaatgatggcttccagcttcatctatgtcccggcaaaggacatgaactcattctattttacggttgcatagtattccatggtgtatatgtgccgcattttcttaatccagtctatcactgatggacatttgggttggttccaagtttttgctattgtgaatagtgctgcaataaacatatgcatgcatgtgtctttatagtagaattatttataatcctttggatatatacccaggagtgggattgctgggtcaaatggtgtttccggttctagatccttgaggaaccaaaacactgtcttccacattgattgaagtaatttacactgccaccaacagtgtaaaagcatttctatttattcacagactcaccagcgtctgttctttcctgactctttaatagccattctaactggcgtgagatggtatctcattgtggttttgatttgcatttctctaatgaccagtgatgatgaaccttttttcatatctttcttagctgcataaatgtcttttgagaagtgtctgttcacatacttctcccactttttgatggtttttttttcttgtaaatttgtttaagttccttgtagattctggatattagacctttgtcagatggatagcttgtaaaaattttctcccattctgttggttgcctgttcactctgatgatagtttcttttgctgtgcagaaactcataagtttgattagatcccatatgtcaattttggcttttgttgccattgcttttgatgttttagtcatgaagtctttgcccatgcctatgtcctgaatggtattgcctaggttttcttctaggattttttatgtgtttaggtcttacatttaagtctttaattcttcttgagctaatttttgtataaggtgtaaggagtaggtccagtttctgttttctgcatatcgctagccagttttcccagcaccatttattaaatagggaatctcttccccattgcttgtttttgccaagtttgttgaagatcagatggttgtaggtgtgtggtattatttctgaggtctttgttctgtttcattggtctatatatctgttttggttccagtaccatgctgttttggttactgtagccttgtagtatagtgtgaactcaggtagcgtgatgcttccagctttgttctttttgcttaggagtgtcttacctatacgggttattttttggttccatatgaaatttaaagtagatttttctaattctgcaaagaaagtcaaaggtagcttgttggaatttcattgaatctataagttactttgaacagtatggccatttcacaatattgattcttcctatccatgagcatacaatttttttccgtttgtttgtgtgctctctgattacctcgcagtggtttgtcattctccttgaagaggtcctttacgtcccttgtaagttgtattcttaggtattttattctctttgtagcaattatgaataggcgttcactcatgatttggctctctacttgtctattatcgatgtataggaatgcttgtgatttttgcacactgattttgtatcttgagactctgctgaagttgcttatcagcttaaggagattttgggctgagatgatggggttttctaaatatacaatcttgtcatctgcaaacagagacaatatgacttcctcttttcctaactgaatacctttcatttctttctcttgcctgattgccctggccagaacttctaatactatgttgaataggagtggtgagagaccgcatccttgtcttgtgccagttttcaaagggaatgcttccagcttttgcacattcagtatgatattggctgtgggtttttcataaatagcttttattatttttacatatcttctatcaatacctagtttattgagagtttttatcatgaaaggatgttgaatttgatcaaaggcccttttctgcatctattgagataatcatgtggtttttgtcattcgatctgtttatgtgatggattatgtttattgacttgtgtatgttgagctagccttgcatcccaggggtgaagtcgacttgatcttggtgggtaagctttttgatgtgctgctggatttggtctgccagtattttattgaagatttttgtattgatgttcatcagggatattggcctgaaattttctttttttcttgtgtttctgccaggttttggtatcaggatgatgctggcctcacaaaatgagttagggaggagtgcctctttttcttttgtttggaatagtttcagaaggaatggttccagctcctctttgtacctctggtagaatttggctgtgaatccatccgttcttggacttttttggttggtaggctattaattactgcctcaatttcagagcttgttattggtacattccaggatttaacttcttcctgttttagtcttgggagggtgtatgtgtccaggaatttatccatttcttccagattttctagtttatttgcatagaggtgctaatagtattctctgatggtagtttgtatttctatgtgatcagtggtgatatcccctttatcatttcttattgcatctatttgattcttctctcttttcttcttcattagtctagctagcagtctattttgttaagcttttcaaaaaaccagcttctggattcattgattttttgaagagtttctcatgtctctgtctccttcagttccactctgaacttagttatttcttgtcttgtgccagcttttgaatttgtttgctctttcttctctagtttttttcattgtgatgttagtgtgttgattttttatctttcttgctttctgatgtgagcatttagtgctataaattctgctcttaacactgatttagctgtgtcccagagattctgggttcgttgtctctctctttgttctcattggtttcaaatagcttatttatttctgccttaattttgttatttacccagtagtcattcaggagcaggttactcaatttccattagttgtgtggttttgagtgaatttcttaatcctgagttctaatttgattgcactgtggtctgagagactgtttgttatgatttccattcatttgcatttgctgaggagtgttttgtttccaattgtgtggtcaattttagaataagtgttatgtggcactgagaagaatgtatattctgttgatttgtggtggagagttctgcagatgtctattaggtcttcttggtccagggccaagttcaagtcctgaatatccttgttaattttctgtcttgttgatctgtctaatattgatagtggggtgttaaattctcccactattgctatgcaggagtccaagtctctctgtagtcctctaagaacttgtcttatgaatctgggtggtatattggctcatatcccagtatgtggataccactgtattgggagcatatatgtttaggatagttagcacttcttgttgcattgatccctttaccattatgtaatgtccttcttttccttttttgatctttgttggtttaaagtctgttttatcagagactaggattgcaacccctactgttttttgctttccatttgcttggtaaatattcctccatctttttattttgagcctaagtatgtctttacatgtgagatgggtctcctgatgcagcacatcgatgggtcttgattctttatccaatttatctgtcttgtctttaattggagactttagcccatttacattaaatgttaatattgttatgtgtgaatttgatcctataattatgacgctagctggttattttgtacattagttgatgcagtttcttcacagtgtcattggtctttatatttttgtatgtttttgcagtggccgttactggttgtttttttttttccatatttagtgcttccttcaggagctcttgtaaggcagacctggtggtgacaatatccctcaacatttgccttgtctggaaagcattttatttatgtgcttattaagcttagcttggctggatatgaaattctcgtttgaaaattattttctttaagaatgttgaatattggccccctcctgggttcaagggattctcgtgcctcagcctcccgagtagatgggattaccggcacgtgccaccacacctggctaattcttgtatttttagtaaggacagggtttcaccatgttggccaggccggtgttgaacacctgacctcaggtgatccacctaccttggcctcccaaattgctgggattacaggaatcagccattgtgctctgctcttcttctcctttttttgtccaattttttgttatatgttttatatctatatgtgctgcaaatccaataatacattatttaaattaaattattattaaatcttatataattgtatgtcttttaagaatgttgacaaaaaatgtagatcaagtatatattcacagaatctgttacattgatgtttttgcttatcatttttggttttcttcatttgttgctgtagattcaaattaccaactggtatcttttccttgttccaatacagctttgctctcacccaccttctttttcttgttattggcaaatatatatacagatctcacaatacaattatatacatattgttttatataattgatttttaagtcagttaagaggtggttggagaatacatatgcaattatgtcattgtaattatctacctagttacctttactggtactctgttctttgtgtagacttaaattacttgctgggtcactttctttcagcctgaaggactttttttagtattttttgtaagatagctctgttatcaacaaattctctcagtttttgtttatcttgaaattatctttatttcatctttatttttgaaagacagttttgctcaacataagactcttggttggcagactttttttcttctactattttaaatatgtcatatcacattccattgcctttcagcctccattgtttctaaaagttagctgttaatcttaatagggttcttttgtacacactgctttcaaggtgttttatttttttttcttttaagcatgtttactgggatgtttctgagtagagatttctttatcctacttggagtttattgaaattcttaaagcatagataatgtttttttcaaatttaggaaagttttcaaccattattttaaaaaatgtttgtattcctttctttccttttcttctatttcaattatgtatattcttgtgattaacagtattccatatttctttgagattgttcatactccttcattctttttttctgttttttttttctgtgctattgcaataatctctgtgttcttccagcatcagtctcttacaccctcaaaattgctctattaaatgaagacacattaatatttttgaaacattgctttacactcatcactccctaacttgaaagcttctcataactctccattgtctatactgaaaataagtttagagattgccattgattggctattttgtacctcattaacattatttcccctatttcccttcacaaatcttttaatctagtcaaattggcctgtcagtaaaaccagttttaatctcaacctctacagcactttatgcttatcactcatttcattatagtacttcatattgtcatttttacttattttttaatacagtgaattttaagcctctggaattcagttgtttaataccctaacacttggtacactactctgaatgttaggaatagtaagaaatataattgtcgataatgttgtgatacacaacatgacatttaatcatgtttcaattagtgacagtcaataagtataatcaaagcacaaaaattctctcccaagaataaattggtagagttggaaattgaaggaaaatgttaacttaacaagtaattatataattattctttcccactgaaatcaattgatgactctgatgtatattgattaaaaatgctttaatatgtacaaacaactgcaaatatactgttttgttcaattaatggtttgacaatttagtgaagtgctggatggaaaagacatataaactaaggggagtggatctctcccctggctgtgtcacttttttatttctctctattcccacatcattaccaaagccagtaatctccaaccatctatttctcaatcttaagactattgttcagggctgggcttggtggctcatgcctgtaatcccagcactttgggaggctgagaacaggtggatcacgaggtcaggagattgagaccatcctggctaacacggtgaaattctgtctctactaaaaatacaaaaaattagccgggcatggtggcacacacctgtagttccagctactcgggaggctgaggcaggagaatcacttgaacccaggaggcagaggttgcaatgagccaagatcgcaccactgcactccagcctgggtgacagagcgagactctgtctcaaaaaaaaagactattgttcagacaagttcctgagcaaaagttttctctttctaagacatcatgatctacatataatgttagcaattctattttacatatggcacagtatgtatatttttgtacagtgtgaatgattatggtcaattttttattatttttttcttctttagtcaacatagggtaaaataaagaaaaggcaatttcagaaagcatgccaagcagcagatattgatttgttgtttgttaattccttgccctttaaacaagttgaataaagctatcttgatatcctatttggatatgcttatgttattctgaagctaatctgaaaatttaaagctatatgcatgtaaacttctatgtaatagatatgtaatagataaacaatgtattacataggtatctatgtaatagataatgtattacataggtatctatgtaatagataaacaactgtggtaatacaagaataaataagggtacttactgaaaataaaaaagaaacaaatattgcatttcagaacacaagccagtttaaccaaaatgagaaagaattaaactgaaagcataactagaaagataagcatgttatgtgcagaagtagcttcatttctatttccttctctttttgatcctttattcaaaatcttagggagtctaaacagaataacccatcccctataagaaattatcatttttgttttatgcaaaatgaatacatcattaaaatgatttttaaaaatcatgaaatgtagtatctgtgttcattgtctaatggaagtttttaaaaatgtatttgatagaataattttaatagttcattgtatgctttaaatagcaagtatttctctgtatgaaaggagtttgcatgtattatagataaaatattgatcctagtatggattgtcattgttgtcctagtctgtttcatgttgctgtaacagaatactacacactacgcaatgtataaacaatagaggtttatttggcttatgattctggaggctgtaaaggccaagattgaggggcaacatctgatgagggacttcttactgtgttataacatggtggaaggtatcacatgttgagagatgtgcaagagagggaagggggctgatctaatcctttcatcagaaacccactcccatgataaccaacccactctcacaataactgtattaattcatccatgagggcaaagcccccatgtcctaatcacctcttaaaagtctcattctcaatactgttgcattggggattaagtttccaacacatgaattttgggggacacattcaaaccatagcaatagtaatacatttcattatgtagataagtatgtatgtgtggtcttcaattctaaacttattttgtcttcaaactttaataattaaaataactccacatgaaattagatttatgtgtgaaggatgtaaagtgataaaagttatataattttacaggtaattttatgaattatatagcagacaattattgcaactctaaagattgtttacaaattcaacaaaaatattgggattcatagatataagtttatcctattatgacaaacatagaattaacattattattcctttatctttaaattcccttagtcaaattttttaattcttacagatgaatataatttaaattagattcaattaaatattttttttctttaggaaaaagtcaaagagaaggaagaaaatctgaatcttgtaaaccaattcttaaagtagaatacaagacctgcaaaaacaggtatgcatttttactttagggaaagagggatacgaagcagagacaaaaaatgcagatgacctttaatgttaagatattgtttaaagttttacaaaattgtaaagacaactgaatcctcaatattaacataattgacttgtctcatagacatatctctgatgattattattatgattattataaattacaagtgttaattatttcaggattcttaatgaacatttagacaagtattatacacattaattttaacagtaaaggacttctggccatgcatattacaagtagcaggatttattaagcagaagcaatgtgcccgttaatattgcatgtgaaagacttaaatacataaccaagtgtctatactttaagatcttacattctgaagttggaagattacagtttgttcgaaagataaagttgtgtatattaatgtaataaaaagtactaaattttaaggtgttgaaaaatacaaaaataataatatttagtaaaatattattttgtgtttaaagtagctatatccggctgggtgccctgcctcacgcctgtaaccccagcactttgggaggctaaggcgggtggatcacctgaggtcaggagatcgagaccagcctgggcaacatggcaaaaccctgcctctgctagaaatacacaaaaaaattagctgggcatggtggcatgtgcctgtaatcccagctacttgggaggctgaggcacaagaatcctttgagcccaggaggtggaggttgcagtgagccaagatgctgccactgcccttcaacctgtgcaacagagcgagactctgtctcaaaaagaaaaaaaagtagccatatcctataaatcaacaagttccttttacttggcaataataattagtggcaatacactcattgagaattaccataataaatcttgcctaaacattaaatttattttaattcaaattaaataatcctagtttatattaataatatgaacattttataatgttttcttggtatcataggtatactgaatgtttgtttataactgctcttttaaaattttaatagtacaaaattatgctcatttttaacctgttattttatctatatatagatatctctttagcctactatgcattcactgataaaaatgaacactgtttgaacagagccctcagaaataacaccacacatctacaactatctgatctttgacaaacctgacaaaaacaagaaatggggaaaggattccctatttaataaatggtgctgggaaaactggctagccatatgtagaaacctgaaactggatcccttacttacaccttatacaaaaattaattcacggtggattaaagacttaaatgttagacctaaaaccataaaaaccctagaagaaaacctaggcgataccatgtaggacatagacgtgggcaaggacttcatgtctaaaacaccaaaagcaatggcaataaaagccaaaattgacaaatgggatctaattaaactagagagcttctgtctggtgaaagaaactaccatcatagtgaacaggcaacctacagaatgagagaaaatttttgcaatctactcatctgacaaagggctaatatccagaatctacaatgaactcaaacaaatttacaagaaaaaatcaaacaaccccatcaaaaagtgggtgaaggacatgaacagacatttctcaaaagaagacatttatacagccaacagacacatgaaaaaatgctcatcatcactggccatcagagaaatgcaaatcaaaaccacagtgagataccatctcacaccagttagaatggcgatcattaaaaagtcaggaaaaagcaggtactggagaggatgtggagaaataggaacacttttacactgttggtgggactgtaaactagttcaaccattgtggaagacagtgtggcgattcctcagggatctagtactagaaataccatttgacccagccatccccttactgggtatatacccaaaggattataaatcatgctgctataaagacacatgcacatgtatgtttattgcagcactattcacaatagtaaagacttggaaccaacccaaatgtccatcagtgatagactggattaagaaaatgtggcacatatacaccatggaatactatgcagtcataaaaaaggatgagttcatgtcctttgtagggacatggatgaagctggaaaccatcattctcagcagactatcccaagggcagaaaaccaaacaccacatgttctcactcataggtgggaactgaacaatgagaacacttggacccaggaaggggaacatcacacaccggggcctgtcatggggtggggggaggggggaaggatagtattaggagatatatctaatgtaaatgaggagttaatgggtgcagcacaccaacatggtgcatgtatacatatgtaacaaacctggatgttgtgcacaagtaccctagaacttaaagtgtaatagtaaaaaaatactaataacaaaaaaacccactgttttataccattataactaaagtattagaaagtttcaaatttaatcattattaatggaaatatgaaatatatgacatatattttgcctcttgaaatattacttatagtttaagctttgcttgagttttcaggttcaacattatttacaatatttcttatgtggtattgcacttcaaggattattaaggtgcaggacactatattaactgttcctagcagcttgtggtattattttatgggtttttttcacattatatatagtttattatactttaagttttggaatacatgtgtaaaaagtgcaggtttgttacatagttatacacgtgccatggtggtttgctgcacccatcatctacattaggtatttctcctaatgctatccctcccctagcctcccaacccccacaacccccaacaggccacggtgtgtgatgttcccctccctatgtccatgtattctcattgttcgattcccaattatgagtgagaatatgcagtgtttggttttctgttccggtgttagtttgctgagaatgatggtttccagcttcatccatgtccctgcaaaggacatgaacttgtcttttttaatagctgcacagtattattccatggtgtatatgtgctacattttcgttatccaatctatcattgatgggcatttgggttggttccaagtctttgctatagtgaatagtgctgaagtaaacatacatgtgcatgtgtctttatagtagaatgatttataatcctttggatacataaccagaaatgggattgctcggtcaaatggtatttctggttctagatccttgaggaatcgccacaatgtcttccacaatggtggaactaatttacactcccaacaacactgtaaaagcattcctatttttttatgtttttttattttttatttttattttattattatactttaagttctagggtacatgtgcacaacgtgcaggtttgttacatatgtatacatgtgccatgttggtgtgctgcacccattaactcatcatttacattaggtatatctcctaatgctatccatcccctctccccccaccccatgacaggccccagtgtgtgatgttccccttcctgtttccaagtgttctcattgttcaattcccacctatgaatgagaacatgcagtgtttggttttttgtccttgtgatagtttgctgagaatgatggtttccagcttcatccatgtccctacaaaggacgtgaactcatcctttttcatggctgcatagtattccatggtgtatatgtgccacattttcttaatccagtctatcactgatggacatttgggttggctccaagtctttgctattgtgaatagtgctgcaataaacataacgtgtgcatgtgtctttatagcagcatgatttataatcctttgggtatatacccaataatgggatggctgggtcaaatggtatttctagttctagctccttgaggactcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccattttttgatggagttgtttgtttttttcttgtaaatttaagttcattgtagattctggatattagccctttgtcagatgagtagattgcaaaaattttctcccattctgtaggttgcctgttcactctgatggtcgtttcttttgctgtgcagaagctctttagtttaattagatcccatttgtcagttttggcttttgttgccattgcttttggtgttttagacatgaagtccttgcccctgcctatgtcctgcatggtattgcctaggttttcttctagggtttttatggttttaggtctaacatttaagtctttaatccatcttgaattaatttttgtataaggtgtgagtaagggatccagtttcaggtttctacatatggctagccagttttcccagcaccatttattaaatagggaatcctttccccatttcttgtttttgtcaggtttgtcaaagatcagatagttgtagatgtgtggtattatttctgaggcctctgttctgttccattagtctatatctctgttttggtactagtaccatgctgttttggttactgtagccttgtagtatagtttgaagtcaagtagtgtgatgcctccagctttgttcttttggcttaggattgtcttggcaatacgggaccttttttggttccatatgaactttaaagtagtttttttcaattctgtgaagaaagtcattggtagcttgatggggatggcattgaatctataaattacattgggcagtattgccattttcacaatattgattcttcctacccatgtgcatggaatgttcttccatttgtttgtgtcctcttttattttgttgaacagtggtttgaagttctccttgaagaggtccttgacatcccttgtaagttggattgctaagtattttattctctttgtagcaattgtgaatgtgagtttactcacgatttggctctctgtctgttattggtgtataggaattcttgtgatttttgaacgttgattttttatcctgagactttgctgatgttgcttatcagcttaaggagattttgggctgagacgatggggttttctaaatatacaatcatgtcatctgtaaacagggacaatttgacttcctcttttcccaattgaaaaccctttctttctttctcctgcctgattgccctggtcagaacctccaacactatgttgaataggagtggtgagagagggcatccctgtcttgtgccagttttcaaagaagcattcctattttttctacatcttctccagcatctcttatttcctgactttttttctttctttttttttttttttttttgagacagagtctcgctctgtcaccaggctggagtgcagtggcgtgatctcagcacactgcaacctctgcctccggggttcaagcgattctcctgccccagcgtcctgagtaactgtgactacaggcatgtgccaccattcccagctaatttttgtatttactttagaagagacagggttacaccatgttggccaggatggtctccatctcttgacctcgtgatccgaccgcctcagcctcccaaactgctgggattacaggagtgagccaacatgctggcctgtttcctgactttttaaggatcgccattctaactggcatgagattgtatctcattggggttttgatttgcatttctctaatgaccagtgttgatgagctttttttcatgttttttggccgcataaatgtcttcttttgagaagtgtctattcatatacttcgccaacttttagatgaggttgtttgttgttttcttgtaaatttgcttacgttccttgtagattttggatattagccctttgtcagatggatagattgcaaaaatatcctcccattctgtaggttgcctgttcactctcatgatagtttcttttgctgtacagaagatctttactttaattagatcccatttgttaattttgccttttgttgccattgcttttagtattttagttatgaagtgtttgcccatgcctacatcctgaatgatattgcctaggttttcttctagggttttatggttttaggtcttaagtttaagtctttaatccatcttgtgctaatttttatataaggtataaggaaggggtccagtttcagttttttgcatatggctaaccagttttcccaccaccatttattaaatggggaatcctttccccattgcttgtttttgtcaggttcatcaaagatcagatggttgtagatgggtggagttatttctgaggactcggttctgttccattggtctgtatatctgttttgataccagaagcatgctgttttcgttactatagccttgcagtatagtttgaagtcaggtagcatgatgcctccagctttgttctttttgcttagcattgtcttggctatacaggctcttttttgcttccatatgaaatttaaagtagctttttctaattctgtgaagaaagtcaatggtagcttgagggggatagcattgaatctataaagtattttgagcagtgtggccattttcgtgatattgattcttcctatccattagcatggaatgcttttccatttgtttgtattctctcttatttccttgagcagtggtttgtagttctccttgaagaggtccttcatgtcccttgtaaattgtattcctaggtattttattctctttgtagcaattgtgaatgtaagttcactcacgatttggctctctgtctgttattggtgtataggaattcttgtgatttttgcaaattagttttgtatcctgagactttgctgaagttgcttatcagcttaaggagattttgggctgagacaatggggttttctaaatatgcaatcatgtcatctgcaaacagagacaatttgaattcctccctttctatttgaataccctttatttctttctcttgcctgattgccctggccaaaacttccaatactatgttgaataggagtggtgagagacctcatccttatcttgtgcctgttttcaaagggaatgcttccagcttttgcccattgagtatgatattggctgtgggtttctcataaatagctcttattattttgaaatatgtttcaatacctagtttattgagagtttttagcatgaaggggtgttgaattttatcaaaggccttttctacatctattgagataatcatgaggtttttgtcattagttagttctatttatgtgatggattacgtttattgatttgcatacattgaatcaaccttgcatcccaggtatgaagccaacttgatcgtggtggataagttttttgatgtgctgttgtgttcggtttgccagtattttattgaggatttttgcattgatgttcatcagggatattggcctgaaattttgttgttgttgttgtgtctctgccaggttttggtatcaggatgaccctggcctcataaaaagagttagggaggagtctctctttttctattgtttggaatagtttcagaaggaatggtaccaactcctctttgtacctctggtagaattcggctgtaaatccatgtggtcctgggcttttttgggttggtaggctattaattactgcctcaattttagaacttatttgttcagggatttgagtttttcctgggttagtcttgggagggtatatgtggttaggaatttatccatttcttctagattttctaatttatttgcatagaggtgcttatagtattctctgatggtagtttgtatttctgtgggatcagtgatgatatcccctttatcactttttattgtgtctatttgattcatctcatttttcttatttattaggctggctagttgtctatgtattttgttaatcttttcaaaaacccgcacctggattcattgattttttttgaagggtttttcatgtctctatctccttcagttgcactgtgatcttagttatttcttgtcttctgctagcttttgaatatgtttgctcttgcttctctagttcttttaactgtgatgttagggtgtcaattttagatctttcttgctttctcctgtgggcatttagtgctataaatttctctctaaacactgatttagctgtgtcccagagattctggtacattgtgtctttgttctcattggtttcaaggaaattatttatttctgccttaatttcattatttacccagttgtcattcaggagaaggttgatcagtttccatgttgttttgtggttttgagtgagtttctcaatcctgagttctaatttgattgcactgtggtctgaaagactgttatgatttttgttcttttgcatttgctggggaatgttttacttccaattatgtcatcaattttagaataagttcattgtggcactgagaagaatgtatattctgttgatttgtggtgcagagttctgtagatgtctattaggtccacttggtccagagctgagttcaagtcctgaatagccttgttaattttttgtctcattgacctgtctaatattgacagtggggagttaaagtctcccactattattgtgtgggagtctaagtttttttttgttggtctctaagaacttactttatgaatctgggtgctcctgtattggttgcatatatatttaggatagttacctcttcttcttgcattgatccctttaccattatgtaatgcccttgtttgtcttttttgatctttgtttaagactgttttatcagagattaggattgcaacccctgcttttttttttctttccatttgcttggtaaacagttctccatccttttattgttagcctatgtgtgtctttgcacataagatgggtctccgtaatacagcacactgatgggtcttgactctttatccaatttgccagtctgcgtcttttaactggggcatttagcccacttacatttaaggttaatattgttatgtgtaaatttgatcctgtcattatgacactagctggttattttgcccattagttgttgcagtttcttcatagtgtctatggtctttacaatatggtatgtttttgcaatggctagtaccagttttttgtttccaaatttagtactttcatcaggagctcttgtaaggcaggccttgtggtggcaaaatctctcagcatttgcttgtctgtaaaggattttatttccccttcacttatgaagcttagtttggctggatatgaaattctggtttgaaaattcttttctttaatagtgttgaatattggccccaacttttttatggcttgtagggtttctgcagagagaactggtttagtctgatgggcttccctttgtaggtaacccgacctttctctctggctgcccttaacattttttccttcatctcaactttagtgaatctgacgattatgtgtcttgaggttgctcttctctaggagtatctttatgatattctctttattttctgaatttgaatgttggcttgtcttgctaggttggggaagttctcctggataatatcctgaagagtgttttccaactctgttccattctccctgtcactttcaagtacaccaatcaaacataggtttggtcttttcacatagttacatatttcttggaggctttgttcattccttttcattcttttttctctaatgttttcttcatgctttatttcattaagttgatattcaatctctgatatcctttctttcacttatcaatttggctattgatacttgtgtatgcttcatgtgctatgtttttcagctccaaggtcatttatcttcttctctaaactggttattctagttagtagttcctctaaccttttttcaaggttcttagcttccttgcattgggttagaacatgctcctttagctcagaggattttgttattacccacctctgaagcctacatctttcaattcatcaaactcattctccatccagttttgttcccttgctggtgaggagttgtgatcctttggaggagaggctttctggtttttggaagtttcagcctttttatacttttttgtctcatcttcatggatttatttacctttggtcttggtgaccttcggatggggtttttgtgtggatgtcctttttgttgatgttgatgctattcctttctgtttgtcagttttccttctaacagtcaggcccctctgctgcagttttgctagagtttgctgaaggttcactccagaccctctttgcctggttatcaccacgggagtctgcagaacaggaaagattgctgcctgttccttcctctggaagcttcgtcttagagggacacccaccagatgccagctggagctctcctgtatgtggtgtctgtcgatcactgctgggttgtgtctcccaatcaggaggcatgggtgtcaagggcccacttgaagaggctgtctgtcccttagcagagctcgagcactgtgctgggagatctgctgctctcttcagagtcagcaggcaggaatgtttaagtcggcttaagctgcgcccacagccacccctccgccaggtgctctgtccaagggagatgggagttttatctataagccctgactggggctgctgcctgtctttcagagatgccctgcccagagaggaggaatctagggaagccctctggctacagcctctttgtggagctgtggtgggctctgtccaggtcgaacttcctggtggctttgtttatactgtcagggcaataccacctactcaagcctcagtaatggtgacgcccctcccccaaccaagctggcacttcccagatcgacctcagactgccgtgctggcagcgagaatttcaaaccagtggatcttagcttgctatgctctgtggggttgggatccactgagctagaccacttggctccctggcttcagccccctttcctgggaagtgaatggttctgtcttgctggcattccaggtgccagcgaggtatgaaaagaaactccttcagctagctcggtgtctgcccaaatggcttcccagttttgcattttaaacccagggccctgatgacgtaggcactggagggaatctccttgtctgcgggttgcgaagaccatgggaaaagcgtggtatatgggccagaatgcactgttcctcacagcacagtccctcatggcttcccttggctaggggaggaagttcttcaaccccttgcacttcccgggtgaggtgatgccccaccctgcttctgctcaccctccgtggtctgcacccactgtctaatcattcccagttccatgagctgggtacctccattggaaatgcagaaatcacttccttctgtgttgatgtcgctgggagctgcagaccagagctgttcctatttggccatcttgctagcccagattccgcttcactttcatatatttttaaaaatcttttctctttccttcagttttgagccatgaggatttcttataatctttattgtgttatctactagtatccaatctttgattttctgtagactaagaaacttgaaagccaaacttgtaaaatgagagcaaatagatccatataatgcctgagaggttcttccatgacaatgtatacatgcctggactttatgacgtctattttattgcttggaggtctttacaatttgtatttctgttggattctcaacagtattcagcttaattcagttaaaacaacatttagtagttactactatagtttagtagctattactatataatatatagtataatatatatactatagtataatatactatataatatactatatataatatatatacactatatacagtatataatataatatatagtataatatataatatactatatagtataatataatatgtagtataatgtaatgtaatatatagtaataatatactatactatatatagtatgatatagtatatatattactatatactatacatagtataatatagtatatatattactatatactatacatagtataatatagtatatatattactatatactatacatagtataatatagtatatatattactatatactactagcttatatataatatactatatatgctagtataatatactatataatatatagtatatagtattatttagtagttattactatattactaaacaaatgcgatttgtttgatgttctgaaataagattactgcttgcttttgaatttgttatattctagcagtagaggcaaggacataaactagtgatttccatacaacatggaagttacttttatagagatatgctatgggagcacacaaaaagagcacctaacccagccttgaagggagtagggaggagaaccatgaagagagaaatcaggaaaattctttggcaaggagatgcctgagatgggactttaaggatgatcagatgttgccaagcaaagggaggaagagatgaaagtgaagagaacatatttttagaaatcaaaaactcaagttaaggcagtgtaaagtaataattaaaatcattggctttgaagtaagacagttgtgtgaccttgcaaagtttaattaactctcttaaagtttagtttccttatcaacaatacctgtctcactatgatattcatgagaattaaatgaaataatggatacagcctgtaatgtcgtcagtttgatgaagacacatagtgggtttcttagtagttactattattattgacatcattatttcatgtagttaaaattattcaagtattcttaattttttgctagtcaataatacaactatgtgtaaattaatcttcatatttgtaatgtgaaacaatcatattattgatgataattactgtcatcccacctacttgtgtacattagtacattgcttctgttttttgtgattactactttattacctctggagcttagcacacaaggaggttaaaaagcagaggggcagtgaggttaagaatactaaaatttattgccacagcaaaatgggccacagttaggaagtggaattatatagctatatccctgctccaactattacacggcagaaactgtacagttataagtcaggatggctgtcacagaaacaggaaccttaggaagagctctaccatataagctgcagcagtagggtctcttactggactgcataggtagcacatgtaagggatgtgttttcttctcggttttatgtcagaccagccaatcgcagacttgctttacatttccagagataaacagctatgtatatgggaatcatttatccccaatcaccaatttgcttactgacactccaactaagatggcctctaggcttaataattttatcctcttcaagataggaatattgatttatatactgactaccactagaattattaggtgctcttaagctaaagaaaattattttctgctaatcttttaatctgttcctattacggcagcctactgataggctttatgtataattaagttctccaagcctcaatatacccatctgttaaatggagataataatagtagttatctcattgggatgttataaggattaaataaaagaatgcatgtaaaattctgcatgcgatgcctagaatatcataaatactcaatatatgttagcatttaatatttattatgttacacaacttgtttaatcttgttgccttcattggaacaaacttttaatgctgttttctgtatgtattttacaaattatacatacagtaaaattaactatttttcttttggtgtacagtttcatgttttaaacacatgtatgatttctaaaactatcaccacaataaaaataaagaatatttccatcatttcccacaactctcactttctgtccctttatagtcactcctctccccaactcctaacccttggcaaccactgatttgttctccatcactatagttttgccttttggagactgttacatataagtggttatatattatgtaaccttttaagcctagcttctttcactcagcagaatgcctttgagattcatccaagttatgtatccataatttgttattttttattaatgctttctttaagtatgaggacatttcaagtatatggtcatttatttcttttataagaatccatctgataggtatcccttaatagaatctttgtattaaataacacctgacacagtttaggctggtacaacatttagtgtggtacagcattatcaaacaactgtgttcctttaatcactaatgatattcatgcaataaaaaggatctgtaatctaataaatgtgagaaattttgaattctataaaagtaaattggattgcttgccatatgatttctcagaatttttaacatatgctatgaaatgcaaaattcctgaaaggagatatggttttgcaagtgcaaattatcaaattatcaaaattaatttttttctgctcgacaactaccaagttgtattccacagtttgggaaacattaaactaaaaatgaaaaatgtgggcttttgagtctgggtttgaatctttgtcctggtactcactagctgcttgaccctggacaagtttaatctgcattaatcccagattattcatgtataaaatgggactaatagtactttcttcatcaaggttgttgtgaggattacacaaaatttactttatatatacacatagcacaatatatgccacatggtaagcactcagtaaatggtagctatttattactagaggcaatatataggagtgtttagaatcataggctttggagtctggtagatctcaattttcttttggttgttgcttcttagctgttatttaacctcattaataaaatgaggacattgcttatgaggattaaagatgataattaaatatttagtacagttaaccatgagtggttccctgagcactttcctgaggaaataactttttattcagtcactcagtagtttatagagaaatgcatatatattaacaactaacttcagacccagagtattctgatgcagagtcgtaattagagcagaagaggttttacttcctttcaatattagagaggacatatttccaatgtatatacaaaaaagcagggggggtaaattgctccttatcctatgcttggattagtattaggggatgagagtaaattcacctacttttacacaggaaaaaaatagatacgtatggcctttattaatattaatagtaggtagttaagcttaatattattattaatattatgaaaagatactacattctcttaagtcgtggcctttttttgcaaaacagagcaaaaaacaaaggtaaaaacccccacactatttcataaataactatattagaaatgctttttaaatctggataaatcttattaataatataaatatacattttatagaaataacaaatgtgctttttaatggcaccattagtaggttggtcatttaccatatcaaatcactggtgcaagactattactcaaatcaactgaagtaaaataagttagagtatttttgtttattttgcttataactcaaatatttatgtcagaatactgatagaattataaatagaaaataatacacacattttatatgtatgtttgtatagaagctttgttaaaaaaaaaaccctttttggttatatagccagcataagattagtaaatgtcccactgataatgtttggcgccacacacagtacaaaacggaagagaaaaggaaatcttacagagcgatttctagaaacaagtagattcttcagcttagcaaataggatgtaagtgaattatgtagatgagcattatattctcaaataatttgatacaataaaagcctctaggtctttaaaaaaattagaaaagaatattttcaatttggtatttacttcttacttcttgaaaatattttttgctaacacactttttcttttgtacacatacactagagatatgtaagtattgatttgagaaatgaaaaatgaaaaactgtgaaatgacttcataattttcagatagctataatgttttagaggaatcttaaccccactctattatctaattatatcttataaagcaacagaccaaaaatcttgtttaaagttagttgagcaagatatatggagtttatactgatctatagactggccacaagtaaaatagaaaaggcaatttatctttgattagctatccttctcttacatattagctttctccatctttttatctttactcttttttcacagaaactccattatctagaattcttattttaccctctgccattctgagctttccactgtcacatttcattttatattaaaatttgtctcttttctcttgtacagattttaggccccataggccagctaattaatctgatattctgacatagactaatattccaatgatagtgatttagagtttgggaaccaagtaaagtacgtgaagatgtccttttgagagtcagtgagcacatctaccttcctccaagctcactgcctttccccaaacctaccccaatatgtttagactggtccattagtaaatttaatgtgagaatgtacatctagaaagtgggaaatggtagaatagtaggttattgaatgagaaattttgagccgggcaagttttttgctgtctgtcatgttatatggtatgcaacaaaacctgttctttataggttcagtcctgtgactttgtgtcattttaaaggacttctgagtctcattcatgttttttcctatgtagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatggtaagtaactaaaatgaaactattaatgttgaaaatcattttggaaatgacaagtttctaacaaaattaaggttaaatattttcagatgtctactgtggtataacgctgtgagctacaagtgctggaacaggttctgcaactgtacctacttgagaaactggaaataacacagatgtagtacagcaatgctggcatttcaggttctaatatcaggtaagtgctttaaactttgattagatggtggaagctgagctgggagggtctgataagggtccagggtgaaatcacttggggaagctgaggtctcttaatagcctctctcagaccagctccatcaattccatcccaaagccaatcaaagttaaagcacttacctgatatcagtaatctgtaactgtggtggtgctgcatctgtttcacatctggctttgcttcagatgcaactgcagcacctctgattactctagtaatgcagatgtgtggttaatgactttttaaaattttgagaatagtcagaagggactttgggaggagaaatgcttatatatttttattatactgaatataaagactttttgtaaacataacaactagtctaaacttatatgcaatctgtataatgaaatctaataatgatgaaatattttaataatgtggccaggtgtggtgactcatgcctgtaatcccagcactttgagaggccaaggcaggcagatcgtttgagtccaggagttcaagactggcctgggcaacataatgagattccatctcaaacaaataaatagataaataaataaataaatctaaaaagtgagaaaagtgaaaacataaaaaaggaaatatgagtcatgttacaacaacatagtatgtgtgtatacattactatatttttaagacagaatatgcagatataagagaaagagcactggacttggggacagaatatgtgaggttatgatttagctctgccacttactagctaggtgaccttgggcaagtcactttacatttattagttttatttatcgtttgtagaaagagaatagtaatatggtctccacatgactactggaaggttaagtgagcatacttcttaaactataaaaatatatatgttgtgagttccactattatatgtattaacttactttaaattatttagtctcacatttaaaagatgggataaattgatattaaataataatcaatgtagcactttatttccaaagttactaggacagacaatttacttatgtttttaattgtcaaataattattgaatcattctatggccccagtactacaagaacttgttgagcatacagataaagtattaaactaatctctgatgtcaaattgcataaaatctggtcagatgagtgagattattatgacttgttaagtttaagtaatgaaagaccttaattaagtgctgagttgtatggttcagagtataaataatgtattaatttttaagttaaatagtcgtggtttcatgcatagtaatagcagtttttggaaagagagaaaggtaagtctgattatgagagagtagagttgtttagggaacagaagaagagagaaactgtcttacaatatttatgaatcatcagaatataagtgttttttggagttacaaaaatgaataatgaaagaatgtaggaagagagaacagaagaccaacagctgagcttaggaaaatgcctcctatgaaaagccttgaggaagaagatgtgtgagcaatagaaattgagaatgtgtggtctgtgtgtatataaatttctgcacgttggtagagatgttaggacaatttctaataaggttcaatgaagcataaatgcaatgtaaccattcctattcactttcaagccatatataaaaatctttgttttttagcaatgtggtaatgaggatggaacttttcacttgtcaaaagctaggagatgtactttaactctattgacagtgccggaaaggtttctgaccatatatccacctcaagcagaacctagtccaaaccaggaccccagaaactttcctaatctagctccttcattagaggattattctccatgtaaatcacatccttgagtacatccccagctgtaatctctgggattatcattggtgttggattgtgccccaggactctcggggcacaattggtagctcgtggagaggagggtgagcactgttagtgaggccaactcgagagatgagaattagggtaaaagccatttctgaggccagatctcctggtgagataacactaatattatttcaccctttttgggagaaggaaatatggacctggcagatttgtacaaaattctttcccaggagctgtacggaggccaatgggacaagcagaaatgactgccaatgaggagtcctaattggaaggggatcagtaaagattagagactaccacaaatgtgttggctaccctgaccacctagatgaatttagaactctacaaaggaacattgaaagcatgccagggttaaggaggactaaagaaagggccttgggccatggcaggctaaatgccacaccacaaatctttgccaattgggcttttattattcccttggtctgtttcaccagtccagaggactagaggtggtaagcacaatggagatgttgataaataggccaaattatacaaatgttttcaataatttgccctgtaaaatgagttcctcgtgcattatgaagcccttgagagacttctcaggttggtataaattttccaacagggccttagctactgccatggctatggcctgttgacaatagaaggcttcaatgcaatgctaaaacatgtaaactgtaactagtacatactgatatccttgagagacagggagctgaaaaaaatattgttgccgtgcctcaaagggactttttggtaatgtgaagtggtccatgaagccacgaaatggttttccaatatggtattgtggatatatttcacacagatactaaggttgtgagctatcccaaggcatgcttgccatctgtataaataattggctgttttacctttggctaaaagacatgtctagtaagagcatgcagttctgcctgttggacagacctgacatcaggaaagataagtaaagtggcagaattaagcaagttatattgggtcatggtaaggggaggtgaggatagaaaaagaactgcatagtttgctagactctttgtgatgtgaattgaggagagccccattagagtgtggaatacagacagtgaggggggccccgttactattttcattgtggcttttacaaaagaagagacaacatcaacttctttgagacaaggagactatagtatcctatgggtacggtttgtgtccaattctgatattttaattcacctagttggttagattttaaaaggggaaatcccctgaatgtcccgagagcatccctagtctggactggggaaagagggctaggggactccatcaggatttagttataaccaaatgttagaggatcttaggagaattcagaatctagtccagtctatagccaaataacaaggactttagggcaatgcacaatgttacaatctaataacagatacaattttgcttttcttagaagcataacttttcctctccacattgatcatataagaaatctcagctattagaacctcttgaagctagatggccagaccaagtcaggcattagattttacttatagtcttaaggttcttgggcctaccaggaagtgatagtttttacttactcactgtaaaactaggaactcttgaagacaagcattttaggcacatttttacatataacatttcagttcataccttggtaatataaccaatgttcccaattgtatcctgctttcaagagagataagatttttatttaacttatataaataaaaataagaatattcatttatagcttctgaattttaaggaatcaagtagggagaaaaagcaaatgcttccacctttgttcaatagaggatactttaccaaaatattgcaagctatagatagcttatgtcagaaaatttccttgaatttggaaaacaaaacatttaagcaacaaaaacattatccttatcaattacttaatttcatttaaataattctgtttggttggccaggtgcagtggctcacacctgtaatcccagcactttgggaggctgtgtgggagaatagcttgagctcaggatttcaagaccagcctgcacaacatagcaagatctgtctctactaaaagtcaaaaaaattatctgggtgtagtggtacacgcctgtagtcttagctactccagaggctgaggtaggaggatcaagcttgagcccaggagatggaagctgcagcgatctatgattgcaccactgtactccagcctggggaacagagtaagactgtttcaaaaaatttttttttctttattttgattagcaattttggactatagcccattgcaaatacttctagagaatttaaaacaataactgtggatgacaaaaacccagaacaatcatagccaaagatatgatgagaatttccaattgacaaggcaatttagatattttggtggcatacaatcatttaacataataatcattattatggcacatatcttggcatatcagaattttatacaattttacactttttaataaagccacaaatataacttaagggaagttaaacaccattcataatttgacagcacttcctgtattatttaccaaataaacctaatcatttaatatctgtacaagatgagagataaaccctttgaggctcttcagggggcctatgtggaaaattgtaaaattaattttaggccaaaaggcttaacttaagatttgggtcctggagagacctgccaaagatgttaaaaatttcaaaaactactttctttaatagaatggtgttcactgctaaataatagttacttattcaaccaaagtaagagtaaaaatcagaagatttcaaaagcaatacagaaagttacatggatgtaaaaaccttaacccttgtaaagttcagttttctgaagtagtcaaaacccaacaaggacagcatgaagtacaggaagtttccttggtaaaacacagaatctgtgtttcctaggctcatatattccttgagcaaggaatatgtggttcttagcaagagcatatgaagttctggttacataaaataattcagacacataaagaaaagccaagagtactcaatcaagttataccgagtaaaacattgcttttctggaccttcaggataaaagtaaaaccagagaaactaggtagttctcaggaagaaatgtgacagaaatagaaatttgtttgtaattcagaggatggttgttaaacacatttcagaattaaaaatcaaaacctcttgcaatcttactaaaagcaattgaacctttgttggctgggtgcagtggctcatgcctgtaatcccaacactttgggaggctgaggcagtggatggcctgaggtcaggagttcaagaccagcctggccaacatggtgaaacccccgtctctactaaaaatacaaaaatcagctgggtgaggtggcacacatctgtaatcccagctactcgggaggctgaggcagaagaatcgcttgaacctgaaaggtggaagttccagtgagccgagatcatgccactgcactccaacctgggcgatagagtgagactccgtctcagaaaagaaaagaagaaaagaaaagaaaggaaacctttgttgttttaacataggtgaccagatttttaaactttgtatcagtgtattttaacatcaaagtttattctttagaaagactgtcacaaataatttcttttaattatagccagcttaatcacacccagaatttccttcataagttcccattcatgaaccttatcatgatttactcagaccatctatggattactgagacaccctgcctcactctatacttcctctttcttcttaagtaaccagttatatcgctctaggaaaaagatttaccatgcaagactatctcatgcaaaattattctcttatctttacatctataactctccttacatctctttctgtctctactatttacagttcctttctatcttgtttctatttccttcctaaatccacattttgacactccctttagataacctttgaattagaaaaagttattttttctcaataaaagacatttttttctcttattaaacacaccttactttggcatactttatatacagaattatatatcaattggaatttttagcttctggtaaccttaaattttattaaaaacataggaaacacaaaatcttgatttgcctgttacatatcattatttaacagataacaaccattttatttttattatttttcatttttttactttttagagacagggtcttgcccttttgcccaggctagagtgcagtggcatgatcatggctcactgcagcctcaaactcctgggctcaagcaatcctctcacctcagccccccaagtagctgaaactccaagtgtatgtcaccatacctggctaattattttatttttttgtagagatgtcttgccttgttacccagggtggtctcaaacttctggcctcaaacaatcctcccaccttagcttcccaaagtgctgagagtataggcttgagtcaccatgcttggccaagagccattttataattgtcagaaaaacgtgtttccctataacatatttttatgcatatttagtctttctcttagtatttctagtctttctattaaatttaagaagccaaggacaaccctatttatgttcagcagtttgtttcagtttttatcgtatttgaaaatgacttgtacatttaatgagtcatctattatttaatttaggatttcaaattacataaaaatttatagctatttatcccatttacctttatttatttattttagcagtgtgctgagattacttatgaaaactgagataatagacaaactagtcatcattccaaattatttatctattacttattttatacaactgcatatcaggcaaatattataaaagtaatgaccttaaagtcaaataattcagaggacacaggcattcccatcaaatcaacaaccttagactagtcccatttgccaaaagatttctaagtcaaatgtgaacttgaaaagtgcctggtcttatttgcttaatttatgagtactcatctatttataagccaatttggtaccatagacaaatacaaccagacttgtacatgcagccagatacaagtctggttgtatttgtctatatcgggcaaatattataaaagtaatgaccttaaagtcaaataattcagaggacacaggcattcccatcaaatcaacaatcttagactagtcccatttgccaaaagatttctaagtcaaacatgaatttgaaaagttcctggtcttatttgcttaatttatgaatactcatctatttataagccaatttggtaccatagacaaatacaaccagacttgtacatgcagccagatacaaataatgatcaagctttaaataaagctttagccatatgtcaggcataactcactagttaaaagggatagttagattcaaacttcgtcactgttaaactaacaattttagtttaaatttttctgttccacgtggctgaagccccttactgaattttagagaaaccagagtagcaaagtagtcgggcggaccggcaggaagagaggagctagttgaagaaggttagctctagaatcaattagaaagccaataagtctcttttctacattagattacctaaggttcctagatcatagaggatccccagtcccattatttttaatcactatcagaaactggtatctggtgggctgattaatgggcagcttctttctctacctgccaggatgattagggcactcccatttccaatggtcctcttgtttataatatgcacattgtggcctcaagagtgtacggccattttggccagcagtggggtccctaagggtcttacccatggccatttgtttttcctagcatgctccatcttgtgcctcgactggtggtggccaagagccacagcaagcagcatagcttgttgtctcatgtcgcattgcttttgcccttcctggacttgaataagatgattaaatgccttaaaagcaatctcgactactggagatattgatattcccaacaccttttctactttttgtagttttcctcttatgccaggggcactgtgactgataaaactctcaggttacctggatgttcggggttaatgtcagtgtattgcctgaaggctttaaggaccacaagaaaggaagaagcattttctttggccactgttgtacctttatggcttgtgctgctggagtcctgctacaattaacattccccattttgcttggaagtttatctcagatggctagagcaaggccctgcactagaaagagatatatatattttgggtctgcaatgtggtacttatggagattccttcccagtgaatcacccaatgggttgggtatcctctagtctcctaggagtacctaaaagggctggagggagcaatgtagtccctctattaaataattttctaattaggctgtttctgtgccatcaaaatattaactgctgcttaagccaaatattactgctcatatcagaatacaaacagaaacagaaaaagccaatcaaacaagacaaaccacagcattttggactctgagtttgatccactcaaagggagcaaacagacaaggctcaaacttgtccctgcaagcttcagacatctttagtccattctggatggggaaggttgacctccagccaataatcaagcaaataatttactcagtctagttgactggaacagacagcgaccctgagtcaggcctccttggctgccactggcagctccttcagggtttgctgagtggtcttaacaacataaacaagtgactagacaaaccctaaacttgacacatatacatatacacatccaagttccaagttcccagtcaagttcctagtcaaatttataatcgagtgccacgtgaacatacccccttattcttctttcaatcaaagttgaaatcccctaacaaagcccccttgtggaggttgacaaggctccctagtggaagttgataagaaaggagctgagagttggtcacttgtacagagattaattcaccacaaaataaaaataaaaaagaggaaaaaaaatgtgttccaaaattcaaaacttctttttgctgcaaaaatgaaagtaaaagcaccaaaagtcagcagggccatgctggggagacaggaaccaagagtaaatcactgagtaaaacacctggacagctgctcagaccctcaagtggatcccatccctgatatggagctggtgagccacagtcaaaactgtcctgaaaggatttagagaagtccgatttgggtcaccaactttgttattgaactaaactgggtccatttgcccatgcacaatggaaagccaaacactgaagcagcaggtttttgcagcaagaaaggtttatcatgagtgaactggcaaggagacagatgtcaaatctgtctccccaagctggggattgaggaaggttttatagtcagcgcgtaataagtcatgatctgattggatcttgccataggatgatgccaggaggtatgctctgactggatccttccctggtgtgataccagggctctatctgatcggatcctgcagcctaccatgcaatgtatgcttcttaattttagtccctgttccttgttctgggcacttaggttctacctgtggttgcatgctttgtttatcttggcatgttcaggttacgtggccttcaatctgggagtccatggcaactgaagagctttgttatgtaaaagttgaaccagattgatatgatatggttacacaacctataaatatatttcaaattacattgaattgaaagtaaactttttattataagcagtgttgctcttatacagatgtgaatgtatgtcatatcccagagaagcagagatactattccctcagtacatctccttgtaggcataaaatcagatctaaaatacaaaggttatggaagaataagataaatgtttgtgagatcaggtgacagattcactgtcttcacataatccaatattatcatcactccatgattattgagatatatttatactatgctacttttaatttttttcttgttctttctagtgatcttaatattaaatttgagaagcacaactttttttaagtgctctttgttacttcttactttggcttatagtttggtcttctcacatcatttaaataatatttgtatagggataaaggaaatgcaattttgctgattttatagtatatacaatatgaaaacttttcattttttatttttacttgtagaatttcaagaaccctatgctgtcgtggtacttctggagaaagatctcattgtagttgatctgacacaaagcaagtaagttatccatgtacagattaacacttttaaactctatttattttagattattggcatttgtattcttttgataggaagtattctttgtgtgaatattggtttgctagaattacagaaatgcactttggttcaatggtgaaaattaaaccagaggaatttgggaaacactgagaaaattgtgagacaacttaaaggcagcacctgatgtttggacagaagcattggagactcaggacacataaaattgatcacatttttgttgtttccttaaagaaaatcaatcattatgaaaacttgtacaatgtgatagctgagtaatggaaaatgacacatgatagaagtattattgcactactgctgcagacaacacagaagaccagaatctcaggggcagagaagacaggggccttcttttacttttattcctttttcattatgtcacaggcaattgaaacaactgtagaataatgctataatagtggtgctctccactcctttacattgtcagtaaaaatctaactgtacatttttattataatggtaatagcatgaaactaatttccatcattgtatgttcttcgcccactgatcttttagcctcatatatttgtaacacaattttgtaagttgtctctccttggcctggaatgactttctcttcattttttcttcttattaatatctgtaagattctcaagtcagatatcacttccttatttaaaaaaattcattatctatataatttggccacatattctagtatgggctctcataccccccacatttctctcttcatagcttttgacacagatacaattttctatttgctgttgcttaaagattgtctccccactaggctgtaggctccatgaaggaggggctctgtctccacatggagtcagctctcaataaatttttgttgaataaatcagtccaaattctactcttcaagttgtttgtaaatgtaagatccagggttcttcctcatactaatttgcagatattgttctcggtgtttggaaagggatgtaggatttgggccattaaatcatcataactgggaattctgcttagctgccctatttatcaacattaacactttttgggtagatgtaaggatttatgcttattcttctaagaagttctaatatgagtcttattaaaacatactcttctaatctcattggtactcaactcgtctttctacgtcatatttgttggttactcgtactttgtctaagtatctaacatctttgcaggcccattatactttacctttcatgcccactttcttcagtatatatatatatatttttttatttaaattttgttttattgtgatagactatgtataacataaaagttaccattttatgtatacatacattcttgtgcttttcattaccctatataagtatgtgaattaacattttgtttgcaagttttcatctaacatttaccttctttagcatgtattaaaatctatgtggcattcccatttcattggttattacatgaaatttaacatgtcaaaaactgagtatgttctctttccttccaaatggttacctctcagctatactgaatgttaaacaagttgtaactttggaatctctttcaatttttttctttttatctttttctttccatttaatccccaacccgaaggcaagcattagggtttacaaattatttctattcttgatttctttatgtctaaattcctctagtaagtttttagttattatttctctttttaatatctttttgcctactctttgccaatgtactaaaacaatttttctcaaaaattttctcaatatttcactttgtcaggagcctattatcgttacctcttgctattatcaaattctaaattgtaggcctggtcttcaaggggtccatttatcttctaactctgtaatcttagaaatattaataatttctactctgaaacagagaatctctgatatatctagtttaacctctggtacctctagtttaacctacttgtcccttaactagacatgagtttttcctttacctgattttgcatatataactattcttatttgggatactatctgcaacatttcagattggtggaaagagaactcctgccagaacacacacacacacacacacacacatacacacacacacacacacacactatattctctggagattggactaaactcctaatttttaattaagttcctaataatatggcaaaaaactgttttgtaacaagcacctcctaccctaaaaaaacacagtgtgtcagaagttataggatgacacagacctggaacagatatagcatagaataatactaatttcctcctagtacagtgccttgtacatatgatgttctaaatagctacaggaattttaaatttgattctgaactcatttcctttttaaggttatagtaggcttgaggatatgaaagttattacatccataagtctttattccaactatgttctctagtttacataggaaatgatcttttagatatacacagtcacatacacacaaacctacatatgacacacatcttttcattattcctgcaaaaaaatttaaaagtttcctatatattacctctttgtcttagtcccttttatattgttataaaggaatactcaaggctagataatttataaagaaaaattatttgtttggctcacaattctgatgtctggaaagtccaaggttgagtgtctgcctctgttgagggtctcaggctgtttctactcatctcagaacgtgaagggaagtcagagtgtgcagaaatcacatggtgagaaagaaggcaagagagagaggggacaggtttcaggcttttttaaacaaccagctctcatgggaacgaagagtgggaactcgtccttaagggaagacattaatctattcatgaggaatctgcccctgtgaaggggaaagacatcccgatcatagcattcttcacctgaatccccaaaactcatgtcctcacataaaagatacaatcattcttttccaatagtctcaaaagtcttaattcattttaacatccattcaaaagttcaaagtccgaagtctcatctgagacacaaagtaagttactttcagctgtaagcttataaaatatgaaacaagttctttacttccaaggtaaaaatggttgtataggtattgggtaaacatttccattccagtaggaaggcgtaacaagtctcatgtagctttaaaacacagcagagtagacattaaatcttaaagctccaaaataattttctttgactccatgtcctgcatcctgggaacattggtgcaaggggtgggctcccaaggccttggcagtcctgtccccatgtttttgctgtgcacagcccatgtggctttcatatgttggagttgaatgcctgaggcttttccagactgaggttgcacactgctggcggctctgcctatgtggcaggtttcagcatgggcacccaggctttttgatatatcctctgatatctagggggcagctgccaagcctccatggctcttgtgttctgggtgcctgcagacttaacaccatgtggatgccaccaaagctatggcttgtgccctctggagcagcaaccccagcagtagctgggtccatttgagccatagtgggagctggagttgtagggatgtgaggaacagtgacccaaaggggcacagggcagtggtgccctaggcctgtcccccaaaaccattctgttctcctaggctcctgtgattgtgatgggatgggtggcctcaaagatttctgaaatgccttttgtccattgtcttgactattaataccttgctctcttactggtcatgctaatctctttaggaagtagttgcttagattcctctcctgaaaacactcttttctttactaccacatggccaggctgcaaatttttcaaatgttaatgctcgtgtcccttttaattatagattcttcctttaggtgattccattgtggacataatttagtgtaagctgttaaaagtaacaatgccacttcttgagcactttgctgcttagaatttttttcttccagatactctaggtcatcgctcttaagattagccttccataatgcagccaaattctctgctacagtgcaacaatgcagccaggttctttgctacagtgcaacaatggggatatttgctccagttccaataagttcctaatttctgtctgagacctcattagcatagccttttctgcccatatttctgtcagtattttggtcacaactacttaaccaatctctaagaagttccaaactttccctcatctttttatcttctgagctctccaaactcttccaacctctacccatcactcatttctaaagtgcttccacaatttcagttatctttatagcaacaccgcgctccttagtactaattttctgtcttagtctgttttgtgttactaaaaggaatacctgaagctagtaatttattttttttcaaaaaaaatgtttattttgtttacaagattgggcatctgtatgtggtgagaacctgagctgttttcactcatggtgaaaggtgaagcggggctgagctggtgtgtgcagagattacatgatgaaagaagaaacaagtgagaaggagaaggctccaggctctttttaacaaccagctctcacaggaacaaaaagggagaactcattcacctccaagacaggacattaatcaattcatgaaggatctgccccataagccaaacacctctcattaggctccacctccaacactggggactaaatttcaagatgaggtttggaggggacaaacatccaaaccatagcactcccattgaaagaaagtcaaaatttacttatattttaatatttataaggatactaaataaatatttaccaatgtatataggtaaagtgcttggtttatttttaatgaattaactaagtaaacttgttatataatagtttcagattaatagaattcattgtatctatattagcaaagcaatgccactgtggaatgttagaattatgagaagtaaattttgagcttgagtaaaattttactagtattaatattacattttataaattactattacaaaaagagcatttttgttcatacaattcttgttttatggtacttaaaaaacaagcaaaatttatagtgatgtttagagacattttagggcttactttatcaaaattattttctgtttttttctttgtaaaataacactgatatattgtctttatctattagttttccaatctttgaaaatccatatcccatggacattcatgaatcaccagttacatgcacagcatactttgcagattgtcctccggatttgattctagtactgtattctataggagtcaagcataaaaaacaaggatacagtaataaggtaaaagtagaaattataaataactttttttgtattcatatcacatgatcatacttttttccattactttattttcttacattccatataggaggacttaactaaattctttttaagttataagccaacatctattaaatacataacttcttaaattcaaattttctaaatgctacatagctttaagcctatagaaatataatttcttatacagaaggtatataattatatactaagatatacttatctagtatgtacatttatatactaagtatgtacttatactaatatatatttgagtcataagatgtaacctttattttagatgaaaaaatatgtttaaatgtccaacaatgatagattggattaagaaaatgtggcacatatacaccatggaatactatgcagccagaaaaaagatgagttcatgtcctttgtagggacatggatgaaattggaaagcatcattctcagtaaactatcgcaagaacaaaaaaccaaacacctcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcgcattgtgcacatgtaccctaaaacttaaagtataataataataaataaaataaaataaaataaagaaaataaaaagactcaggtcttcctagtttataattaattaatggtttaggaaacataattattaaaagttatttgttaaataacattctagaattttttattatagtttactacaagattcaactatttacaattgtaacagattatctattatgatttctattattctcccagggctcttgggatggacaacttcaagagacactatttacatagcttctatgttaaatggcaccacagtagtttggtggtacacagactatatgatgcatgtagcaacactgtatttgtacaattaaaaatacttctttgatttgtttatataaatggtaagattgattaaaatctatatttttaagggagatggaattgtgcatttagaggtgtttgttcaatgaaagaattaaaagacagctacacacttcattcttgatgattttacacttatttttctttaagtgagctttttatcattattttaagctattttcattttaaatttctaagccatttaaacatgtatatatattctttctggataatctgtttaggagtggccaatcagtggaggagcttggaaccttggagcacaaacatatccagaaattattattactgggtaagtagatgtgttttgtgagttattagttcatcaacaaaaagatgtttactgagtcttgatacttttccataattgtgttctatgcagaataatagtttaagtaaaagtaaaaatataagaaatagcttctacccaaagattctcatcttgacagaggatataatcaaaccattggaaacataataacagaaaagaaagcatagattatatcaccaggagaaggtcaaagttgggaagtcatgagatattagtcttcatggaaatcacagaatattagctttacaaaggcccttacaaacacttatctatttctgccaaattcaggaatcactgctctgtatctgtacgagatggttattttaaatatttctcaaaacttacagcaccagaaataacactcctttgtatgacaacccacttgatgttttaatattaggaacaaaaatagagacatagctaatgataaatatgagatttaaaaagtaattaagggatctgctaatgggaagatagagtaaatatattttttcctattcttcccactaaacaactaaaaactctggatattacatataagacaaacataagatgactgggaaatgtgaagacgcatcagaccaagtaggacccctaagtcttagagaatgacatggaagtcagttccctaagttttctttctgcctcatatatcccagaattagagctaaagaagctagtaacctagaactgggaataaacacaaattaaaaatcccaacaaaatctagctctctttaatcatagaatgaagaaagtggcagtgtatcaagacagaaaacatatggaaaataatctctctacttaggtttaacaacaacacacacacatacacacacacacacacacacacacacacacacacgcacacacctttctcccacacacacaagtgtggccccaccccaactcactccagtaaaagccaagtggagagcttagagtttcacccttatcagggtataatgaggtacccccaacttccccagagtgtcagataaagcagagtagggagctggggctttgaatcatggtgggtgaaacccctcccctgtggtgtcagtggggagctagaattctcaccactgcctagcagtaatgagtagctaccactccctatccccttccctgtgtcaacagaaataaatgaggaaggaagagaagaaagagggtgggactgcaaagtattaaggaaataatggctgaaaacttatcaaatttagcaaaacaacatgaaccttcagattccagaagctgagcaaaccccaataaatctataccaagataaattattgtcaaacttctgaacagtaaacactgaaagaaaaaaaatctggaaagccacagtagagaaatgacatctgacctatggggccaaaccaatttgaatgacagcagagttttcatcagaaaccctgcctgccaaaaggaaaaatgagtagttttcaagtactgaaagaaaagaactatcaatcttgaatcctataaccaatgaaaatatccttcaagaattaaggcaaaatcaagatcaaaatctatcatttccagatgcaataaactaaaagaatttttcaacaccaaatctaccattaaaaaagtagctaaaggaagttccctacacagaaaggaaatgaaccttggttcatcaagaaggaagaaataatgcaataataaaagtatggataaatacaataggctttccatctcttggatttttaaatgtatattttatggttgaagcaaagattatagtaacagagtctgatgttactataatcacattgtctggtgtggttctaaatgtgtatagaggagatatttaacacaattataaataagagagggtaaaaggatgtaaatagagttaaggcttttatatatcttgaactggtaataagatgacactcatagaatgtgataagttgtggtacaatgtaatacctaaaaaaactgtaaaaattatgcagaggtacacttaaaaacactactgacacgtcaaaatggaagcactataataattcaggtaacaggaaggcagaaaaaaggaaacagaaaaaattatatggtatactgaagccctaatatatcaataattatattaaatagaaatggtctaaatacttccattcaaatatagagattgacagagtgggttaaaaacatgaccaactatatgttatctgcaatacactcacttcaaatataacagcatagacaatttgagagtaaaaagacagaaaaaaaaactaaaaaaagaattaattgagagtgatatcaacaaggtgacagaataggaagccctagactttgttctccacaggcacacttactttacaacaatatgtggtccaaaaagccattaggacaacttcagaaaccgtttaggaagtcacagtaccccagacaagctcaaagccaagaatggtcacattgaaatgggtaagaaaagcagggcgtttcagccacatcagtcctttttccaagctggcagagctcacaattaggaggaaaagtgcaactcatggcttcacctttactcatggcttcacctttttgagggaaagaaaagagcggaagatatacacaatgttctggatatatgttatagcggctgctcaagggactagtttctgtgtcatctgatagagatctggcaaactttggattcctgggtgccactgagagcaaaatatatttcagtggcttgtagcatcagagaacctgcagtatttcagacagatactagagcagcaagatactacaagttcctgaaagaaactggaaaacttcactagttaggaattacatgcacaagcccagagaagacaaattcccataaaaggtttgagaggctcttagaatgtctacctgggctgatttatgaaaaatgttccctgtacaaagtcagtccataaggatatgactaatttttcacattaaagtcaacaaaaataaagcatacaaagagacagggaaacatggcccaatcaaagagacaaaaaaaaaaaaaagtccagtaactgattttaacccttttcctacttgccccgagaatactcactggcagcacttgcagctataacatttatgccaagataactttgcctcaaaatatctcacttttattattattgttgtatcactctagtatattgactttggaaataaaagacatcattctatttatagcattctggttttagtagtggtatttccatttacaaaatatagtaattctccatcactgaaaatgtcttatcctaggaaacatagcattcctacgtgtgaagttaacatcattcttgtacagttgttggctgaggattcatttggtgaatttattttttccgaaatagactattctgatgttagttctgttcagaaataactccaggaacagctttcatattttattttcaccttgaaaaccagtcagattttcttcagcctcaaaaagtgtgtttacgtaaaattaaaggagcactggaagcaaactgtactttttattctaaatgggaaaagggttaaagaaacagaaatctgtgtattacctgacaaagagttcaaaataatcatcttaaagaaactcaatatattagagaatacaaatagaaaactaaacaaaattagggaaatgatgcatgaacaaaatgagaatatcaacagagtttgaaattattaaaaaaaaacaattctagatctgaagtatatgataattgatttgaaaaattcattacagagtgtcaacaacagacttggccaagcagaagaaagaatcagtgaacttgaaaataggtcacttgaaattattgagtcagaggaacaaaaagaagagggcctaagagccttacaaacacattcaagtggactgatgtacacattatgggaatttaagaaggggcggggagagagagagagagacagagagagagagaatggagtagagagaatggagcagagagcttacttgaagaaataatggtcaaaaatttcccaagttggaggaaagaaatggaaattcaaattcaagaagcttaaacaagtccaataatatgaacccaaagaagctcataaagagacacattataatcaaactgtcgaaaatcaaaaacaaaaagaaaatcttgaaagcatcaagaagaaaagttcttatcacatgcaaggaaatccccatgagattgtcagcaggttttttagcagaagcatggcagactagaagggagtgggataatatactcaaagtgctgaaagaaaaaaaaccccaccaacttagaatgctatatttgtcataaccaacttcaaaaatgaaggagcaataagacctccctatataaacaaaaactgaaggaattcatcacaactagacatgtcttacatgaattgctgagagttccttcagttgaaacaaacacactagacaacaccaccgaagcatacaaaaacttaaaagctctctggtaaagttgaatttatagacaaatatagaatatcgtaagattttaaagatggtggataaatcactttgatttctggcatataatttaaacaataacaacataaaaattactataatactatgataatagatgcaaaatataaaaatatgtaatttgtgacatcaataacatgaagagatagtgaatgtaaaggagtagattttttgtatgtagttaaagttgttatagtttaaaatagattggtataactagaagatattttatgtaatcctgatggtaaacacgaagaaaatgcctatagaaggtgcacaaaagaaaatgaaaaaggaatagaagtatgtcactaaaaaaaaaaaacaaaacccaaaggaagccagcaagagaagaaaagaaagtcaaaataaccacataacatatagaaaataataaaatggcattagtaaattattctgtaccaataattatgttaaatgtaaattgattaaactccctaatcaaaagacatagaatggcttgattgaaaaaagtagaactatatgctgcctccaagaaactcactttagatttaaggacacacataggttgaaagtgaaaggatagaaaaagatgtaccatgcaaattgtaaccaaaagaaaatgagatgaatacatttatattggactttaagtcaataactcacaagggacaaagaaagacattacctaataataaaagagtcaatccaacagaaagatataaaaagtacaaatatgtatgaacataacaacagagcatcaaaatatatgaagcaaacattgacaaaattgaagaaacaaacagaataacacaataatagtaatatatttcaatatcacattttcagtaatgaacagatcaactagacaaaagatcaagaaggaaacagggtatttgaaaaacactatagaacaattgggcctaacagacatacaaaacactatacctagcaataggagaaaaatattctccttaagcacacatggaccttgttctaggataagtaatatgttaggccaggggtccacaacccctgggctgcagaccagtaccagtccatggcctgttaggaactaggccacacagcaggaggtaagtggcaggcaagtgagcattaccacctgagctctgcctcctgttagatcagggacagcattggattctcataggagtacgaaccctattgtgaactgcacatgcaagagatctaggttgcacgcttcttatgagaatctaactaatgcctgatgatctgaggtggaacagtttcatcccgaatccatctctcaccacccgcatctgtggaaaagttgttttccacgaaactagtccctggtgccaaaaaggttggggagtgctctgttagaccacacatctgtagatgcaagttattagtaatgttagttctttggttgagtggtttcaatacgattatattctgtatattaaatctatgttacatacattgttattttcatatcaagtattacatgatgaaaaataaaatagaattaaattttgtaagggtatatagagtctcagatcaacatcctgcagatttttcagcaataaaatttaaaaatatctataagtttataattagagtaaacatacaaagtcattcatagcatctttatttgtaacagccaaaaactgaaaacaacccaaatgttcatcatttggtgaaggggtaagtagagcatatccatacaatggaatactatttagcaacaaaaaggaacaaattattaatacatgtaagaaatattatcctcaaaaacattacgctaagtgcataatgcagacacaaaatgtagtagatattatgtgggttccacttatataaaaattctaagaaaaaaagaatctatataagcagaaagtagattattggggatctactagggatgagaaagagggttgcaaattgccatgaggtaactttttggggtaatggaaatgttctaaaactggatgatggtgtcaatgtgacaactgtgtaaatttactaaaaattatcaaactgtacactcccagtgggtgaattttatagttatgtaaattacatctgaataaagctgttaaagtagagtaagccactcagtgactaaccccctctcaaaataaaaaatcagttggctatatacatatggttctatttctggactctctaatatgtttcactgatatatgtgtctgtttttcaccactagcacaaaaactttattggagctttagggtgagacttaaaccttatgtagtttgagttctccaactttgtttttatttttcaaaattgctttggctaatctagtttcttttcttttgaaaaaataatttcagcttttattttagattcagggatacatgtgtaggattgttacatgggtatattagacacaggtagcgagcataatacccaataggtagttttcaatccaaatccctcgccttctctccccactctagtagactgcagtgtctattgtttctgtgtttatgtccatgtgtacttaatgtttagctcccagttatatgtgagaacatgtggtatttagttttctgttcctgtgctggcttacttaggattatagcctccagctccatccatgttgctgtaaaggacatgatttcactctttttttatggctgtgtaatattccatggtatatatgtactatattttctttatccaatccactgttgttgggtacctaggttgattccacatgccattgtaaatagcatggcaatgaacatatgagtgcatgtgccttttaggtataatgatttatattgctttggttatatacccagtaatgggattgctaggtcaaatggtagctctgagttctttgagaaatctcccaaccgctttctactttcagtagtggcttaactaatttacattcctaccaacaatgtttaagcattctcttttctctgccatctggcaagcatctgttactatttgactttttaataatagccattctgactgttgtacgatggtatcctactgtgttttgattttctttttttttcttcttttttttgatttttgagacagactcttgctctgttggcctggctggagtgcagtggcacagtctcggctcactacaatctctgtctcctgagctcaagcaattctcctgcttcagcctccccagtagctgggattataggcatgtgccaccatgcctggctaatttttgcacttttagtagagacagggtttcaccattttggccaggctggtctagaactcctgacctcaggtaatctgctggcctcggcctcccaaagtgttgggattacaggcatgagccaccgtgcctggccatgttttgattttcatttctctaatgattagtgatgatggcattttttcatgtttgttggctgcttgtatgtcttcttttgagaagcatctgttcatgtcttttgcccactttttaatgggattatctggttttcgctttttggtttgttcaagttcctcatggattctgggtattagacatactttgtcagatgcatactttgtaaatattttctcccattgtgtaggttgtctgtttagtctgttgatagtttcttttgctgtgcagaagctcttgagtttaattagttcttacatgtcaatttttggttttgtcacaatcatttttgggggcttggccataaattctttgccaaggctgatatcaagaagagtatttcttaggttttcttctaggattttagtagtttgaggtattacatttaaatctttaatccattttgagttaatttttgtatatggtgaaaggtaagggtctagttttcactcttttgcatatggctagccagttatcccagcacccctttattgaataaggagttctttccccattgtttgtttttgtcagccttgtcaaaggtcacatggttgtaggtgtgaggctttctcagttttctcttctgttccattggtctatgtgtctgtttttgtaccagtaccatgctgttttggttactgtagccttatagtatagtttgaagttgagtagtgtgatgcctcctgctttgttctttttgtttagctatacaggttcttttttggtttcatatgaaattttgaatagtttttttttctacttctgtgaggaatgatgtttgtagtttgataggaatagtgatgaatctgcacattgctttgggcgtatgaccatcagtttgtttatttctacaaaaaattgttttaccatattttaattgtgattacattgaatttatatgccatttaggggaacaaacatctaataagtcatacaattatcaataatatatatctccttttattaatgccttattttttggtcaacatcttacaattttcagcatacagatctggcacaaattgtgttagattttatctatttcttggttttggcactgttgtaagtggtactattttgttatttccaaatgtctattgctattcaatggaaatgcaattgatttttgtatattgatattgtgtgttacaattttgctaatcatttatgagttccagtatcctttttatagaatctctgagattttctacatagccatataatctgcaaatacaaacaattttatttcttcccttttagtctgtatgccttttatttctttttcttccctatttcagtgcttaacacctccaataagatgttgaataagaatggtgagagtgaacatttttttggctttgctcctgatcttaggggaaaacatgcaatctttcattattatgtatgttaggagatatctgtaggttgttcctacacaccctttatctggttatagaaatttcctgtgttcctagtttattgaaagttttttttaggaatggatgataaatcatgtcaaatgctttttctgcatttattgagatgactatatggattttcttttgtaatctgtcaatatggtgaattttaatatggtagttgattttttaagtgtttgccttacattcctaagaaaacccacttagtcattatgtactatcctttctatatattacttgatttgtattgccaatattttgttgacaatttttatgcctattctcatgaggaatatcggtttgtaattttctcttcttgtaatgtttttatgtggttttggtgtcagggtaatgctgagttcatcaaaagtgttgggaagtattttatcttcttctattttctcgatgagtttttatagaattgacatttgattattaccaaataatgatgcaactctagatatatttggtgatttgcttttatattttgaaacttaactgaattttactatgatattcaattcatatttatattaatatcaaaattatctatccttttattgaatataaataattttacatgaaaatatgttgttcactttccacaggccatttttcattgttctccattacatatataacctttttacagtaaagtctaaggaattattgttctttttctaatctttagattttagtatattgtttaagaaatgagccattgttttaagcttagaaatggtttagcatacattagttttcattaaagtggtatttttgaatcaaaattgtatcaacagtaactcaagtttctgtacatttggagtgattatgatttttatttagtatactttaattaatgctaatttatttctcatctagtcatgcagatggatcaataaaattttgggatgcttctgcaagtaagtttcaagtttctgtacaacagaaaccaattggttaatatttacttatagccagctaccactttttagtttgggcaattaaaatttcagatatatttttagcacacatatgtggctgtgttacaaaaatctattacctacactgttagatcagttgaaagtattatctctgctttacttctcttctataatataaggtaaacaagactaagtcactctttgtcagcaacccattatatctacaagaggcatgatacatcagaaaaagtaccaaactctgttaaattaactctgttcaaggaatttccttcaccctctacctgtgtggtcttcgccaagtgcttatatccctctagtcttcacttttttttccccactcatctaccacatcctgcaaagatcaaatgatttgataactataagaactctttttaaattcttgagaattatgtaacttacagaataaataaggtactctgctcaatgttgaaggaatgcaaagatacttaagacttcattatactcatatatacccttcagaaaaattgtagtcattagaaaagataaagaaatgcacatatataactatagggaaaacaatataagaactctcaatgcagtaccccagatctgtttgctatcagaaatgggagagtcttattgagacctggtagatccaggaaaggtattttgatggagttaacatttagtgtgagttttggaagttagttaacttttgacaggaataggagtgaagaacaagttaacagtgactctaagtttctgaagatgagtaaccaggaagatgtaggtaactcttttggaaataaggaataaaagagagctttgaattttttagtaaaaccataaaattcaagtaaaaatatccagcaggtaaggagaacagtcagaaatggaaaccaatgaagaagcagcataaaagtgatgtttgaagctgtagaaatgaatagcttctgaggaagactgcaataaacacacaagcagaggaagaaggttgaatattgatgatactcttagcccacaaggtagagtcccttgagcaagcaaactaactatcagcaagagaaaaggattaaaagatctaaacccacacattctgaagtccccttctgacttcacataataaaaagcaactgcctaaagagaaactccaaaggacaacagactttctgttgatgaatcttctcatgcaaacctgagtttgttcctggaacaaaattcattgcatagtgatgccattgctcctttcccaccacctcaaagtcactttttggcttttaaaatgtggagggccaggcgcagttgttcacatctgtaatcctagcactttgggaggcctaagcaggcagattgcctgagctcaggagttcagaaccagcctgggcaacacggtgaaaccctgtctctactaaaaaatatataatataaattagctgggtgtggcagcatgcgcctgtggtcccagctactcgggaggctgaggcaggagaattgctggaatctgggaggcagaggttgcagtgagccgagatcacaccactgcgctccagcctgggtgacagagcaagactccatctccaaaaagaaaaataacaaataaataaataaataaataaaataaaatttagaggacactttaacactttaattattagagtgaataacacccttaagcatgcataataatattttgagaagttaatttttaaataaatattttatcacatttagaatataaattgcaaatgattgcagcatgtttaatattttcactgtaatcaaggtcatatctccaacttaatggatgtcttaaaaaaattacttagtttgctaactttgtgaaacactgtctaatacagaaagcaaaatgaatttgaataactgagtttatattattatgtatcttagttttctattgctgagtaataaattaccacaatttaacaacttaaaacaatacccatttatcatctcactgtttctgtgtgttaggaatttgattataccttcgctgggtcctttgctcagggtgtcacaagactgtaatcaaggtgttggctggggctgaggtttcatgagactgaaggttctcttccaagcttatgtaatcgttggcagacttcattttcttgcacattcagagctcatggtagcttgctgcttcaaagctagcaagagtgtctctttaccttcagggagggcctcagtccctcttttaagggggccatctgattaggttttggctgttaagaataagctctttgttgattaactcaaagtcaactaattagggaccttaatgatgtctgcaatatcattttactgttgtcatgtaacataaataatcataggaatgataccctatctgacctcagaagccaggctatagcacgcaatacaatcctttgtctattttttaaaaaatctattttagcttgacataatttcaagcttacaaaaacattgcaaaaaaaaaaaaagtactatgaaatggtttatacctctcaaccagattctccaaatattcctttcctctccctggctctctcttttactctttatctcttccttccatacatttttctctcacacacatacatatatacatatagctttttttcttacgcatttgagagtaagttggagacacattacatacccctaaatacttcagtgtgtatttcctacaaacattcacttacataaccagacttcagtcatcaaaaccagtagattaacactgacacaacactattatctaatctccggattttattcagcttttgcaaatttatatatatacatatatatgtgtatatatatgtatatatacacataaatatatatactttttttttttgacggagtctcgctctgtctgcccaagctggagtgcagtggcgcagtctcggctcactgcaagctccgccccctgggttcacgccattctcctgcctcagccccagtagagtagctgggaccacaggcgcccgccaccacgccccgctaattttttttttttcttttttttttttttttgtatttttagtagagacggggtttcaccacgttagccaggatagtctcgatctcctgacctggtgatccgcccacctcggcctcccaaagtgctgggattacaggcgtgagccactgcgcccggccgcaaattaatattctttacgacaaaaaaatccaggattatttttgcatttagtcattgtatcttctgagttttaaaaactctggaaaagttcctgagtcttcatttcatgacactgacatttttgaggagttcaggccggttattttatagaatctccttcagtctggttttgactaatgtttctcattattagattcaggtgatgcacttttcacaggattcatatttaaaactttactcaaggatcctttgtagaatcatagttcttttatagagttattatcatcatggtctccaatggaaaaatattcccccaaatattcttaaaaacagttcacaaacacaatgtatgagattatatctgaccctttcttgacacagagccactcagaaaagatcccttctcaaatagttacagattcttggactcccaatattgctaactggtaaattacaatgtttcttatctgaaggagtgtctaaaaatttgttgagagtagtaaaccctctaggaataccatcaacctctcacctaacaatcaaaggggaaaactgagataaagaatagaggagtctccgctagggaagaattattttcagtattcccattttagactttctgtgccccaatatttttatcaataaataatgataaaaatacttccttcatgagacttttctgagaatgacacaagaaagcaactatatattccttggtatgtagtatatattcaaggaatgtttatttttttccctgtagtctccctctagctgctgtactgatatgaaagcgtggcattgaatgctttactggttaaaatgtaattcactttgtctacttaggtttacttttgttgtttaacaaatatattggaaaagctttaataacatctaagaattaagtttaaattagaagataactgtgcttcgatgtcttatagtaactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtggtaagttatttaaaatttaactttcacttttacagttattaaaagaaagctattatcatagatttgactactacttggtatggtttccatgaagtgtgcagtatgtggctagtaatacaattcacaggattttaaattattattgttacttactataacatattaataaatgatttggcctaaaaggccaaaacaattctctatcaaaacttggtatttttttcaatgtcaaaacaagcttagtatttaagttaatcttgttacaaattaaacatgttacaattttctcacttttctctttgatgttacatgagttgcatctacctggccgaaataagtcaactctacaacatgatgttttgaactatgtatatattgtggaatatacacctatatattcttctatatatactaataaaatgtataggttttatacatatagttattgatttatttttgtataaaaatcaaattaatgcaggctttgttctatacttttattaatttttaagtttatctgatttgtattttctcatcaactgtttgacataaataattatttctcagctacaataaggttatttttaatgattttctatgtagcaacatttttatggggtagatctaattatggggcaaccttacctaatcttaatttttaaatcaacgaaatactctgcttattcaaaagaataatgattttatgggataaattaattctaaatgaagccacctataaacaactgtccttctctaccttgccccttttaccagaatataaagattatttactataggcctgggtataagtgtttttacctcaacagctaaaattaatatcacccttttattgtatagtagctgaaagctaaggctttgagtcagataaacctaggttttaattctggctttcccattaaatatctgtgtgactctgaacaagccataagtcagtagtagaatgtagctatgattcagtttcatcacatgtacaattccctgtgtaaataaaatgggaaaatggaaaataaaaataaacttggaatataaataccaatttcatagggttcttgtgatgattatataaagacattataatagtgtccttactgtagtaagcactcaataattggtaactgttttgtcaccaccagaggtttttctgtagttttaaaataattatgacaataattttggtgatattcccataatgacatttttgtaagtaattgttttcaatcttaaaaatgctcatttttacattataaggcaaatatgtgttataaaatcagttctaattaaatcatttaatgcattttatgcattcataaagtatttagttttaaaacttttttagtttaataaaggtttttaggtcacctttttattcctatgtaaattattatatgttttttatcaagtaattctgatctgctaattagattaaacaaaagccaaggtaatgaaataaacaaccaaaaatatggaattttgtttggaaaatttttagtgaattaatgcaaagttaaaatgcaatgaaagttttttatactaaaaggctttaaacaagtaattttttcatacacacacaaacatacacactacacacacatatacacgtttgtgtgtgtatatgaaaaaagtttaatttctttcattggaataaccataatcaacttctccttttattttatcatatatcaaattgtaatatataaattgtaatttatactatatcttaaagtatatttattatataaaaactttatcttcactgaggtatttttcttttaattctgaagtttaaaaatttacattttttgtgattgccattgaatattccatataattaactatttgatttagtatgagatacttctcaactttcctgtaaatagtattgaacttattaatttgaaaaaaactgtgtgaatgattcctaaaaagttatcaggtattttaatgtgattatttattatgacttagattaaattaaaacgatgattattagtgtgacttaaattaaatttaaacttgatttttttaagtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaagtaagagtttctaccaaattttcaaacaattttagatattaatcatatgtctttgaaactgtgacaaatgaaattaattttctcttattatcaagctattgtcaggtgatctacaattcttcaggggttactctggtcttttctttgaacatctgtgaagagggcataatattttcacccttcattcacttatttatatatttccttcccagaaggactctaaagaaaacatggctttcacagaataggaagtttggcagggcagaaacttggtgacatgcatgatatttccaattgaaaaagtatgtttatggggtgtgatggctcacgcctgtattcccaacactttgggaggctgaggtgggaggaatgcttgagactaggagtttgagagcagcctgggcaacatagcaagaccttgtatctacaaaaaatttaaaaattaactgggtgtgatggtacacacctgtagctccagcttctagggaggctgaggcgggacaatcactttagctcaggagtttaaagttgcagtgagctatggtcttgccactgcactccagcctgggtgacagtaagaccctgtctccaaaaaaataataatgataattttttaaagaagtatgtttatgtaatttctttagctttcttggaatcaaaaagaaaaccaagtttactatctactacaagagttctatattagaaaaaaggatttctctcatgattgctagtatatttcataatctttcttttttaaaactatttattaataagctaaacaaagatttgcatcatgttcaataaaacctaaagttaacaaagcccatagtaatattttatgattttagtaatagagtataaattactacttactgcttctataccatcaaatcaaatatttctagtgttagctggctggagaattaaacctaagcagggaatttctttgagctgcatatctacatttgccactcaaaaaactttagacagctagttttctcatttcttacaaatatgcttatggaaaatttagagataagattttaggagcaaaattcatgcaattagcagatgctatacttttgtaatcattgattgtcctctcaaaattttcttttgatgtacataaaaagaaggaaatatgagcaaatattactgggaggaaaatctacaaagagaaaacatcatcataaaattttagctagtggatatattttttgaaagtagcatcagtagtatttgataattggtttgttgggaagtatgagagaaagatattagtcagctttaaaggaaaataggaattcagatgctagatatgttgaactcttacactggagggtaggttaatggtcatttgttttattgttatgctttataactgatatatatgtaacatatattacattagaaaaataattacataataaaaataacttaaaataatattctcaaaagaaaaaattgaaatgataaaggccagttgaagttgtggacctaactggctgaaaagccacataaagaaataactaagtaatcataagggactcagcatattttgagaaaactagaaggcaccatccatctgcatgctgcctgcaatgcctggtgttgtatatttctgtagcatgattctatgtaaattctcaagataagtttgaccatgtttatttaagctgtatataataggattgtttttgttcttaaagtgtgaagacacggccagtgcgaatgcctccaggatatcaagcagaacttgttattcaattggtgtgggtagatggtgaacctccacaacagattactagtcttgctgtaagctcagcatatggaatgtaagtaattaaacttttttatgatatgtattatttagctaatatgtttgattttttagatgttccttgcttaagtcctaaaaatgaaaagaagcccttacctggatttttattagattaaacaatatataagaaaaataatttaaatttacattatggttttttgttctttcttgaagtcaaacctgtgatagtgttcccaattttgatgttagtaggagattgttaggattttattacacttaaactgtgttgtttgtttttatattgtctttttttctctttatatttcattttggatactttcttttgacttatcctttagagttcactaactccctcttcaactgtgtctgatctgatggtagatccacctatggagttcaatttcagctattttatttttcagttctagaccttacatttgattattttaaaacatcctgttctcttcctaaattatcactctattctttatttctttgaacatattgaatgtatgactttaaaatgtgttactttaaatatgtgtttgatacttccatatttggtatctagtctattacatttcttagttttgggtcacattatattatgttcatgtatgccagtttgtatgatttttttattagttgttcctggttttttttttaattgagaaatgaacattataatttgaggttctagatgatactttcctccagaaagtatctacatttcctctggcagtctaggttaaaaaactattgaagggtcagaacaacataattcaagcagacatcaggtctttgaaagttggattttattcccattaaagcctaatttaatttcagttaatccttatttctaggttgtagccctccacagaggttgtgtcaaactatactcccaccaccaatgtttagaatgtctactttcctacaacctttctaactacaatgtataatcaaactttccatcctggtcagtttgttaagtaaagagtagtatgttattataatatcagtaaaatttttgtatatcttaagtgaaattgaacatcttttcctgttttgtgacattctgtttctattctttgtccatttgtctgtaaagttgttggccttcatagagatttgtgaaaactgtttgcatattagggaagttagctttctctatagtgtaatttgcaatgatcttccctgcttttgtttgctttatgactttgtttaagatggttcttactttaaagaattttttgcaattctattttttgttatcttttatggctctgaatttgtgtcttatttaaaaagtccttcctcacttcaagataataataaaaattaataaaaacaaaaaaattatgttctctctaatatgctttttttcttttatatgtttaaatctttgatctgtctggaatttttttaagtataagatatgaagtaagtattaaactatattttttcctgatggctaagaattgtgccaataccgtttcctgaatacttcatctttctatgcttatttggaatcaacttttatcaaataatacattaccttatatatttcacttttatttctgtacttcctaagctgagtcttataagctccaagagaatgccttgaaaccatcagtaaggagtccatggaaaaaagtcttatctttgagtacctggaattttcttcagggggatgtggaggatatatgtgaacatagagtattgggtgcttgcttctttactagaatattatttgatgggaaagctggcaaccacagttgatggatgatgggagagaaggaatggactgtgggatagcctactgtttcattatttgatacggtaagaatatatgattattctctagcccaagtaattactgtgaaagatagttgagctcaagccatcttctgagttcacttctctagagtttgacctgtaaagacaaggggacttcagaattcagagactataaagatgtgtcacctggttcagaagctgaagtttgttagaatagatcagataaaaaaacacatttcccttataagggaactgtggaggtgaaagttattacagagcttctgaataactgacacttgtatgaaaatgacagcttggacatctatctcatagagagcctccactgcaaaaatcctagttcatgtggctactagagtaaattccaccaagttttaaagaaataaattttacaagtattactttaaatgttcctgagaattattaaagatgaaatcatgttcatctcattttatggccaacataactcgatgcaaaaacttgaaaagggtattacaaaaagagaaagttgtaagtctatatcatttatgaacatggatttaaaatcccaaccaaaatatagataaatctagcaattaaaaaagataacatatcataaccaagtttggtttacaccaggaattcaaagtttttaaacattttaaattaatcagtgtagttcatcacattagcaaataaactagaaaaaccatatgatggtctggtcaggaatgcaaaaaacaaaaacatctgataaaattaaatatccatttatgacttcaaaagaaactaatagctaaaatggaaggaatttttcttaatctgatacattttagcaaatatgctctatggtgaaatgttagagactttgtctttgaggaaaaaataagagaagtttcttagtccatttgggctgcttaacaaaatatcttacaaattggtaatttgtaacaactaagatttattgctcacagttctggaggctagaaagtccaaaatcaaggtctcaggagattcagtgtctgtctctctgctttgctctctgcttcaaatatagcaccttctagctttgtttgcgcttggcagaaggagtgaacaaactccctcagaattcttttatgagaaaatgaattccattcataatggcggaatcctcccaaagacccagtcaccttcccaaggccccaactcttaataccatcaccttgaggattagatggtctgaatttggggaaacacaaaaattcagaccataacattgtgaccttgcttcccaaaatttatgtctttctcatatgcaaaatacattcttttgattctaatagctccaaaagtcttaaaacattttagcattaactcaaaagtttaacgttcaaagtctcatcaaaatatcatctgggctggatgtagtggcttacgcctgtaatcccagcacttcgggaggccaaggcaggtggatcacctgaggtcaggagtttgagaccagcctggcaaacatggtgaaaccccatctctactaacattgtaaaaattagctgtgcgtgatggcacgtgcctgtaatcccagctactagggatactgagaatcgcttgaatccaggaggcagaggttgcagtgagttgagattgtgccattgcactccagcctgggtgacagagtgaaactccatctcaaaaaaaaaagtcacctgaatcatatatgggtgagactcaaggtatgattcattctgaggcaggtttcttctccaactgttaccttatgaaatcaaacaagttatatgtttccaaaatacaatggtgggatcagcacaaggtaaacatacccattctaaaaggaagaattaggaaaaaagaaagggataatagctccaaagtaagtcccataaaactcccatctccctgggacagagcacctgggggaaggggtggctgtgggcacagtttcagcagacttaaatgttcctgcctgctggctctgaagagagaagtggatctcccagcacagcgcttgagctctgctaagggacagactgcctcctcaagtggatccttgacccatgtgcctcctgactgggagacactagctggcatgggtcgacagacacctcatacaggagagctctggctggcatctggagggtgtccctctgggacaaatcttccaaggaaggaacaggcagcaatctttgttgttctgctgcctccactagtgatacccaggcaaacaggttctggagtggaccacccagcaaactccagcagacctgcagcagagggacctgactattaaaaggaaaactaacaaacagaaaaaaatagcatcaacatcaacaaaaaggacattcacacaaaaaccccatctgaaggtcaccaacatcaaagaccaaaagtagatgaatccacgaacatgaggaaaaaccagcacaaaacgatgaaaattccaaaaacaagaaagcctcttctcctctaaatcatcacaattcctcaccagcaagggaacaaaactgaatggagaatgagtttgacgaattgacagaagtaggcttcagaaggcaggtaataacaaactcctctgagctaaaggagcatgttctaacccaatgcagggaagctaagaaccttgagaaaaggttagaggaacagctaagtaagataaccagtttagagaagaagataaatgacctgatggagctgaaaaatacagcacgtgaagcatacacaagtataaatagccaaattgatcaagtagaagaaaggatatcagagattgaagatcaacttaatgaaataaagcgtgaagaaaggattagagcaaaaagaatgaaaaggaatgaacaaagcctccaagaaatatgggactatgtgaaaagaccaaacctatgtttgattggtgtacctgaaagtaacagggagaagggaacaaagctgggaaacactcttcaggatattatccaggagaacttccccaacctagcaagacaggcaacattcaaattcaggaaatacagagaatatcacaaagatactccttgagagagaaaccacaagacacatacttgtcagattcaccaaggttgaaatgaaggaaaacatgttaagggcagccagagagaaaggtcaggttacccacaagggaaagcccatcagactaacagaggatctctctgcagaaaccttacaagccagaagagagtaggggccaatattcaacactcttaaagaaaagaattttcaactcagaatttcatatctagccaaactaagcttcataagcaaaggagaaataaaatcctttacagacaagcaaatgctgagagattttgtccccaccaggcctgccttacaagagctcctgaggaaagctgaggcagattcttctccaactgtgagcttatgaaatcaaacaagttatatgtttccaaaatacaatggtgacatcagcacaaagtaaacatacccattctaaaggaagaattaggaaaaaagaaaggggaaataactccaaagtaagtcccataaaactcccatggagttttggaaagaaaaaaccggtactagccactgcaaaaacataccaaattgtaaagaccatcgacactaagaagaaactgccatcaactaacaggcaaaataaccagctagcgtcataatgacaggatcaaatttacacataacaatattaaccttaaatgtaaatgggctaaatgccccaattaaaagacacagactggcaaattggataaaaagtcaagacccattggtgtgctatattcaggagacccattgtatgtgcaaagacacacataggctcaaaataaagggatggaggaatgtttaccaagctaatggaaagcacaaaaaaaaaaaaaaaaagattgcaatcttagtctctgataaaacagaccttaaacaaccaaagatcaaaaaagacaaacaagggcattacataatagtaaagggatcaatgtagcaagaagagctaactatatatatgcacccaatacagaagtacccagattcataaagcaagttcttagagacagacaaagaaactcagactcccacacaataatagggagacttttacaccccactgtcaatattagacaaatcaacaagacagaaaattaataaggatattctggacttgaactcagctctggaacaagtggacctaataaacatctacagaactctccaccccacatcaatgaatatacattcttctcagcaccacaatgcacttattctaaaattgaccacataattggaagtaaaacactcctcagcaagtgcaaaagaacggaaatcataataaacagtctctcagaccacagtgcaatcaagttagaactcaagattaagaaactcactcaaaaccatgcaactacatggaaactgaacaaccttttcctaaatgactactgggtaagtaatgaaattaacacagaaataaataagctctttgaaaccaatgagaacagacacaacgtaccagaatctctgggacacagctaaagcagtgtttagagggacatttacagcactaaatgcttacaagagaaagcaggaaagatctaaaattgacaccctaatatcacaataaaaagagctagaaaagcaagagcaaaaatattcaaaagctagcagaagaaaagaaataactaaaatcagagcagaactgaaggtgatagagacatggaaaacccttcagaaaatcaatgaatccaggagctggttttttgaaaagattaacaaaataaatagaccactagccagatgaataaagaagaaaagatagaagaatcaaacaggaacaataaaaaatgataaaggggatatcacctctaatcccacagaaatacaagctaccatcagagaatactataaactagtatttctagtttataataaactagaaaatctagaagaaatggataaattcctggactcatataccctcgcaagactaaaccaggaaaaagtcaaatccctgaacagaccaataacaagttctaaaattgaggcagtaattaatagcctaccaaccaaaaaatgtccaggagcaggtggattcacagccgaattctaccagaggtacaaagaggagctggtaccatttcttctgaaactattcaaaacaatagaaaaagagggattcctccttaactcattttatgtggccagcatcaccctgataccaaaacctggcagagacacaacaaaaaaagaaaatgtcagaccaatatccctgatgaacatcgatgcgaaaatcctcaataaaatacgggcaaaccgaatccagcaggacatcaaaaagcttatccaccacgatcaagttggcctcatacctgggatgcaaggttgcttcaacatgtgcaaatcaataaacgtaatccatcacataaacagaaccaatgacaaccacttgattatctcaatagatgtagaaaagacctttgataaaattcaacagcccttcaggctaaaaactctcaataaactagtaattgatggaacgtatctcaaaataataagagctatttatgagaaacccacagccaatatcatactcaataggcacaagctgggagcattccctttgaaaactgacacaagataaggatgcggtctctcaccactcctgttcaacattaatattggaagttctggccagggcaatcaggcaagagaaagaaataaagggtattcaaataaaaagggaggaagtcaaattgtctctgtttgcagatgacatgattgtatatttagaaaaccctatcgtctcagccccaaatctccttaagctgataagcaacttcaacaaagtggcaggatacaaaatcagtgtgcaaaaatcactacaattcctatacaacaacaacagacaaagagagtgaactctcattcacagttgctacaaagagaataaaatacctaggagtaccacttagaagggatgtgaaggacctcttcaaggagaactacaaaccactgcccaaggaaataagagaggacacaaacagatggaaaaacattccgtgctcatagattcaatgctatccccatcaagctaccattgactttcttcacaaaattataaaaaagtactttaaatttcatatggaaccaaaagagagcccgtatagttaagataatcctaagcaaaaagaacaaagctggaggcatcatgctacctgacttcgaactatactacaaggctacagtaaccaaaacagcataatactggtactaaaacagatatatagaccaatggaacagaaccaagttctcagaaataacaccacacatttacaaccatctgatctttgacaaacctgacgaaaacaagcaatggtgaaagaattccctatttaataaatggtgttgggaaatctggctagccatatgcagaaaactgaaattagaccctttccttagaccttatacaaaaattagcacaagatggattaaagacttaaacataagacctgaaactataaaagccctagaagaaaacctaggcaataccattcaggacataggcatgggcaaagacttcatgactaaaacatcaaaagcaatggtaacaaagccaaaattgacaaatgggatctaattaaactaaagagcttctgcacagcaaaagaaactatcatcggagtgaccaggcaacctacacactgggtgaaaatttttgcaatctatccatctgacaaaggtctaatatctagaatctacaaagaactttaacaaatttacaagaaaaaaacaaccccatcaaaaagttggcaaacgataggaacagacacttctcaaaagaagacatttatgcagccaacaaatatatgaaaaaaagctcatcatcactggtcattagagaaatgcaaattaaaatcacaatgagatattatctcacgccagttagaatggtgattattaaaaagtcaggaaacaacagatgctggagaggatttggagaaataggaacgcttttacactgttcgtggcagtgtaaatttgttcaaccattggggaagacagttgtggcgattcctcaaggatctcaaaccagaaatattatttgacccagcaatcccattactggatatatacccaaaggattataaatcattctgctataaagacacatgcacacatgtgtttattgcagcactgtccacgatagcaaagacttgtaaccaaccgaaatgcccttcaatgatagactggataaagaaaatgtggcacatatacaccatggaatactatgcagccatgaaaatgtatgagttcatgtcctttgcagggacatggatgaagctggaatccattctcagcaaactaacacaggaacagaaaaccaaacactgcatgtccccactcataagtgggagctgagcaatgagaacacatggacacagggaggggaacatcacacactgggacctgtcaggggatggggtgctaggggaggggtagcattaggagaagtgcctaatgtagatgatgggttgatgggtgcagcaaacccccatggcacatgtatacctaggtaacaaacctgcacattctgtacatgtatcccagaacttaaagtataataaaaaaagaataactgaaagatatatattgattattaccatattatatacttgaatacacattaaagcgtaatagattgatttcatctaatgaatgcaaacaaagcatttatatataataaaaagggaaaagcagagagagaaaaaccacggccactttctaaacaatgaattttctatttttttttcattgtgagatgctaatgagttagcagccggccaaaagaccagtcagggtatttgcttttggacagctgtatgaatcatcaactaaactgatttcatttatttctagcttttccaaaaggctttagctgttcagtttgtcgcacatatatggaagacattttctgtattatttatgtcattatcatttagtagtatgcctgtctgaattacaccaggtctttatcattcttcttcttataatttctcaatttcacccttttggtcaaactcaacccccaagctgactgaccatgagggcctcagtctctttatagaacagattattagttatatagtacctcattacaatgcctatgtagcagcatttcagtatctggacattagacattaaggggggaaaaaagcataagacaatcatgattattataagaaatatgtggaaaccacttgatgttctaaatcctggttggccgaagtctaactaggaaaataattttcaaggattaatgtggttaactttagttaactcagtggccttactattccattcactattaattgtttactcttttgaagaacatatcaaggggcaactgttaagtcagaaactgtgaagggtctaagatgtttccctcttagaaaatagtaaatttgtctgcgacagtattatatgtgtgtgtgtgtatatatatatatgtatatatatatatagacagaaaatagtcctctgggtcagaacaaagatagtttattagtgacagcaaaagcagcagcttagtgcaagatcttgcatcagttctctgagcccacaggggaacatggtgagtggcagatggtacttgcatgtgcaactgggtgcataataaaagaggaactccaagttttaaaaactcacatcttatgtaggtctgctggtgaactgcccatttatctttactctggaacataagcaaatattctctggggaagaagagaggttttttatctctactaccctgaaatgtctcaaagtagggagatgcccctaagctttactattctgggatgtctctttatacaaacataactgtaaatgccttcactaaaaggactgtgcagtacagtgaagtactaatggagaatggtctaccaattgtaatgtgaccagttgtacattattatttaggattaattgtgccagtttgtttatattagcctgtgagatccttagacttaagttgtgttacttgccatttgagtctatgtttagaagtaaattgcatatctcacgtttcagtttaagaattttttgctggaatagaattcttgtaagaacctttgaaattcagtcttgttcccctttggatatgttgtgatattgggcttttgataaaatatgagtagtcactcatattgagggttttgctctgaacttggaaagataatataacaaatttaagaactgaaaactggtcttactctttcagtgtatgtttcctaagaagaagagctttttttttttttttttacatcataagcatagtgtattttttaaattaagaaattcaacattgattcaggactattttctacttcacataccatattaaatttctagatatgtcccaataatgtcatttatattgtctattcacagaacagaatcaaatccaggatctggcattgcttttagttttcatttcttcttagtctcctttaatcgggggcagttcttcagcattttttttttagatggtgtctcgctctattgcccagactggagtacagtggcacgatctcagctaactgcaaccttcacctcctgggttcaggcaattctcatgcctcagcctcctgagtagctaggattacaggcatgcaccaccacacccagctaatttttgtatttttagtagagatggtgttttgccacgttgaccaggctggccttgaactcctgacctcatgtgatccgcccacctaggcctcccaaagtgctgagattacaggcgtgagccactgtgcctgacccagcatttattttttaaccttcatatttttagagtacagccaattatattgttaactgtacctcagctgagtttgtctgatatttcctcatgatgagagtaaattaagcattttggcaggaataccacagaaacaaggtaatgtcttctcagtttatcttatcagaaggtacatgatcatggattgtcctaattttagtggtgctaattttgattgcttgttaaggtgatatctaccaggtttctccactataaagttgctgtttcccttcatagataatagtttgtggggagatacttgaaagtttttaaacttcttactcatcaaactttcacccattacatttagcatccattggttattctctgttacccttctatatttataagttagattctactattaagagaccataactccctatcctatataaacatttatttacttgtttactatataagtatgaaatcttagatttgcattttattcagtgagttaagatctgtttctatcatttgtgcctgtgatgctctaattcttccagatttgaccatatggaaccccatcaaaatggcttctatgtccttttgatatgttcccatcgttttttagcagtttgttattttccagtacaatgtgatgttcaatatgtatcttgtatattctttagtctacccctggaatcagctatcttagtcttcttttactggagaatgttatttagaaaacaatgtctgggcacaatagatgctcatttctattgttgtcattgcctctagcccctatcagtatacaaagctaagaaaaaacaaacattgaacactttttgatatatatgagatacaattttaaaggatatatagaggttataattttgaagtagcttatcaatttattcttttatattcttgcttttggattcttctaagaaatctttttatcatgaatgtcttgtgaattcagtcaaatccttttactgcatcaattaaaactgtattagtccattctcaaactactctaaagacatgtctgagattgggtaatttatgaagaaaagaggtttaatttactcacagttctgcaggctgtgctggaagcaaagctgggaggcctcaggaaacttacaatcatggtggaaggtgaaggggaagcaagcacatcttactatggtggaacaggagatatttgtccattttaaaattttcttcctgtgattgatttctagttttatactattgtgatcaggaaaggtacttgatatgatttcaatcagctaagatttggtctaacatgttatctgttctgaagaatgtctcacatgtgctggagaagaatgtgtattcttctgctgttgaatggaatattctgtatgtgtccgttagatccatctgcactaacatatagttcaggtccaattttctttactgattttttgtctagataatgtatctattgttgaaagtgagagtgttgaaatgccctacttttattgaattgccatttgtatctcccttcagttgtgttaatatttgctttacatatttaggtattctgatattgggcacatatgtattcatagttgttatatcttcttgatggattgacttctttattgttatttaatgatcctctttgtcttatgacagtttttaacttaaagtctgttctcttctgatataattaagctacctctgctctattttagcttccatttttatagaaattcatgttcatcccttcactttcagcctatgtgtaaggctaaagttaatctcttgtaggcagcatatagttggatcttaatttttgatccattcagccactcttccttttgtttggagaatttaaacaatttacatttaaagtaatgattagtaggtacaaatttacaatgctatttttattttctggttatttttaatggattctttgtccttcctttcttgcttgctgtgttcccttgtgctttgttgattttctgtagtgatatgctttgattcttttctctttatctcatatatacctactatgtttctgttttacaactacgatgaggcttacgtggaacatcttatacttaataacagtctatttagaaatgataacaactcaacttcaatttcattcaaaatctctaccattttacctgtcactctcctccagcacacattttatatttatatatattttatattgtgaatttattaacaaaacaacaaaatattatacctatagttacttttaatacttttgtcttttgacctttatactggacttaaagttgatttatacaccatcatttcagtactacaatattgtgaatttaactataaatttacatttataagtatattttatgcttttatatgatttcatgttactaattaacacccttccatgttagcttaatttaagatccctttagcatttcttgtaagacaggtctagtggtgatgaacttcatcatcacttttgtttgtctgtgaaagtatctctccttcatttctgaagaacaattttgctagatacggtattgttggatggcagttttttttttttctttttgcgctttgaataaatcatcccattctctggtgctgtatggtttctgctgagaagtgttctgttagcactattactgttcccttgtatgtaacaagttactattctcttactgctttcaattttttttaatgtttggcagtttgattataatgtgtctgtgtgaagctgtcttttggattgaatctgtttgggaacctttgaacttcataaatctggatatgtatatttctctcaaggttatcaaagttttcaaccattatttctttaaatgtactctctgtccctttctctctcttcctctgaatctcccataatgtgactattggttctcttgatagtgttcaataagggtttcttttctgttttttgttattttcagtgttctatagggtttctttcctcttttctattcttatctattttttgtactctgatagtataatttcaaaagatctgtcttcaagttttcaaattttttcttttgcttgatcaagtcggctagcagagctctctactgcattttttctttcattcattattcttttagctccagaatttctacttggttcttttttgtgatttctttttgttgaactttaaattttattcacgtattattttccattgtttcttgagttgtctgtttactcttgtgtcttgctcagcttgagcttccttaaaagaattaaaataattattttgaatttgaaaaataattattttgaatcatttttcagataactaatagatctccattttgttgaggtcagttcctggatagctattgtgttcctttgccagtgttatcattccctgcttttttgtgtttttagtgaacttgcattgatgtttgtatatttgaggcaacaagtcacctgatctggtctttttgaagtagatacagtggggaaatgctttcagctgtgaatggctacaagggcaccagctggatggggtgcaacatctcctgttttaagaaagacacaggtatggtctcaatgcagtttaatcagccgaagtcagtgttggcaaatactgcaggtatccatggcagaagccaaagttgcagatgtctgtagtaactgtagtggttaaggctgttaaggtcctcagtattgaaagctgttgagtttctcctattcaacttttatctcacatagggaagttccagccaaagtgattcctcttggcactaagtctgatgtgctggcacacatgcagctgtggtggtgttgggatcctggccactggtgcacagtcagcaatgctggttctgggtgcaggtgcccagagcagccatgaagccagggctctgtggtcagaggcacatgtaactgaggtggtgcctggggcacaggtgcattttttttatttggcattgacaccaatgtctgaggcctgggcatatacagattgcctatagagtgagaacctgtgtcatctttggggaatgccatgatgacttggtcccaggggtgatgagacatagtaatagcatggaacatagcagtaacgtgggtccagcgacaacagggtgtatcagaggcctgtcaggtcacgacaggggcaggatgcagagcagtagtctgaagccccagtgaaagtaggtaaaagccctgacttataacccaaggtaagagagcagtcagttatttacttatgaatatacaactgcttcatcatcatttgttgaagattatatatgtttcttagcacttttgtcaaatattatttgaccatgtatgtgtgagtttatttccaggtactcatctgttctaccaatatctaggtctgtctttataccaataccggcctgtcttgattcctgtacttttaattaagtcttaagattatatagtctgtatcctcaaactttcttatttttcagaacaatttgggctattctaggtctattatacttctctatatattttacaatcatgttttaagtttcttaagtaaaaaagaagtctgctgggattttgtttgaaattgctgtgaatttgtagatcagtttggggaaaagtaacaatattgaattttctaaccattaagcaaggtacatctttcaatttacttaagtcttctttaatttctctcaacaataattataatttttaatgtacagattttccacatttgctgttaaatttattcatatgtatttcataattgcaatgccactatgaatgttgattcaagagttccataaattttagttcagtgaaggaggttcacagtgtcgcttacaaattctatatccctactgatttgttttctctgattattctatcagttattaaaagaggaatgtttgcatactacaccttaattgtagatttgtctattttccctttcagttctattggttttcatgaattttgaagctttattataagatgaatccacatttaggattgctatatcttcttaagaaattgattccttaatcattctccctatatatctctcaaaatttcctttttctgaaatagactttgtctatattagtatagtcgtttcagcattttttaaattagtgttttcattgtaaatgttttccatcatttcgctttatatttaaagtggatttgttgtaggcaccatatagttgggtcttactttttatccactcaggcaatctctgcccataattggagtgtttcagtcatttacattaatatacttatctatgtgattgggcttaagccaaacattttctaatttgtttttctctttgtccccccactcccccttttttttttcttctttttctctgccttcttctcagggaaagattgcatatcttttaatgattctattttaacttcattattgatttattagatatacttcttttagttttttgttctcaggcttacaatatgtatctttgaattatcaaataagtagataaataaatggaatgataccacttttcatatattttaataactttacaacagcatgcttctatttatcctcctgttttttgcattattgtcataaatttacttccatatgttataaaccgcataatacattgttattaattttactttagtcaattatcctttaaagaaatgagaaaagtctttaatattaattttcatatttaacatttttgttgctcttcattatatagtggagatccatatttccatctggaatcatttttttctgtctaagatttcccttattatttttgtaacccatttatgtgagtgatgaattccttcagcttttgtttttttgcaaaaattcttttccactgcttgaaagatgtatttgctgggtatacaattttaggttgacattatttttatttcttactgcaaagatgccactccatcatcttttggtttgtatagtttcatctaatttttttaatgattttatcattttaatttttacatgtaataaatttttttatctgccagcttttaacattttctctttgttattagttgttttcagcaatatgattatgatgcctttttgtttttcttcattcttattctgcttgggatctttaagtttctattatctgcaggcttattactgtcttcaaattttgtctgtcatttatataaattggctatcattttttcaaatatgttttcttttgttcttcctttatgaaactccaattatggagttttgttttttaaagttttaaagatctcatttcattttaggtaatttctgttatttcttcaagtttactgtcttagtctgggatgttgtaaacaaatatactataaattgggtagcttataaacaacagaaatttatttctcacaattctgaaggctgagaagtctaatatcaaggcaccagtagatttgatgtctggtgagaacctgttccttatagatagtaccttctaaattcatcgtcacataatggaaggggtgaggcagctctctagggcctcttttataagggctctaattttatccatgagagctccattttcatgacctagtcaccttccaaagttcccacctcttaatacaatcatcttgggggttaagttttaacgtattaattttgggaaaacacaaacattcagaggatagcattctctattcttttctactataatgtctaatgtgcagataatgtttaaatttcatatacatttatatctctaaggcttttttatgtcttccattccttcctttgtcacatttgtattttcctcaaccttcttgattatctgtaatatgctttgaaaagcactttcattattttccatctgctagttttatcatctctttcatttctggatatgtttctattgagctattttttcctctggttatcatattttcctgattctttatatgcctgctactttttatatactagatattgtgaattttacgtttttggtggtattttgtgcctttttttagtagtgttcaactttttcctggaatgaaattaagttacttggaatctgtagctaatttgtctcactgctgaagtgacactcctatatctgctgttccatgtattaggagagctctgcagtttcattggtagtagcataaaatattcttagccttgtgtgagctctgggaattgttctgccttatctttttggtggctcttttataggtcttgagtagcttctgcacatggatgcacagattagtacacagccgaagtctcaaggacatctttctgcaaatctctggtattctctctctgtgcagtttattttgccttattagttgtagctgtttttgtagtctcagtctctcatctctgcctcctcaactaaatgagaccatcaatctctctttgagttctagtttcctgtgcccaagcctgggaactatcttcagtcactaacacagaacatttgtgaaatgtattaccttggttgctatccttctctcatcttattctatgttgcctgttgaccaatatgtgaaaactgttgtttaatatatttttgcccacttttctagtaatttaaaataggagattaaatcttttctctttaccaactttctgacaactactgcctgacttccccagccctaagctataacttctcagtattcttatttttaattccaagacaaaaataattatttatggtatatagaatgtcatgcatcctagttgcctacattttttcagtcattattgcatttagaaactctatcgtgtctgtaagcagaagtaatttgctatattttaacataaaaagtttaaggatactaatttgttataactggtaacatgtataatattgcatttatttataatattaagatcaattctttttgcatggaaaaatttcaatgtactttaaaaataattttctgacttgatactcataaaagctctgtgaaccagataaatgtagaagtgtaattatcattataaagaagctaaggccaagcaagattcattaatttttctcaaagtcacatatcctgtaagtgatagagatgagaattaaacccagatctgaccagtataacaatactttttttcagtttccaaagtttgtcttactggaagatgtagagctctatgtgaattagcaaaacatctagtatgggtagaagtgttgttgttgttgtgttttaacttgtgtagtgaagtggaaagaaccattttaagagtaagcagatggtttgtaaacaagattcaatctaaataatacaacatggaacgtacataaaacaagcaaaacaacattcatataactaatgtttaatagtttatgaagcaaaaagtaccgacagaattgttcagctagaggacatattgtaaatggagaaaaataagagttaatgtatgcctaatggttaagataatcaaaatgcctacttagaagagctgtcttttttaaatttctcaggagatttagttaagtaattaatcaaatggtctctttatcttttgaaaggggcacaaaataaagagcacaaaagtaagaaacatttaactttttgtatctcctcatttctaatatagtgtcaatgcctttgatatatgaagttaatttttatttttctctctttcagaagataattaatttggagtctagtagttataattttatttgaaaaaggcatctaattacatacgtaagcatctttagctagtgacatttcttaacctatctcccccttgcatagcaaaaaggttttgtgtgattcttctgtgaaaacataaggcctagtttaaagagcggattgggtaatcacgacttacatgataaaactgctggcaaaatataattgccgatcatcctttttttgtggtaaattgtatgcctattatacgaagacagtttatccatcataaaggcaaggcatccttcttgactttacacaaatcactgcccaacttccccaaccctaagacattacttttcaataatcctatgattgatttgaagataaaaataatcatgcttgttgtgatacattctagttgtattttttttctctcttagagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcaggtaggagataaaacaagatgagttatgaacttgatttggtcatctgtgttcttatttttagatttcttgtctttcttctctgatactattcaaatgcatggcaaaataaaatcaacataatttacaaaatcatgtaagtaaaataaattgggcagaaacattgtgagaatctttgaaagggtcaggggtgtgtatgtttaaacttcaatttgctattgaagttaggaagcatctcaactttcttaggtttaattcctaagaaataacagaaaataagaagctattaaatgtaaaaatgctatgaaaattagggctctgtagttgaaaaaaactgcttgcaatggttgtgtcaaacaggttaactttcttctaaaatatctggtccctttaaagagataattttaggtcatttactacttttaattttttaaattaattccatattgtagctgactcctttccttgttggatgatgaccttcctgaaggtattttcacaattcaataaacatttttcattaacatttttaaagtactatgacagatggcatttttcttggaaggatcaataaatcgatgtatttaactataaaagaaaataaacttaaggtaattaggatttaatgccaaactttgatatgccaattatccaaagttttactgaaattttagtatatatccaaatagttggctttataaacactgccaaagttttgcatattttctgtccattgacagtccagttggtaaaagaaaattaggccaaaaggttgcagatgaaaatgcttctataatattaagtgttattttagacagtcctttaaagtcttctactttgggccagatatggtggcttatgcttgtaattccagtactttgggaggccgaggtgagaggatttcttgaggccagtaattcaagaccagtctacgtaacatagtgtgaccccatctctaataataataataataataactttttaaattttttaataagtaaataaaataaaatttctacattgtattatttaaaataatttattgaatattgatgatattactaaatatgaccataggaaaatataataaaaaataaaaaaggtacatgatggtaggtgttattttccaagtggcagatatgtcaaatttaacatccaaatgtgataataaatgaatttcctttttggactaatgaaacttgttatactgaaactcttcttgttaacctttcttttgcaaaactcaatgatttctgaattaccagtttagacccttttgaggggcacaaaatttctctttcagaaaccaagggtttttagtgagggatctcaacttttagcaatattttaggagagctagaaatttcagtttctggagattttgcctctatcactaccagattttgaaaggaagacaaaataacaagcaactgtacattcacataacgtgaggtttcctcatgattaggaaagacaagtttgaagttgatggactctaggatagaaaggtgttagggggcagtaggctatttataattaaaaatttagttcctcagtcataataaccatatttcaggtgttcagtttgcaatgctaaaagcaccaatataatcagaaaagctgtgaatcctatgacaatatctaaatcacttgctggatatacacagtggggcaaaaaaagtacataatttgacaaaggtaatacaattattatttaatttaaattaaactgcttgaaccttaacagttactactagagcttagaacattgatgactttaaaatcaggaaaatctgtgaagttataaactcagtttgtgtttagtgtacaagatgacacagtgagaactcactttatattataacaatgaagtattaaagactgaaatctttagctttctttttaattgctgaaggattaaagacaatcattttttattaatgaaataatttatacatattagttacaagccaaagaagtgtattttgtaaaaacatataaggaaaatgtgccatctacttttataagacatttaaataagataaaaataaatatttataaatatttttatattaaatatttaaataaatgttaaaattactaccgcattctcatcattcatctatcgcctcttactttataattgatttattttattaatatctccttctaatttaattacctaatcttgctgcaatttcttcatcttggctgttctagattctggtatgatatcacttcctttcactttagacttttttttctctttcttctgcctgctgctgatgctggtggtctggcatgttccaaagacaacttttgcatgcgtggcctgtctaacttttatcctgatttaacgaaacggatccgtacttcctatcagagtaagttatataaaggttaggcaaatagcctttttaagacataatgcttgagttaaatccatacatcagtgctcagtaatgtgtttcttaaaacacattcagcatgcatgcaaatttttgttttgttatggtgtgcaacctgataattttaataaacattattatagaaatatttcaatccatttttgtcctgtacccattcaatcatacccattgtttcagtgtttatttccaaccatgcagaccatgtcctactattccaagagtcactgtcttttattttgaggaggaagagctatgatgccctgtaaataataaaacttattactgacatgccagtatcagtaataagttaatgctttcttattttggcaaccttatgctttggccattttataatactattctaaccagggtcacaatatttgcttcttttaaataattatattccttgaagataactaagtattcctgatttctgatgatttttattaaaatatacaaacatatttctatggtgatttaaggcactcagacattataaagtaggataattaaggtaaaaagtaaacaaataaataatatcaacctttaccatggtatcaaacacagatccgaagatatctagagtaagcaattataaaaactggtatagaaaggatgaagagtgagagtgtgtgtgactggaggtacagatgagactagtgattttatcggtaaatatttattgacataaaaaatgtttatcatatgttaatatattctgttaaaaagcaggttgtttaacaatatatacaaaatggccttatagttgtataacatatacattatacattatatacacacactcacacatatatgttgtttgtaacctgaattccttcagacctcaccagttcatagatactaatggaatcttatcagtaataaaacctaaaactttactggtttatgcccttagcttacaaaagtcagtctctatgaaatccttaaaatgttcctgggaatgcctagaagttgagtaatttttgctcataaatattctctagttttctactctagcagagcacccccttttaggaatccttcccactctctctgttcctgttgctgtgtgcgagaatattggtatctatgttggcttctgctgctcctaaaacagaagcttatttgatactatgataactgtgatatttcttgacatctgaaaattttataaaatttcagtttctgtaataaagttttattggaacatagtcccaatcattcattatatattgtccttaaatgctttcacactacaatggcagagttgagtagctgcaacagaaactatatgcccacaaggcctaaaatgtttactatcctgttctttacattaaagtttgctgattcctgctctgtgccattttttcatacccatcctctgcaccacataaaggatttcagccaaaacctttctgtaaatagtctcagggtagtttaatacacatattcagatttcagaatcccagtttagccttctgaaggtaggatctcctacatttgtgtgtgtgcttgtgtgtgtgtgtgtgtgtgtgtgtgtgtgtgtagacagaaaagtttctggaacatggctttgtggattttacagacttcttttggctttacagtatactctgatttttctgtaataaacttgtaattattttatgctaagaagctaaattggagactgaaggtcaggagcagaagcgggctcttagttcatcaggatcctataatatcagccatgatgtaaagtttttaaaagttctgagaaatctcaataatatattttcttatattccttatatttccttcagaattttttttcagcccatcattcaggatcctctaaagtataatttctatcaacaacctcaaatggattttctactattctcctcttaagccaaatttttgtatcttactaccattatgttttactcatattatccactctctggaaatgccctgctaaaagtttactttctatagtaagcctttcctaccaccatcagagccctgttgtgccaattcctttatttaaatgcttccagtgtccaggtttgtacacagtacaggcttgcctgaaccatttagttgacatttagcctagattcatttgtatggctacttacttttatacttttgttctgcctttccaaatgcatgacaagaatctcaagaccatatctaaaattctttatattccctgcatctagcacaagtcacaaggtctctatgtaaatgatgatgtcagtaggatagagcatggcagcagactttattctctcacatgaactgccagaaaacttttcaaatctgacaaatgagagaagaactaggtaacaggttcaccagaattttgcaaaagtaatcatagtttctaactagagacctaacgttttaagtcagaagtaaaatcaagtctgttgaaggacttaaagaaatccccgtgtctctaccagtgggccccacaagggctcagacaagctctaggatttcaaatcagatttcctaaaagtcttctctgaatgattgatattgtatattatgaaaagggattgattctttaaccactcaaaggcatatcctacaattgcttttcaaaatacatttaatgaaaatttgacttgaagtttaactattggataatataatctgattatatttctatagtctcactttattatagtagacactgctcagccttttcattaattgcttactaactttcagaaaagcatatatgcattgttcatatttggggtaatagaacccagttccattgattatctattctactctgctagtcagtttgactcagtgttatattatccactagtgattataaccctttgaggcagattgatatatattagtatatttctctacacatgagaaaattgaagttgaaaaaaatgaaattagtctctcaaagccacacagaataagtgggacccaaacttatgcctatctgacactaaaattactcgataggcttttcactgtataatcttggatctctaagtgtcttttttaaagtttcaggaacattggaaaccaagtccgttattttataatcagaaaacacctcagtttttgcacactcaatgaaattatatcaatgactcttttactggtcaccttattccataggttaggctccaaacagctgacctccccaaatttttaaattaccaagcggcaaaactttcacatcatagaataataaaattttgtagttgaaagaaaactttcgtgttctacagattatgatttttagaagcagaaaaacgctttgaaaagaacagcagacatctgatcagaagatttacattgttttaccttttccatttattagctacttcatacatttataatcttaaacaaggcatttaatcactctgagtttctttcttctaatatataaagtaaaaattgcaatttctacctcccttagagagttgtagaacttttctgggttaatgttaataaaagtgattctataaatgttagttattataattattataaaagatgaaccaacccacaccacagagaggttaaataacttccagaatcataagaaatctatggaatacgtagaactaaaactcaggctgctgcctcattgcctagcaacagttctacttatgataatcacataaattttgctatttaaaaactgatattatgccatttgaatcaagggaagtttgaaaagtaggcttaatgtagagaattgtctacattgcttgtgcatcaatttctagttatgcaacaagggatcctttggagagtcccaggcctattatccctttcttttcaaagggtaggggtatgataacagatcctaaaaacacctgaaacataaagaagaaataaaagaaaaggggatgataagagaactatccaagaaaggcaaataagtattgtaaaacgaacagaaagtcaggaatggagaagtaaacaaaaaattaaagaagaaatgctttaagaaacaaaaatcagcaaaaattatggtaaacaataaatggggaaaacattcattcaaataatattttactgagcatctcttgtgtcaaacatttttctaggcattaagtacatagtgatgagtgaaacaattatggtcttttcctttcatttataacaggtaatatacagataaataaagtcatagataattgaagaaaggtggcaatgcaataatagggaaaaatgagataaggtggacctatttttgaaagtgttgtcagggaatggcctatccaacatggaaacatttaagtgaagttttgcaagataaatagtcaaagctttagattctcactaccaaccaagatagaaagatagagtagcaagtaccagatttaacctcctgcctgaaaaccccacacccattcccccaaaatagacaaaataaatgaaaacaatggtttttaagacacggggtatcaaacaatgaaaaaaaaaaatgatgggacagatgggaaacctaacaatcacacgcatttactatggcaagataatttctagactgtagcaaagggaggggaagcccaggaggaaaccactgagctttttaggctgggagatgaagatgagaaaccaaagaaaccaaagcatctacagctcacaaaagaatttcagagatctacagtgtttcctcctagagcaaagtgctgatcaacgtatacatatgatgcagctatccaggaacaggtaaagagccatctgaaaggattaaaggaaacagtgcccaacactcaaataaaggaaatagtgccatttccactaccctaaatagaaatagttcataactcacatccacttctatttaacattgtactggaaattttagacaatgttgtcaagcaagaataagaaataaaagttatctagatttggaaaggaagaagaaggtaaatagtctttattcacagaacacatgattgtctatgaagaaaacttaatgaaatctgccaaaaacagctactagaactaaaaatgtgagtttaacaatgtgcaggatataaggttaatatacaaaattccattgtatttctatatgcatacaacaatctgaattgaaatttaaaattaccatttacaatatcatcaaaaataagaagtacttagccataaatgagacaacagatacgaaagacccacacattgatgggccgggcgcggtggctcatgcctgtaatcccagcactttgggaggctgaggtgggtggatcacgaggtcaggggttcgagaccagcctgaccaacatggtgaaaccccgtctccactaaaaatacaaaaattagctgggcgtggtggcgggctcctgtaattccagaaactcaggaggctgaggcaggagaattgcttgaacccaggaggcagaggttgcagtgagccgagatcgcgccactgcactccagcctgagtgacagagcgagactccatctcaaaaaaaaagaaagacccacacatggaaaaccagaaaacattgctaagaaaagttaagaagacttaaataaatagttacaccaagtttatgtctcacaaaactcaattttattaagatggcagttcattccaaatcgatttgttgtttcaatgctagatcccaataaaaatacagcagatgttcttgtaggaactgacaaactgattctaaagttcatacagaaattcaaaggatttagagtagccaaaacagcttttaaaaagaagaatctgttcttgcattagttagcttagaataatggcctccagctctattcatgttgctgcaaatgacatgatttcattcttttttatggctgtgtagtgttccatggtgtacatgtatgacattttcttaatccagtctactgttgatgggcatttagactgattccatgttattgccattgtgaatagtgctgcagtaaacatacgcatgcatgtgtttttatggtaaaccacaagttatatttcttcgggtatatacataatagtgggattgctgggttgagtgataattctgttttaagttctttgagaaattgccacactgatttccacaatggctgaactaatatacactcttaccaacagtgtataagcattctctttcatccacagtctctccaacatctgttattttttgactttgtaataatggacattctgactggtgtgagatggtatctcattgtggttttgatttgcatttttctaatgattggaggtgttgagcattttttcatatgcttgttggaatcatgtgtgtcttctttagaaaggtgtctatttatgtcttttgcctactttttaataaaatcattttttttgttacaaatttgtttacatttcttacagattctgagtattaaacctttgttggatgcataatttgcaaatattttctcctatcctgaaggttgtctgtatactctgttgatagtttttatagctgtgctcaagctatttagtttgattaggtcctatttgtcaatttttgtttttgttgtaattgcttttggcatcttcatcatgaaatctttgtcaggtcctatgtcacatggacaaaaagaagtgaacaacagacactggggcctacttgagggtggagtgtgagagcggggagaggattttaaaaatacctaccaggcactatacttattactgggtgactaaataatctgtacaccaaactcccacaacatgcagttcaccagccaagtatctgttccccttcaagagactcccccaacacataaggactcacataaacttaaggtaaaggagtagaaaaacattccatgcaaatggacaccaaaagtgagcaggagtagctattcttatatcagacaaaacagactttaaagcaacaatatttaagaaagacatgaagggacattgtttaaagaatgtcccttcttgtttaaagaagacaggaagggacattaaatatgataaaaggactagtccaacgggaaaatataacaattctagatttatatgcatctaacacaggatctcccaaatttatgaaacaattactactagacctaagaaatgagataaacaacaacacaataatagtgcagtacttcagtactccactgacagcactagacaggtcattcagacagaaagtcaacaaagaaacaatggacttaaactataccctagaacaaatggacttaacagatatttacagaacattctacccaacaactgcagaatatacattctattcatgagcacatggaacattaaccaggatagaccatatgataggccacaaaacaagtctcaataaatttttaaaagtcaaaattatatcaagtactctctcagaccacagtggaataaaattcacacagtggaataaactccaaaaggaaccctcaaaactatgcaaatacatagaaattaaataatctgcccctgaatgatagttgggtcaacaatgaaatcaagatggaaatttaaaaattctttgaactgagtggtaatagtggcacaacctatcaaaacctctgggatacagcaaaagcagtgctaagaggagagttcatagcattaatgcctacatcaaaaagtctgaaagagcacaaatagacaatctaaggtcacacctcaaggaaccagagaaacaagagcaaacccaaacccagcagaaaaaaagaaagaacaaagatcagagcagaactaaatgaaattgaaacaaacaaaaaatacaaaagataaatgaaccaaaatgtggttctttgaaaagattaacaaaattgacagaacattaatgatattaaccaagaaaagaagagagaagatccaaataaactcaattagaaacaaatgggaaatattacaaccaatacaacagaaatacaaaaggtcattcaagactactatcatcacctttatgcacacaaactagaaaacctagagaagatggataaattcctggaaatatacaaccctcctggattaaaccaggaagaaatagaaactctgaaccaaccaataacaagcagtgagattaaaatggtaatttaaaaaattgccaacaacaaaaaaagtccaggaccagatggattcacagctgaattctatcagacattcaaaaaagaattggtaccaatcctattgaaactattccagaagatagagaaagagggaatcctccccccaaatcattctgtgaagccagtatcaccctaatatcaaaaccaagaagggacataacaaaaaagaagactacagactgatatccctggtgaacgtacgtgcaaatatcctcaacaaaatactagctaaccaaatctaacagcatatcaagaagataatctaccacaatcaagtgggtttcataccagggatgcagggatggtttaacatacacaagtcaataaatgtgatacatcacgaaacaaaatttaaaatcgtatgatcatctcaatagatgcagaaaaagcatttgataaaattcatcatctctttatgattaaaaccctcggcaaaatcagcatagaaggaaaacaactaagggtaataaaagccatctatgacagatgtacagacaacattttacggaatgggggaaagctgaaaacattccttctgagaattagaaaaaaacaaagatgcccactttcaccacttctagtcaacatagtactggaagtcctagccagagcaaccagacaagagaaataaataaagggcatatgaatcagtaaagaggaaatccaactgtcactatttgccaatgataagattgtatgcctagaataccctaaagacacatccaaaaagcacatggatctgaaaagtgaatttagtaaagtttcaggatacaaaatcaatgtacacaaatcaatagcactgctatataccaatagtgaccaagctgagaatcaaattaagaactcaaccccttttacaacagctgtaaaaaaaataaaataaaatacttagaaatttacctaactaaggaggtgaacgatctctacaaggaaaactacaaaacactgctgaaataaataatggacaacacaaacaaatggaaatacatgccatgctcatggatgggtagactcaatattgtgaaaatgaccatgctatcaaaagcaatctacaaattcaatggaatttccatcaaaataccatcattattcttcacaaaactagaaaaaacaatcctaaaattcattcacacagtaccaaaaaagcccacattgtcaaagcaagactaagcaaaaagaaaaaatctggaggcatcacgttacttgacttcaaactacactacaaggctatcgttaccaaaacttcatggtactgacataaagataggcacatagaccactggaacaaaacagagagcccagaaataaagccaaatacttgcagccaactcatcaacaaagcgaacaataatataaagtggggaaaggacaccctattcaataaatgatcctggcataattggcaagccacatgtagaaaaatgaaactggatcatcatttctacccttgtacaaaaatcaactcaggatgaatcaaagacttaaatctaagacctgaaaccatagaaattctgaagataacattggaaaaacctttctagacattggcttaaacatagactttatgaccaagaacccaaaagcaaatgcagcaaaaacaaagataaatagatgggacttaattaaactaaaaacttcctcacagcaaaataaataatcagtaaacagacaacccacagagtgggagaaaattttcacaaactatgcatctgacaaggactaatatctagaatctataggaactcaaatcagccagaaaaaaaatcaaataatcccatcaaaaagtgagttaaagacatgaatagacaattctcaaaggaagatatacaaatggccaacaaacacgtaaaaatgcttatcactaattatcagggaaatgcaaatcaaaatcacaatgcaataccatctttctcctgcaagaatggccgtaatttaaaaatcaaaaataatacatgttagcatggatatagtgaaaagagaacccttttacactgctggtaggaatgtaaactactacaactactatggaaaacagtatgaagattccttaaagaaccaaaagtagatctaccattcgatccagcaatcccaccactgggtatctacccagaggaaaagaagtcattatatgaaaaagacacttgcacatgcatgtttatagcagcacaattcacaattgcaataatatggaaccaacccaaatggccatcaatcaacgagtggataaagaaaatgtggtatatcatggaatactactgagccataaaaagtaatgaaatgatggcatttgcagcaacctggatggagttggagaccattattctaagtgaagtaactcaggaatggaaaaccaaacattgtaagttctcacttataagtgggagctaagttatgaggctgcaaaggcataagaatgatacagtggactttagggactcaagggaaagggtgggaggtaggtgagggataaaagatgacacattgggtacagtgcacactgcttggttatgggtgcactaaaatctcaggaatcaccactacttatccatgtaaataaacaccacttgttacctaaaaacctattaaaacgaaaaaaaaattttaaattttaaacactaaaacaactcaaatttttattaagtaaatggataaacaaattctggcaaatccaaacaatggtgctctgctccgcaataaaaaagaatatactattgataactactacaacatggatgaatccaaaataattgtagtgagtaaaaataatcaggaaaaaaaaggacacattactgtatgattccatttctatagaattccaggaaatgaaaagcaatgcatagtgacagaaagcagattagtaattgcctgggaatgggaagggacacatatggtgagggctggaagagagggttacaaaagggcacaaagaaactcttgggcatgacagaagtgtttattatgttaattgcaaagatggttttatggatgtatacgtatgtcaaaatgtattcaaatagtacattttataaacattaattaaaccttaacaaggctattttttaaaagaagaactaacgcaaagaagagcagggaacagcacattccaagcagagtgaacagcttataagaaggttctaggccaggtgcggtggctcacgcctgcaatcccaacactttgggaggccaaggtgggtggatcacctgaggtcaggagttcaagacaagcctggccaatatggcgaaaccctgtctctactaaaaatacaaaaaattagccgggtgtattggtgggtgcctgtaatcccagctacttgggagactgaggcgggagaatcacttgaacccgggaggcggaggttgccgtgagccaagatggtgccattgcactccagcttgggcaacaagagcaaaactctgcctcaataagtaaataaataaataaaatagaaggttctaggatggtaaaggacttaactatatcatctagaaacagaaagaatgcaaggaagctgacatagtcatgcggaagagaaaaagtgagtgaagattttgttgtagagatgagtaaggacaagatcataaaagcttctgaagtaattacaagaaattatattttaatttaagcaggggaatgatatgctttgatttatgctataaatatccacactgctgtgtgaagaaaatattgtggagccaaaaaggaaagcaagctggtgtacccattagaaggcgagtattgcactccagcaggaaatgaagtggcttgactagggtgatagcaacgctgttggagaaaaaaggatagattcggaaatcattagcatttacagagctactgattatcattcaatgtgagagataagagagtggaatcaaagattattcccagattttggcttgagccacttattgtcatgatattttttacaaaggtgaagaagcttgagataggagggggcatgtggtggtaggaaataaagagttcagttttagacacgttaaatgttattatgtctgttgtataaatggagatgtcaagtggacaagtaagtctgaatatcagatgagaggtctagggcaataatttgagtctttagcatataggtggtatataatggcatgggaataaatgaaattacctagaagaagggtgggggaaggaggaagcatagaaggaagaagacaagagagaaaaagagaaagcaagagagagagataagggagtagggaagaaaaggagatttgtgaatagagatatcaggaatttcaacatttaatttcaggaagaagaggagttgccagggagaagagaaaaaggaaaagaccttcacagaagaaaaaacaaaacaaaacaaaacaaaaaacctggggaatgtttcaagaagtggtaaactccatcagatgctacagataagctaagtaggataggttcagaaaagtgattagagtgtgtctggctctgtgaaagttgttagtgaccctttaaaaagcgattttagaaaagcaatgaaatagaagccaaaatattgttaaactgaagagtggcaggtgaggaaacagcacaactgaatacctctttaaagatatttggttatgaaggggtgctgaaaaatagattaatacctggattggagtaagatgttaaaaggagtagtttggggtttttttaattttagagaaaagagcatatttttaatttatgtgaatacagaatgatccatagaaaaagagattgaggataagggagagaggggataactaaaggaaaaaaattcttaaggaagtgagaaggaatgggaatcaaagcacaggtacaaggactgacatttaataggaggctttgtctattagtatagacagactttttttaaaagaaatgagagaactacagaatgaagagatacattgaaaagtacattgtttcattgagagatgaaacaagtgattgttatatctgattttcagttcagtattttagtagtttttcctcttaaaatcagttttacagtgtaaatttcttactacaaagctttatgttgaaaatcaactactttgaattgtaattagtaggaaaaaatatgtttctatctttgaatttacaaaaatcaacaaaaacatacaaaatacgggagatattacctagcagtatgtgtgaattttcttgacgttagttaatagtaatctcatcgtgagtcagacaaataaaacagtctctcaactaggaataacattgtaccccagggatatttggcaatgtctgtgaactttttgattgtcacaactgaagagtagggatagtctactgacacctacatctacaatgtatttctacaacaaaatattatctagccaaaatgtgaaatcaaattgaaaacatttagaacacaattgtaaataataatttagtaagcaaaaattttaaagtgtagactatatggatggaaatatttgtatattgggtataagtctcctagagaatactgatattttatttgatgtttacaagttattacttaaagtactatcttattatattaccaagtaagctacatcacaggtgtatatttttaagttataaaagttggtgtgattcacagtagccaggaaatcatatttctgatactcaattgtttatttaccataaaagttctgtatctgttccaaccagaatttattacatactttctgatgaatcactgtaaaaaccttcaagtttagtagccaatttgctttactctattcacatgtcagacacagctttatccacataaaatcttggggaaatttcatcatttagtgctcattagagtattagcaaaagcatgatgtttgacttgtaccctgagtactttagtagaatacctactaatgtcagtaatggattaaccaacttaactggtttccattccactgattcctcctgtcttcaatccagctttcacagtatttccaatatttcaaatataagtgaaagaggggctttccatttccagataggatgttaaaagatgtaaaagaccttaatccccatggtaggaacaatgatgaaaacaacaaaatcctatagtaatgacaataaaattaaaattatccttttctatggggctatggaagagtgatacattcaaagaagtctaattaactgaatgccagacagagaagagccattcacaggtgagcagaaagctactgctgcttccatacctggggctagtgactgacctgggtataggtgggggaaagagtgggcttttgatagatagacagactgaaaggaatagaaaatagccagtgaggtttaatggctgtttggactgacctatagattggaatttgaaagaatttgaaacaaccctaaatagaaaaataaatcattcaagttggcaattgtctgccactaaaccctcaccaatctcagaatttttctgcaaaagtagcaatgcaggtggactggaaggcagagaaatttatgcagtcttaatgtgctgtattctggggtaattatagaatttaaccaaaagttgaattaagatgaattaaaactatctgaaacagcatcccaactgtgtcactgcacaaataccaatacaaataacaatcagtcccttggcaaagggggtataaaagattgagtgttggattgagaaataaagagagattttcatagtccaatttgaaacaacagtggaacttaatcttattaaagctacagcccagccccagcttaaatacttagcagaatctgaatgattctacattatatgtgtgtgtgtgtgtgtgtgtgtgtgtgtgtgtgtgtgatattcctgatattagtgataatatacatatatgaatgattctttagtttttactactgttgtacacagatcataccatcagaaattagaaaacatgcaaagaagcagaaaattgtgactcataattgagtggggggacaaaagtcagtcgaagcagatccatagagacccaaattgaaattagaagccaagaactttaaaagaactattataagaatatataggaaaagaggctgggcatggtggctcacgcctataatcctagcactttgggaggcagaggtgggcagatcacctgaggtcaggaggtccagactagcctggacaacatggtgaaaccctgcctctactaaaaatacaaaaattagctgggtgtggtggctcatgcctgtagtctcagctacttgggaggctgaagcatgagaattgcttgaacccagaaggtggaagttgcagtgagccaaaatcgcgccactgcactacagcctgcgcgacagagtgagactctgctcccaaccgccaaaagaatatataggaaaagatggtttggctgagtaaatatgttggggaattttagaagagaaagtgaaacgctgaaaaagaaccaaatggaaattatagaacttaaaaataaaatatgtgaaattaaaagttcatggttgtttcttagctgttaatgaataatgctgcattgaacatgagaatgctaatatttctttgagaatcctgttttcaattattttggataaatacccagaagtaggattgctggatcatatagtggttctattttttattttttgatgaacctcattgctgttttccatctcagctgtaccattttacatgcccaccaatagtgcacaatgattccaatttctccacatcctcatcaacacttgttattttctgtttttgtttgtttgttttgttttttataatggccatcctaacaggtatgaggtgatatctcatggtagtttcaatctgcatttccctgataattagtgatgttgattagtgatgttattttcatataactgttggctatttgtattatcttacacaatacgtgacaataaattcaaaatgcatttaaaaattaaacataagacctaaaactgtaaaacttccagaagaaaatataggtgaaaaccttcataacattggtcttagcaaagaattcttgaatgtgacatcaaaggcacaggtaataaaggcaaaaatacgtaagtgataccgcatcaaactaaaagcttctacacaacctaaatatctgcagacagatgaatgaataaagaaaatgtggtagatacatacaatggaatattagccttaaagaaaaagaaaatcttgtcatatgctacaacatgatgagccttcaggacattacactagatgaaataagccagtcatagaaggacaaatattatatgattccacttatatggtgtatatctaaaatagtcaaactcacagaagcagaaagtagaataatgattgccaggatctgtggagagggaaaaatggagagctactgttcagtggatacacagtttgagttatacaagatgaacaagttctaaatatctgctgtgcaacagtgtgaatatggtaaacagtactgtaatgtacactgaaaaatttgtttagaaggtagatttcatgttgtgtgttttttaccattgaatatatgtgttgattatatatgtagagttaagtgtctttggggttcttctcctaattataagaacctttgtgaagtcagtgtagggtaacaatcaccaacacaacagcatattttcaattgtatttgctctcctagcagatcttgtaaaaatcaacatggaaggataatatataatcctatattcatctctgacctctgaattgaggtattaagtagacaaaaaatcaaaagcaagtttcatgaaatcatctatcatcgtcattttttgaaaacagtattactatcttttcccactagcaacatgaaaagcaaatgaggaagatattttatagaaataattaagctggtgatgtttttcctccttgaggagtttcatattcatagaaaccttgaggataaaggtttcatattctaaaactgttttttcagagacagtaacatttaaacatctttatggaagtgtcaaggcaccctttatacttactaccaaggaacctaaattggactttttgaataaaaaggcattcctttcaaaaacaaaagttcacatgattgctttaacaatatattgcacagcactaggaactatcagttaacttgaatacacgtcactagaaatgatccaaacagaagcacagagttaaaaaataataataataattaagctaaatgaacatcagtgactttggctgaaattttttccaaatttgatgaaaaacatcaacttaaagatccaggaagctcaaaacaccctaaactagaaaaatacaaaaaggccaggcatggtggttcatgcctgtaatcccagcactttgggaagctgaggcaggtggatcatttgaactcaggagttcaagaccagccggaccaacatggcaaaaccctgtctctaccaaaaactacaaaaagttagctgggcatgcagctgtggtcccagctacttgcaaggctgaggttggaggattgcttgagctgggaggcagaggttgcagtgagccatgattgcaccactgcactccagcctgggcaacagagacctgatctcaaaaaaaaaaaaaaaaaaaatacaaagaaaacgacacttaagactttatagtcaaactactaaaaccaacctacaagagaaaatcttaaaagcagtacagaaacatacacacacatacaaatacaagggaaaaatatgaataatgagtgattttttccatcagaaataattgaagctagagacaacataatgacgtcttttaagtgctagagaaaaacaactgtcaatccagaattctatatctagcaaaaatatcattcaaaaatgaaagtgcatgaattaacagatctgtactataagaaatagtaaagaaaatttttaaagcagataaaaaaacgatggaaaattaggaatacaggtaagaatgaaaagcactggaaataataaatatgtgggtaaatataaaaaggtattttgtctttccgtaaactctgtgttactctttcagaagtaacaatgtattatgggatttataacatgtagaagtaaaatgtatgataacagtaacacaaagtattgaagagaagtatacagaattatactgttgtttttttcaacataggagaagtgatgtaagaataattaaagatgcactgtaatgaatctaacaaatagatgcacattataatccctagaacaaccattaaagaaaataaaacagagaggtgtagctaagaagccaaagagatgataaaatggaatactaagtatattttattttctcaaaagacagaaaagagtaacagtaaacaaacaaaaaaaagaactgaggggacaaactgaaaacaattagaaagatgatagacataaacttaaccccatcaaagattatattaaatagagtacacattccaaaaaaagaaaaagagcttctgagacaggattaaaaagaaacaaatatcaaaaacagtgtatatgctatttataaaagatgcacgttaattataaaaacataaataggttgattactgtagccttgtagcatagttcgaagtcaggtagcgtgatgcctccagctttgttctttcggcttaggattgatttggcaatgcgggatcttttttgattccatatgaactttaaagtagttttttccaattctgtgaaaaaagtcattggtagcctgatggggatggcattgaatctataaattaccttgggcagtatggccattttcacgatattgattcttcctacccatgagcatggaatgttcttccatttgtttgtatcctcctttatttcgttgagcagtggtttgtagttctccttaaagaggtccttcacatcccttgtaagttggattcctaggtattttattgtctttgaagcaattgtgaatgggagttcactcgatttggctctctgtttgtctgttattggtgtataagaatgcttgtgatttttgcacgttgattttgtatcctgagactttgctgaagttggttatcagcttaaggagattttgggctgagatgatggggttctctagctatacaatcatgtcgtctgcaaacaggggcaatttgacttcctcttttcctaattgaatgccctttatttccttctcctgcctaattgccctggccagaacttccaacactatgttgaataggagtggtgagagagggcatccctgtcttgtgccggttttcacagggaatgcttccagtttttgcccattcaggatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtcattggttctgtttatatgctggattacaattattgatttgcgtatgttgaaccagccttgcatcccagggatgaagcccacttgactatggtggataagcgttttgatgtactgctggattcggtttgccagtattttactgaggatttttacattgatcttcatcagggatattggtctaaaattctctttttttgttgtgtctctgcccggctttggtatcaggatgatgctggccgcataaaatgagttagggaggattccctctttttctattgattggaatagtttcagaaggaatgataccagctcctccttgtacctctggtagaattcggctgtgaatacatctggtcctggacttttttttggttggtaattaattattgcctcaatttcagagcctgttattggtctattcagagattcaacttcttcctggtttagtcttaggagggtgtatgtgttgaggaatttatctatttcttctagattttctagtttatttgcatagaggtgtttatagtattctctgatggtagtttgtatttctgtgggattggtggtgatatcccctttatcattttttattgtgtctatttgattcttttctcttttcttctttattagtcttgctagcggtctatcaatattgttgatcttttccaaaaaccagctcttggattcactgattttttgaagggttttttatgtctctatctctttcagttctgctctgatcttagttatttcttgccttctgctagcttttgaatgtgtttgctcttgcttctcttgttcttttaattgtgatgttagggtatcaattttagatctttccacagcatggtactggtaccagagatatagaccaatggaacagaacagaaccctcaaaaataatgccacctgtctacaactatctgatgtttgacaaacctgacaaaaataagaaatggggaaaggattccctatttaataaagggtgctgggaaaactggctagccatctgtagaaagctgaaactggatcccttccttacaccttatacaaaaattaattcaagatggattaaagacttaaacattagacctaaaaccataaaaaccctagaagaaaacctaggcaataccattcaggatataggcatgggcaaggacttcatgtgtaaaacaccaaaagcaatggcaacaaaagccaaaattgataaatgggatctaattaagctaaagagcttctgcacagcaaaagaaactaccatcagagtgaacaggcaacctacaaaatgggagaaaatttttgcaatctactcatctgacaaagggctaatatccagaatctacaatgaactcaaacaaatttacaagaaaaaaacaaccccatcaacaagtgggcaaaggatatgaacagacacttctcaaaagaagacatttacacagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaatacttttacagtgttggtgggactgtaaactagttcaaccactgtggaagtcagtgtggtgattcctcagggatctagaactagaaataccatttgacccagccatcccattactgggtatatacccaaaggattataaatcatgctgctataaagacacatgcacacgtatgtttactgcagcactattcacaatagcaaagacttggaaccaacccaaatgtccatcaataatagactggattaagaaaatgtggcacatatacaccatggaatactatgcagccataaaaatggatgagttcatgtcctttgtagggacatggatgaagctggaaaccatcattctcagcaaactatcgcaaggacaaaaaaccaaacactacatattctcactcataggtgggaattgaaaaatgagaacacatggacacaggaaggggaacatcacaccccggggcctgttgtggggtggggggagtggggagggatagcattaggagatatacctaatgttaaatgatgagttaatgggtgcagcacacaaacatggcacatgtatacatatgtaacaaacctgcacattgtgcacatgtaccctaaaacttaaagtatataaaaaaaaaatacgttgaaagtaaaagaaggggaaaagaattccatgaaaacactatccccaaaaaagctgatatggctatattaatattagatgaagtagacttcaaggcaaggagataaacagttcaaattaataaaataaatgaccagaatgatataaaaatcctacatacttgcataaacctaataagaactattcaaaatatatgaagcaaaaactgtcaaaactagaaatagacaattctaccatcattgctggaaattcatcatttctcttttgtaactgacagaacaaatagacaaaaattggtaagattataaaaaactaaagcaactctcttggccagattgatctaataacatacacacctacacaatgcaattgaaaatacaaattattttcatgtaaacacgtaacattcacaaggatagactgggcgataaaacaagttataataaattacaaataattgaaattaaatagaatgtgttctctggccacaaaaggaattaaattaggaatcaacagtatgtataaaattccctaatacttgaaaattaagcaactcatctctaaataactcatagcttaaaaaagaaattacaaaggaaattttaaaatatttttgaactgagtgaaagtacaaacacaacatatcaaaatttatgagatattactgaaggagtgcttagaggaaaatttagaacattagatgttatgttagatttttttttaaatctctacttcatgatctaaagctcttgattaagacattaaaaagtaagagcaatgtaaaccacccaatgtaaaggaaataataatcatcaaaaatgaacgaaatagaggtcaaaccagagtagatcaacaaaaccccaaaacagttcttcaaaaatactatataaaaccctaacaatactgatccagaaagaagaaacataattaataccaggagtgaaaaaaaagcatcactgaattctacagacattaaagaaataaagtaagattattaactctattcccagaaattgacaatttagatgaaattaagagattccttgaaagacaaaactcaccaaatgtaacaccaaacacattggaaaatataagtaacccatatcattaacattttttaattcaaaattaaatacccacaacaaagaaaactacaagccacaggtggctgcacttgttaatgctatcaaacatttaaggaagaagtaacaccaatcttatgcaaattcttccaggaaataaaagaagaaggaaatctttccaactgtttgtctgaaaccagcacaatgttgataactaaaacttgacaaaggcagtacaataaaagtacaagtcagtctcatttatggaactagatgcaaaaatcagatataaaatattagcaaatggaagacaaacatataaaagaaagataaagcatcataaccaaggtggatttatcccaggaatgcaagtttaaaatttgaaaatcaatgaatgtaaaatactgattaacataagaaaggagaaaataatacagtcatatcaatacatgtgaaaacatttgataaaattagatattttaaaataaaaatccttaacaaaacaagaatagaagaatatttcctcaatagaataaaccgtactaagaaaaatctacagcatcatacttgattgtgaaatactgacttttttttgtagaatcagtaaccaggggaggatgtttactatcatcacttttattcaacatttagttcataacctagtaaggacaaaaagcaagattaaaaaattatatgcctaaagattagaaagaaaatttaaaactgtctttacttgccaatggtatgatggtgtatgtagaaaacccaaaggaaactacaaaaataataagtgaatttagcaagactgaagaacacatgtcagtagacaacaattaattatatttctatataaataacagcaaacaatttgaaaatgaactttaaaaaaataccatgtacaggatagacttccagctggcagcctgaggagtatcatagacttattcctgagtggaagagcataatttatgaaagctattttaaaaacaaccatgtaaagtctccagaaattgtcgtaagggcatatagcaaatgaagacatatttattcaagaaaatctactgaaacttggtagaaacaatgagagtctgtggcacttgaaccacaactcacttaattcctctcccccttccaggttgccagcatttctcatcccctccaactccaagttgaagagaccaaattcctgggaagtgttaccaagaggtcagaggctcccttctgaccattccccaatgacaggacagaagctctaccccaggcatagacctcagtaccataaaatattgaatccctgattgcccttaccccatcttgctcatagggcagaagttttatgcttgaaaagataagctgagaagaccagaggataccacctttgcccaaggcccagactagtggctcaaaggttttgcccaggaaagaaatgcggtctacgtgaatagagagcttcaaagccctccccaaagtgactagccttatatgaaacagtgtgggaaagttcaagcctaagtgtgctctcaagaccaatgggaaatttggtgataatgaaataagaggaagtaattgatagcacctcttaattaggggcaacagactagaccagtgagaaccaatgaacgagactgctaagaagagccttcctgggatttaaacctcaaagactagcctgaaaaatgaccccttatcaaattaaattagatcagaatactgtacaatgtatgtcccagggtactgtcaaaaataatagaacatctggtggatgctaagcttgaaaaacaataaaataatagaccaattacccagctgtgatttggcagtgtaacagctgtatatgatattaacagaggcagacaggttaacagagagatgaaggagatagttaaagagaatcctgctaaaatcactgccatcccagagtgactatatacactgaatactgtgccttctgagaagcaacctcaaagtcttcacaatgtagaggaaataaacctcatgaaaatagtctagccgagtcactgaataaataaataagcaaacagcaaaaactggagaggggagagaggaatcagtcgtcagtacccagaagtgatacaatatattacctaaaatatccagttctcaacaaaatatcatgagacttgcaaagaaacaaagtgtggctcattcacagggaaaaaaagcaacaaaaatttcctgtgagaaggcccagatgttggattgaacagaccaagacctcaaaacaaccattataaatatgcttaaagaactggaagacactatgcttaaagaagtaaaggaagctatgatgacaatgtctcatcaaatcaagaacataaataaagaaatagaagttacaaaaagaaccaaatggaaattctggagttgaaaggtacagtaagtgaaaagaaaaattcagtagtgggactcaacagtagatttgaactagcaaaaataacaaccagtaaacttgaaaataggttaatagagacagtgcattctgaaggacagagagaaaaaaatatgaagaaaaataaagtctcagagaaacatgggacacaattaagtgcaccaacatatacataataggattagcagaaggagaggagagttagagaagaaaggagaaaaatatttgaagaaataatgactgaaaacttcccaaattttatgaaaaacattaattacacatccaagaagctccatgaactccgagaagataaatggaaaaatatctacaaccagatgcatcatagtaaacatgctgaaacacgctacaaggcaaaaaacaaaaagaaaatcttgaaagcaataagagaaaaatgacttgtcacatacatggaactcttacaagattaacagctcatcagaaacaatggaggccagaagggaatgggatgacatattcaaattggtcaaacgaaaaaactgtcattcaagaaacttatatccagaggggaacaacacactggggcctgttgttggagcagggggagggagagcatcaggataaataactaatgcatgtggggcttaatgcctaggtgatgggttgataagtgcagcaaaccaccgtggcaaacgtttacctatgtaagaaacctgcacgtcctacacatgtatcccagaacttaaaataaaattaaatttttaaaaaaacctcatatccagcaaaagtatttttcaaaaatgtaggtgaaatagacattgtcaggtaaacaaaaactgagagaatttattactagcagagccaccttacaagaaatactacgggaagtttttcaggctgaaagaaagtgaacctagattgtaatttaaatctacacaaaggaacaaagagcatgttaaggtaactatgtaattatgaaagagtataaatgcatatttcttctctcagctgatttttaaagcaatttataaaacaacatatatataattgttatttggggatctataacatagaaattaaatacatttgtcagtaagagcataaaggaagtgggtgggagcaaagttctgtttcagtaaacagattattccagatgatagcctggattcaccagaacaaataaagagaataaaaaatggtaaatggtaaatcagaaggttataaatatatgcttgttcttcttatttcttagcttttataaaagaaataaaattatataaagtagtaattataatgttttattggtttgtaaaatatatagatttaatttgtataccaataacagcacataagagagaatacagctattaaaaattaacatttctgtatctcactggaattaagtcagtatacatctgaagtagactctgattggatatatacagtaagttctaatgtatacggtaagttttaccactaggaaaactccagaaaatatggtgaaagattaatcaaaggaatgaaatgctgcacaagaaaatattcacttaatgccaaacaaagcagtaaaagactagaggatcaaaaaaaaacatgagacagagaaaaccaaaaggaaaatgacaagtgtaacccaactatatcaataatattaaatgttaagtgattaaacaatccaatcaaaagacatagattgtgagacttttttttaaaaaatcaagatctgcctatatgctgtttatgagagagattttagatttaaaggtgtaaataggttgaaaatgaatgggaaaagatcatatgaacaacagccataagaaaactggagttactgtactaataccatttaaaaaaatagattttaaagcaaacagaatgtcactagaataaaaagtgaccttttataatgataaaagtgtcaatcaagatgagacaataattaaaacatatatgtcccaaataacagagttacaaaatacatgaagcaatgcctaacatgatcaaaaagagaaagtcaataataattgttggaaatttcaaagttccacttttaaaaatagatacaagaactagacagaagatcaaaaaagaattagatgactggaaaaatgctatgtagaagacctcgataccaaaatctccaaaatattgcagaaagaaacatttaaaaaattatttaaatggaggggaataccaggtttacaggttggaagactcaccttttaaaagatctttattctaccaaattaagccatatgtttatcacagtcctataaaaaaatctaacatattatttgtagaacttgagaaagtgattctaaaatttatgcagaaatgcaaaggatctggaataactaaaatactcttggaaaagaagaacaaaattggagaacttcactacctgatttcaagatgtgccttaaagccacattaattatgatagtgtggtaattgaaaaaaagataaataaatggatcattacagaataaaaagtccagtaatagatccacacatgtatggccaatttgtttttgacaaaggcaccaataaaaatcaatgaagaaagtctttttaacaaataatggtggaacaactgggcaaacaaataggagaaaaatgaactttaattcctacttcacgtcacaaccaatcatttttaaagttctagaagaaaacaaagaataatatcttcatgatcataggtttggcactgactacttaggaattaaaaagaaattacaataaaaataataaatttttcttcaagtaaattaaatttctgctcatcaaaaggcactattaagaggccaggcatgggctgggcacagtggctcacgcctgtactcccatcactttgggaggccgaggcgggtggatcacgaggtcaggagattgagactatcctggctaacacggtgaaaccccgtctctactaaaagtacaagaaattagccaggcatggtggcggacacctgtagtcccagctactctattccgaaggctgaggcaggagaggggcatgaacccaggaggcagagcttgtagtgagccgaaatcgtgccactgcactccagcctgggtgacagagggagactccgcctcaaaaacaaaagaggccaggcatggtggcttatgcctgtaatcctagcaccttgggaggccaaggcaggtagaccactggaggtcaggagtttgagaccagcctggccaacatggtgaaaccatgtctctactaaaaataccaaaattagccaggcatggtggcccacacctgtaatcccagctacttgggaggctgaagcaggagaatcacttgaagctgggaggtgaaggttgcagtgagccaagatcgcaccactgcactccagcctgggcaacagagcaagactctgtctcaaaaaaaaaaagacaccattaagcaaattaaaagataaatcacatactgaaagaaaatattcacaatgcctatttttgactaataattcttacctaaaacatatgaagaattcttactactacataacacaaatataagcagtccaacataaaaaataagccagaaatttggatagaatcatgaagatatatgattagccaataagcatgtgaaaatgttccaactatccatagtcatcagagaaatttaaaatcataataagatactactatgaccagaaggactaagattttaagagactattacctagtgttggtggagatattgagcaattggaactcccgtaagttgctacggagaatgcaaaatagacagcccctgtcattaccatagtggaaagactatggaagtatttaaaggaaaaacacaaacaaatcaaagattttgacatataggtatttattgtggctttatttagtatagtaaagattggaaaatccaaatgtttcacaatggaggaatgttaaattaaaagtgtggtatatctttataatgatttgataaatttttaaaatggtggaattgtttatgaaataaatgttatatacaaaaatcacaagcattcttatacaacaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaagatacaaacaaatggaagaacattccatgttcatgggtaggaagaagcaatatcgtgaaaatggccatattgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcaagctaccggacttcaaactatactacaaggctagagtaaccaaaacagcatggtactggtaccaaaacagagatatagatcaatggaacagaacagagccctcagaaataacgctgcatatctacgactgtctgatctttgacaaacctgagaaaaacaagcaatggggaaaggattccctatttaataaatgatgctgggaaaactggctagccatatgtagaaagctgaaactgaatccctgccttacaccttatataaaaattaattcaagatggattaaagacttaaacattagacctaaaagcataaaaaccctaaaagaaaacctaggcattaccattcaggacataggcatgggcaaggacttcatgtctaaaacaccaaaagcaatggcaacaaaagccagaattgacaaatgggatctaagtaaactaaagagcttctttttttttttttttttttttttatggcagaaaaatgtagttttatttgttttgtttttgacttaaggtatgtcaatcttttttttttttttttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaaagattagggagtggtgatgactcttaacgagcatgctgccttcaagcatctgtttaacaaagcacatcttgcaccgcccttaatccatttaacgctgagtggacacagcacatgtttcagagagcacagggttggggataaggtcacagatcaacaggatcccaaggcagaagaatttttcctagtacagaacaaaatgaaaagtctcccatgtctacttccatccacacagacccggtaaacatccgatttctcaattctttccccacccttcccgcctttctattccacaaaaccgccattgtcatcatggcccatcaccaatgagccgctgggcacacctcccagacggggtcatggccgggcagaggggctcctcacttcccagtaggggcggccgggcagaagcgcccctcacctcccggatggggcggctggccgggcggggggctgacccccccaccaccctcccagacggggcggctggccaggcagaggggtcctcacttcccagtaggggcggccgggcagaggcgcccctcacctcccggacggggcggccggccggaaggggggctgaccccccccacctccctcccggacggggcggctggccgggcagaggggctcctcacttcccagtaggggcggctgggcagaggcgcccctcacctcctggacggggcggctggccgggcggggggctgaccccccacctccctcccggactgggcggctggccgggcggggggctgaccccccacctccctcccggactgggcggctggccgggcggggggctgacccccccacctccctcctggacggggcgactggccgggcagaggggctcctcacttcccagtaggggcggccgggcagaggagcccctcactcccggacggggcggccggccgggcggggggctgacccccccacctccctcccggacggggcggctggccgacccccccccccgcctccctcccggacggggcggctggccgggcagaggggctcctcacttcccagtaggggcagccgggcagaggagcccctcacctcccggacggggcggctggccgggcggggggctgaccccccccacctccctcccggacggggtggctgccgggcggagacgctcctcacttcccagatggggtggttgccggacggaggggctcctcacttctcagacggggcggttgccaggcagagggtttcctcacttctcagacggagcggccgggcagagacgctcctcacctcccagacagggttgcggcccagcagaagcgctcctcacatcccagacagggcggtggggcagaggtgctccccacatctcagacgatgggcggccaggcagagacgctcctcacttcctagatgggatggcggcggggaagaggcgctcctcgcttcctagatgggatggcggccgggcagagacgctcctcactttccagactgggcagccaggcagaggggctcctcatatcccagacgatgggtggccaagcagagacgctcctcacttcccagacggggtggcggccgggcagaggctgcaatctcggctctttgggaggccaaggcaggcggctgggaggtggttgtagcgagccgagatcacgccgctgcactccagcctggacaccattgagcactgagtgaacgagactccatctgcaatcccggcacctcgggaggccgaggctggcggatcactcgcggttaggagctggagaccagcccggccaacacagtgaaaccccgtctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggagggagagggagagggagagggagagggagagggagagggagagggagagcgtaagcgtaaactaaagagcttctgcacagcaaaagaaactaccatcagagtgaacaggcaacctacaaaatgggagaaaatttttgcaacctactcatctgacaaagggctaatatccagaatctacaatgaactcaaacaagtttacaagaaaaaaacaaacaaccccatcaaaaaatgggcaaaggatatgaacagacacttctcaaaagaagacatttacacagccaaaagacacatgaaaaaatgctcatcattactggccatcagagaaatgcaaatcaaaaccacaatgagataccatctcacacccgttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccttttgacccagccatcccattactgggtatatacccaaaggattataaatcatgctgctataaagacacatgcacacgtatgtttactgcagcactattcacaatagcaaagacttggaaccaacccaaatgtccatcaatgatagactggattaagaaaatgtggcacatatacaccatggaatactatgcagccataaaaatggatgagttcatgtcctttgtagggacatggatgaagctggaaaccatcattctcagcaaactatcgcaaggacaaaaaaccaaacactacatattctcactcataggtgggaattgaaaaatgagaacacatggacacaggaaggggaacatcacactctggggactgttgtggggtggggaggggggagggatagcattaggagatatacctaatgctaaatgacaagttaatgggtgcagcataccagcatggcacatgtatacatatgtaactaaccttcacattgtacacatgtaccctaaaacttaaagtataataataataattaaaaaaagaagctcatcaaagtaaaaaaaaatcagaatatgaaactctttattggattaaaaatcatcatggaaggggccaggcgtgatggctcatgcttataatcccagcactttgggaggctgaggcaggcagatcacttgaggtcaggagttcgagaccagcctggccaatatgatgaaaccctgtctctactaaaaatataaaaattagctgggcttggtggcacacacctgtaatcccagctacttgagaggctgaggcaggagaactgattgagacccaggaggcggaggttgcagtgagccgagattgcaccaattcattccagcctgggcgatagtgagactctgtctcaaaaaaaaaaaaaggaagaaaaaagccaaaattatgatgaaattgtgtattttttaatcctctccatcacttttctgtatcttccaagttttctagagggacaaaactttacttctatagtccaaaaaatgtttatttttaaataatgattgttctgaataactatatagtatttaatgatgataattataaaattgtttagggttttgacacgttgtaaattggcacaaggaagtagttttactattattgttagatccatattcagttcagttcctaccttcatcaggaaagtaggtaaattcagaaggagctagggaaaatgacagaatcaatagacagtacagaaatagaaaagatggtattttccagacaaatgagcttagctctttaaccaccaaattttgtattttaaaattttgatgaaactctttctaacatatacatcatgctttcttacttactatcttatagtgaccaaatcccatccttcctcctagctgtttaactttggagaattgatgtaatagcctttcttcccctgttttcttatctgtatgatggggttaatattataacccctctaattatattggtaggtgggaaaacgataatttatataaagtatttagcggaggattaggtacaaaataatagatactagttgctgttattactattactacaaagagcgtgtggcacagtaggcattcaataaatttgattcactgactcaacttacagtgatgtctttaaaacctttcagagatctgtaaaacacccacctgttaaatggtcccagatctctcactcactagtcattacagttcctttctctgcccattttttcactgttgttccacgttacttttcttaatgtttctagttctagcagcctcctcctctttataacttgcagtttctaatttgctgtcagatagcaaagcctgttcaagtcagtacactttcaaggagtgcctagaaaactcttatagcaactctgtggattaacacttactgcttatttagtcaaactttttcctaatttgtatatctagggttaagaccgtgttcgacatagtttagtttgatgaatgcctatttccagattaatggtaatatttatatcagtaaatattatgtgtactatgattacaaacagaaatttaaaattggatgagcattacattgaaagtcttgaaaataatgttcaatgaagtaaaaaatagagcaaacagtaagctttgcatttggtattcagtgctctataagcaattgaaatatgagtgcagaataaaaaatctgagttctgtgtccttttcaagctatgttattgacttacttctctgactttgaataaatagcttaaactctttgaagttatagtttctcacttataaaacacaagagttgggctaggttgtcacaaggcaccttttggttccaaaattctgtgattttttttggacctaccacaagcttattgctataaattgtataaagaagagggtgatgggaaagaataggaacaaagattattttggtcattgaaaatagctctcaaatgtttctgagcatggagacagattaaaatagaaattatgaatatttatttcacaaaagaaagtctgtgagactttctaacaaagatagaaaaaccataatgaagaatattttacaaataccatataaatacagattggcaagtagaaagaattataaaatgtttattaatctgttgtgtctattgttgcatttgtcagaaaagtggcagaataaaaattaagaaatattggaaagagaaaaatatagtgcttattataaggaatttgatactattgaacaaaacacagtatgtaatatacaatactacatttttataaataaatataaaatttagaatttgtagtttttaaagatcttttaaaagccaataatcatatctcctgagaggatatttgattaggtattgttaaaaccccttctaattcttcttatttatgatctattttcagataaaattgggtcatttattaaagtagctatttcttataaaaatagttaaaaaaggattttatatctttgtaccatccatgtttaaatactcttgcatgtcaatcagttacttctccttattttttcctgtatcacttgtttaaacaaattttcagaataggccaggcatggtggctcacacctgtaatcccaacactttgggaagctgaggtgggagtattgcttcagcccaggagttcaagaccaacctgggcaacatagtgagaccctgtctctataaaaataaaaaaaaaattaataaaaatatttttaaaattcagaataattgacgtaacttggacatgataaagtagttttcacataaaaaaaagccttttaaacttgtaggaattaagaaataagaataacctacaaaatgctagcaaaatttatctcattttttttcattgtattttcaggtttaactgaactgaatgacagtccagttcccctagaacttgagcgctgcaagtctcctacctcaggtaaacatgagtggtattttgcagacttctggtaattcactgcagtaatctgttgctttattttcatgatctttataatgtgaaatttataattttagtaattaggtataattccattcattaaatttactgtaagcaaatttgattccaaatatcaaatacaaacaaatgtcttttaaaatatttttatctcaaaataaaattaagatcagaggtaaaagtgcaacactttaaaagacattttaaaggaaagttattttgcagatacattaataatgcttactaagtattgaataaaaattggtgatatagagaaacttgtcatcttcaggctagagctgaattagtgggaaatatacagtatatatgcagaagcaaatgataccattcctctagaccacagtttggaaacatgtatatttattcacaaggaaaaatgatgatagaatatgatatgaagcaaaacatcaagacaaagtgtgcacccattaaaatatatttaaaatgtgagaataaagattcctagggataaatctttaaggtactgtctgttaaaaaaaaagttaacagttatttttgggtggtgggaatatgactggttggcctgttttttaaaatttttacatatttgataattctgatttttctataatgtatatatagttttgtgtgagtttttaaacaccaaaatcattaggtatgtctttactgaatgatagatctgttcttacagacaagaaactgtagttcctttttatttacattattttaatttgaaccttatacaaatttataaaagtttaataatgccattataaagcaacgaatttggacttgtagaaattaatttagaattgcagcatttcttccatttattccatccctgaaaagtggttagttctttattcttattcttcaggaatctaggctatgtataatctagttatatcctatgtaaatttttctcttagtcatatatttttaattcttattttactgatcttattgtaaagactgtctcatatgtttaccctgccttttgcattctcattgacaccaacccaatttaggtatttattgcctcatacctatggtatcatacaaatattctagtagatgtctgtattttctctcttcaccttttacaattaatgttgcatgtcatgttgtaaaattaatattcttaaaatattactttgatcatattttcccatgcttataaatcttcgatataaaatataattcaataccctttatcaaatttacatacgtaacttcaaattttgttatagctggccaggcacagtggctcatgcctgtaatcccagcactttgggaggccaaggggggaggatcacttgaggccatgagtttgaagaccagcctgggcaacatagtgagaccctgtctcattaaagatgataataataataattttaaaagttttttaaagatcattatagctgttctacctttttgtattttcatataacttttataaagaatttgtcagttcacacacaaacatgcttagatttttattatgatttcactggatctatagatcaactgggcagaattaacatattcaacaatattgaatttttcgtttagtatctctctgtttatgtgtgtctactttctttcggtaatatttttgggtttttttgtagaggtcttgcatatctttcattaaatttattcctttgtgtttgtttttttcctattattgtgttatttttatgtctttttctaattatttgtggttagaatatgaaaatacagctaatttttgtatattgagcttgcatccaggaaacttgctaaatctatttcttaattcttatagttggtaaaattcttttggattatctacgtatctaagtatgccccttgtgaaaatgaaacctccattttctccttctaaaggaaaaaattggctagggccttcaatacaatgttgaatagatgtggtataagtagactttttttcttgttcccagtctcattgataaggctttcaataactcataattaattattataattgctgtcagtttttggtagatatgctgtttttagccctttgcctatgatgtttcttcttttgttaatgttacagcagatttaggaacaccaccacaacgcacaacgaccacactttttttttttttttttttagacggagtcttgctctgtcacccaggctggagtgcagtggcgcaatctcagctcactgcaacctctgcctccgaggttcaaggattctcctgcctcagcctcccaagtagctgggactacaggagcgtgtcacacacccagctgattttttgtatttttagtagagacggggtttcactgtgttagccaggatagtctcgatctcctgacctggtgatctgcccgcctcggcctcccaaagtgctgggattacaggcgtgagccaccgtgcccggcccacactttatttttaatttcaaagcagactcagaaaactgtgcatgcaattaagtagattgtttcaaagcaggaaaattttgactatttttgtattatgttacttgaggcagaaatgatggattgtgataagatccatttgtcacttcaataccttacttgatactggtctactagacaggtcccactcttctttagtagcaactttaaattataagtaataataattgaggaatgagagatttttttttccttataacagttttgtaatcattaaatgttatatttgttaaactatgtgaaatgcatccttctgggaaaagtgcgaatggagtttactacttaagaatattggaaataatcacaatatttactgatttcattcattttccatgaaagagaatgataattaattgtgctatattagagggtcatttaaaggacagtgtgcccattattatttccaaaattcaatacaatacatatacaatagccacacatacacctaaaactacattctgtaatctcttgctgttgtaggaattgctgcattctgattcagtagatctgaggtggggcctgagattttgtatttctagcaagctcttggctgatgctaaggcttctggtctccagatcacttgagaatcactgccctatgaaacattttaaaaatattttttcagtagttacctcccctgtaggtatctgtttgggaatctcagctctcacccctttaaatctgctacagatgaaaagattgatgcaaatgtctctgaataaaggaggtcaggaattaggcaaaccagaaaccagtaatcattttataactctgatattctccttttaatataatttcaacttttattttagattcaggggttacaagtggaggtttgttacatgggtatattgcatgaagccaaggtttgagatacaaatcttcccatcaccccggcagtgagcatagtaccctacagttagtttaccaaccctactcttgtcccccttccttcctttcccctctagtagcccccagtgtctatggttgccatccttatgtccatgaatacccaatgtttagctctcacttacaaataagaacatgcagtatctggttttcagttcctgcattaatttgcttagggtaatgacttccatccagctgcatccatgttgctttaaaggacatgatttttggctgggcgccgtggctcacgcctgtaatctcagcactttgggaggccgagatgggcggatcacctgaggttgggggtttgagaccagcctaaccaacatggagaaacccagtctctactaaaaataaaaaattagccaggtgtggtggtgcatgcctgcaatcccagctactagggaggctgaggcaggagaatcacttgaacccaagaggcggaggttgtggtgagctgagatagtaccattgcactccagcctgggcaacaagagcgaaactgtgccaaaaaaaaaaaaaaaaagacatgactttcttttttatggctgcatagcattccatggtgtatatgaaccacattttctttatccaatccactgttgatgggcacctggttaattccacgtcttttctattgtgtatagtgttgcaatgaacatatatgtgtatgtgtctttttggtagaactatttctttttgtgtgtgtgtgtggggtggggggttgagggggtgcggatatatgcccagtaatgggattgctaggctgaatagtagttctaagttatttgagaaatctccaatctgctttcctcaggggcagaactaatttacattcccatcaacaatatataagtgttccctttcctctgcagcttcaccagcatctgttgtttgttgactttttaataacagctattctgactggtttaagatggtatctcagtgtggttttgatttggatttctttaatgattaatgatgctgagcactttttgatatgtttgttggctgcttgtgtcttcttttgagaagtgtctgttcatgtcttttgcctactcttaatggagttatttgttttgtgcttgttgaattgtttaacttccttgtagattctggatattataacttagttggatgcgtaggttacaaatattttctcccattctgtagtttgtctgtccaccctattgattgtttctcttgctgtgcagaagctttttaattaggtcccactcatcaatttttgtttttgttgcaattgtttttgaggatttaagtcataaattctttttcaaggccagtgttcacaatggtgtttcctaggttttcttctaggattcttatagtttgaggtgttacattgaaatatttaacccatcttgcattcatttttgtgtatagtgaaagattataactctgattttctatgtgggtctcaaacttccttataccacagtgaactacagataaaatagagtgagggttcagacctaaacattttcttgaggataatacaggagaaaagagcagggattgggagcttgaagaatccattgagtcaaatggaatgccaatgttctcagtttccaagataatataacactttatattatctattcattcactcaactatacatcaaataatttccagtttctacagctagacattatgctattcactgaggataaactaatgaacaaaataaacatacttcaaatgcagaaataaacattaaactttaattatataaattgttcatacttttttaaaggctgtacaaccttttttttctcaccaacttgtactgtacagcttgacctcccaagagggtgagtaggtgctaacaatcagccctagcttcacttacctggtacaggactacaacctcttaaagagaacagatcctttttatttggacgaagaattgaaaacttaccaagctttcaactgtggggctgtgtctttctaaatgttgtttgtttttctaatgtcctattgaatgtatgccttttttctaattctttacttggattaatatctttttctatactagcattaggtcctgacactgctgctacctgtgtagacattcaccttcataattctcagtgcacaatctacaacacatttattatgctatcaagttcaaatgaaggctaggatgatagaaatatatatctttatcaaaatatcatagaggttagtcacaaaatactaacaaaggagtatcaaactctgttgttctcaggattgggtcagagcttggtcttacagcctagtttgaatgctccttctgggcattcctatgtgcctaaagtcctattttagtctccaaaaacctttcttctccctccaaacagtcctttgttggagcagtatttatctttattttagataaggatacaaaatgcagatctttccaaatagttattatgaaattcagctttattaaagataaaaattattggttcacttaggctaaggtactccatgccaatagttttatattcccttcctttaggacttgctaccagaacccctgagtcagcactaggcttttataggaatgaaatatcagctatgagacagaggaatcaagtatatcacttgccaggtgaagatgaaaatctctttatgaacaaacaaaagttattcatatcttcacaattttctaggcttcacaacttgtctcaaaactttattctcatttgttgtggtggaaacacaagtccttcatggtgtatgaaaacaaatttttctgaagcaaatataacgccagagacacttcatgagatatgaattaggaatccctaaggcttttgtgaaatgtttggaaattttccacaaaattttggtagtgttgtttttgtactctaaacctgattagttttctcaggtctctaagaaagtaagggggtcgcgggtacggtcaatagagaattcagtgaaatcttaagatccaaacaatagtaagattttttttatattctctgtaattcttcataataccatgaaatattttctatcatcagaaacaactatgattgcctcaaagaggcaatgttatctctcaaaaacagtaaatggaaaggaaggtcctataatctaaattttatgcagtctttgacatttgcttttttttaccccatgctagctcatagtgttaaaaagaaaaaaaacactcaaacacaggttgcacagcctcctgaaattaggcattatcgcaaaatgactgtggccagttttacaactccacaaagtgtgaactattaatgttctagtccccaaataaagtcagtagccaaggaagatagagataatagttatccacagtttttcaaacagtattttatttttctcttatgtaatacaacaccccagcatatgcctttttctggtgagaaaactaaagttcagactatttaagtgagtagaggtggaattccaagttagttatatttgttttttccctagtgttcgttaattaaatgagaaaaattaatttgggaattacaaaaaataatcacaattaaaattatgggacattcaaacagtgagaaaatgaaaagtagctgagctgtgaaatgttttaacaaagaaatttaatagaacttaagaaatatacattccatgaaacatcagaaaaaatatagtttaccattaaagtttctggaaaaactgattttcaaaataatttttagttcttacagttcataaatcaacaacattatcaccttttgagtatattaagccttttttactaaaaattataatcaacatttgtatagtactttaaagcaaacaaggtatttttcatatgtattatctttaatccttacatctatgtaatactattattgttcttattttgtatgaatggagaaattatggctaagaaaagattctatagctttcccaaggtcactgtgctagtaatggcttagtctgaacccaagtcttcaggtcttcagacttcaaggtcctctgattatttggcccaaattatttggcctcctattatgtctactaaaaaaaaaaaaagtgggttgaaaaactcagttatcactgtaagtttataactcaaaatagacattaatcttaacagaaatgaagttttataatcatcgaacaactatatgacattaatagtcatggactcattaacattgtccaaatagaaatatattatatattttaagatgaaggtagtgtcacaacattaaacattgtcatgctggagcaaattctaataaaaaatacctctttacccagttgtatcttaaccacatcttgggaaaaaaggggaaaattgcaacaaaattagagatatgtaggctttttatggctttaccatggcgtggtgaccccagaatgcttgcttttttgtttttaactttgtctctatacataccaggtgtttttgtcttatcttagtttctggcttagggaaaggtagagacaaatgaaatttgttactgtattccaaccagtcagctaattaatcagtaaatagataaattcataagtacataaactaaaaacattttaatctaaacaacttttattttaatttaatgttgtatttatttatttcagagaatatatccagaccatacaggtggtatcttctgtatcaaggagattatgttgcttagtggaaatggcatagctttggagtcaattttagagaaaaatttgaccttaccctctcactttctacagttataactttagcaggtttcttacacttaattgtgtgccagtgttcagaacatagatgctcaataatatatggtagtgattattataaaagcagtggtgaatatccatggcctgaagagactcagcttggtccctttgaccattctggacttccaaatattcgttgtagcttagccataacaaagtagaaattcttcactggaaatcaaaaagtaaattctgtcatttcaaagtaagaagcaattaatcagaagctttgaattagaaacttctgacctatctctttgtgatatctcccattaaagtagtagccatatgcagactttgattcaggatttaacctgttcctaaaattttaattcagatgtagaaccaatgatctgactgagacttatttgtagccaatacaacatccttatgatgaaccaggctgcactatccattgactttgaattgaattaggagtcagcagaaagacatacgaatatacagatgattgaagaaagatgatacagtcaaaacacacgaagtcccctagacaaaaccataatgtaatgcctgcaattctatttttatttagggttaagcataaaacctcattctcacataagctatggtaagccaccaaactgttgattactctgctgcaatgctataattgaacataaatttggaaagaatgagtctaggagtagagataaatactttcacaaaggtttataatctgctgctgttgtgaggctaggccatcatctgatctttaggccagaatttacagatgactattattgtgtattttgccatcagtgaatactttcactcattttcataatttttagtctctcatgctataccacttaacaattactagttaattcagaagttgatagatgtaactaggtaagtgattaacccaatctgtggggatgctttcctatgtattttgtttctttttttagtcatatttattaaagtacaatttatgtaaaataacattcacattttagtgtataattctacagattttctttcttttgtttttgatttggtttctattttcaaaaagtatgctacagcatgttaaagtaacaaaaatttcctgacaatttgcccagaatctaacaagtccgtgggcataagaaatcaaattgttataattctaacacttgctgtggtaatattccctcactccaactggattacatatggtactttttgccgtgttacttttgtgagctaagacaggcagtttttcagggtgtgaaggattaaagagaccattcaatgtgaggatgcacaatgtgacttaaggagatttttagagaaaataaataagcccgttataattcaagtttgttaggacatactattgtgcaaaggaaataacagtattatatacaattgaaggctttatcaagtgtgctgtttaatgccaggcactagattttcagtagaacatgttgcccagataaattatttctgacatggaatactatagaatgacaatcttttcttgccaattaagtttaataatgaaaataatagctaacattgaatgcttgccatataccatacactatgctaagggctttacacacattccttccattaatcctgacaagattcttgtgaagtacagacaattgttatccttattttacagaggaagggaagcatcaatctttctgaaattaagtaactattagcccagggcagatggttgagtcatgatttgaatccagctcatttgtgttcttaaaaactaggcttcacggctgggcctggtggctcacgcttgtaaactcagcactttgggaggccgaggcaggtagatttcctgaggtcaggagttcgagaccagcctgaccaacacagtgaaagcccgtctctactaaaaatataaaaacttagccgggcatggtggcatgcgcctgtaatcccagctactcaggaggctgaggcagaagaatcgcttgaacccaggaggcagaggttgcagtgagctgagatcgcaccactgcactccagcatgggtgctagagcaagactctgtctcaaaaaaaaaataaaaaataaactaggcttcgcttcataaatgctaggaaacctaccatggagaaaagcaagagtgtctgtgtggagctgtacaaagggaaaaaaatgcatctaacctctcctaataggggcactactgttccttgtaactaccaccttctattcctcattagaaaatggaatataaaaatatgatgaaaaattttaattacttaaaaaaagaactaatcataatcaccttaaaaagcccagaaaagttatatatatacacacatatatataatgcatatgtgtgtatgtatatatattatatatataatgtacatttgtatctgtatgcacatctatgtctaattcaacaactaagaacaatatggcttctcttgtatggaaaatctgagctgcacttcaggaagtacttcttatgtaccttcttatcctgggtaaaagtcccgtaggttggttaatactcatgaagacttaaaagattgctttttgaaatgccatctgtcaacctcttgatgtcagtataacctgcaattcttcttaaaatacaattcctgctgacctaaggatacctggaggtgtccactaagtctctccaggtgctttaagatctggcatgtgggagcaagaactagttaattactcattattggtccagaggttagaactgagacaaatcaataaatggtaaagaaaagtagtttgagcttgaataggaggaaattctgtggcaattatagcaatcccaaattagaatttttttatacttttggaggttctatcatggaaatactcaaacagttagaatgtcaagaatgtagtaggggtgggacgggtggcccatgcctgtaatcccagtgctttgggaggctgaggcgggaggattgcttgaggtcaggagttcaagaccagcctgaccaacatggtgaaacctcatctctactaaaaacacaaaaattagccaggcatggtggcaggcgcctataatccacctacacgggaggctgaggcaggagaattgcttgaacccaggaggaggaggatgcagtgagccgatattgcaccactgcactccagcctgggtgacacagcaagaccctgttcccccacattcctcttgccgaattaaagaagaaactacttgtcacaccacatatgaaaaaaatctacataaagatacacttatttaatgtaagacaattgcttttcacatatttctgtttgcatattaaatatttactactgaatagcaaaacactaatattggaacaatatttctgcttccatacatgctcactaaatggaatgttcatcagggttttaataattatacaatatttctgcttcatgggcagactgggaggggcatggcctgaaagccacagtttctatctcaacagggaaggcttatggcatagggcataagccttctgagtgcagactgctcagaacctagctagctgctgctagtggaacactgtaggtgtgaaacctgccttgccaagtatgtgggagctggatggggcttactgctgcctgctactccccactgccctagcagattcttctgggaagcagaggcagctacacttctccttggaacattaccccagcagcagagaactgccttctgatttccccggggctgcttcttgcacccacatgtggagagctagagtgcagacttaacctgacccagccaccacctggctttgctcctctacccaccctaatggcttaacacaaaggacagaaacttttgggagttctatgaccccactcattgcttgagacagtagggtacctttcctgggtaacacttgagacatcagagtacctcccctgggtaactaacattagacaagcacaaataccaccattaccaccacagctgttgctctttgcaaatgctaccccctggctggagaccaactaacacagcccacaacagcatctgcaggcagaataacacagcacccaagaaggagaaaacttgtgcatgacctcagctaccaacattgcctgcatcaccctggccaacggagagatcctgagtctgttcacatgacccgttcattactactacagctggcatttgagaaagccaacacagtaagcctatttataaccaaggaatctcacagaatctatatcactcgcctgtcaccaccatcagagctggtgctaatacctgctgctgggagacttgaggacaggtcatgtgcctggatcccttgcagacagtccccactaccatcctgaagcgtggcagccccacagggcagctagacccagaagagcagcattcacagtagtctggccttcagggactcctgcggctaggggaagagggagtgcacaacattaaggaggcatcctgtgggacagaagaatccagatggcaggtcttgagtaccaaactttccacatgtgggaagtttctttcagcagaggcactggtgcagtgctgagctcagcaagaaaagtctgcagctctcccccaacagtcaggcagcccgggtgctcatgaaagatctttgagatggaaacttctcccccttgctcgccactgcagacacagttgaggcttctcccatgggagcttagcatgagtgtacctgtagacaccctttctggaacatttcagggtgactgcttttccacagaaggagcatcctccaagttcaggcttgcatgaaaggtagaatcatagttcctctctacttggaatatcaaaattcctgcagatgaaaagaggtgcctgtctaatctgaataggtgaaacactgggtgaagagtgtgtctgggagttgagtagctttccttctggtctggcagaggagctgaggtagctctctcccttcctcctgaaaagaccacagtgcatttcactgagaattctcccagctacctttgtcaaggccgtgatctctccccaacattgggtattgcatctacccacatactttagctacatctggtttttacccccagacacctcccctactggactgaagcctgaacatttcaacccagtaaataaaatgttggggaaaaaaataactaaataaaaaagtgcacaccaatggggaacaagataagcttccagaaacttctgccattctagccctgcaggagacagtgaacctgctcacacaccaagcacattgccaccacaaccagcatctgagaaagccatcatacaaagactttctataaccaagaaactcatacagagtcttcacctctgaaagcgcccagagccaaattaggttacaaaaactgtaatcattaaagtcacaactttaagagacaaaaaaaaaaagaaatttttaaaaatcacagatgaattaaaaataaatccaaaaataattaaaagaaatagtttacccaaatgagaaggaaccagaaaaataattttggcaatatgacaaaacaagatactgtagtacccccaaaagatcatactaggtcttccacaatggatccaaaccaagatgaaatctttaaaacaccagataaagaattcaaagggttgattattaagttacttcaggagatacaagagaaaggagaaaactaacatgaaaaaaaatttaaaaataacaattcaggatatgaataaaaacttttctatagagatagatattttcaaaaaaaaaaaaaaaaaccagaacttctggaaatgaaagacacatttaaggaattatgaaatgcagcagaaacttttaacagtagactagaccaagtagaagaaagaatttcagagcttcaagacaaaattttgaattaattcaatcaaacaaaaataaaacaaaaataagtttaaaaaaatgaacaaagtctccaagaaatatgggattacataatcccatgaccaaacttaaaaatcactggtgtttctgaagaagaagaaaaaccaaaaagtctagaaaacctatctaagggaataattaaggaaaacttcactggccttgctagagatttaaacattcaagtacaagaagttcaaagaactcctgggagatccattgcaaaaaggacatcaccaaggcatttgtcatcaagctatttaaagtcaaagtgaagtaaagaatgataagaacgtgaaaaaaaaaagcatcaggtaacctatacaggaaaaccagaagggattcaggctttatctttagcctccttaaacagaataactatcatcagccaagaatcttgtaatccagcaaaactaagttgcttacatgaaggagaaataaagtctttttcagacaagcaaaggctgtgggaacttgccactaccacaccagccctataaaaaaaatgctaaaagggggcaaaatcttgaaaccaaaggtcaatatgcaccagaatggaaactcttgaaaggcttaaactcacaggtcctataaaataatagcacatggagaaaataaagcatctaggtagcaatcaacatgatgattggaacagtacctcacatctcaacagtaatgttaaatgtaagtggtctaaatgctctacttaaaatatacagaatgaaattaaggcagaaatcaagaagttctttgaaacaaatgaaaacaaagatacaacataccagaatctctgggacacggctaagtcagtgttaagagggaaatttatagcactaaatacccacatcaaaaagttggaaagatctctaattaacaacctaatgtcacaactaaaaaaacttagaggaccaagagcaaaccaaccccaaagcagaagacaagaaataaccaaaatcagagctgaactgaaggagattgggacacacacacaaaaaaaaaacattcaaaagatcaatgaaattaggagctggatttttgaaaaaaaaataagataagctgctaactagggtaataaagagtaaaagagaagattcaaataaatgcaattacaaacaacaaagggaggttaccactgaccccaaagaaatacaagtaaccagcagggactactataaacacctctatgcacagaaattacaaaacctagaagagatggataaatttctggacacagacaccctcccaagactgaaccaggaggaaattgattcactcaacagaccaataacaagctccaaaattgagtttgttaataatagcctactgatatggtttggctgtgtccccacccagatctcatcttgaattgtatctcccataattcccattgttgtgggagggacctggtgggagataattgaatcatggcagcagtatcccccatactgctctcgtggggagcagtctcatgagatctgatggttttataaggagaaaccccttttgcttggttctcattatttctttgcctgccaccatccatgtaagacgtgacttgctcctttttgccttccaccatgattgtgaagcttccccggccatgtggaactgtaagtccaattatctctgtcttttgtaaattgtccagtcttgggtatgtctttatcagcaatgtgaaaactgactaatacacctaccaaccagaaaagtccaggtccagaaggattcatggctgaattctaccagatatgcaaagaagaaatgtatcattccagctgaaactatcccaaagaattgaggaggagggatttctctccaactcattttttgaggtcagcatcatcctgatatcaaaacctggcagggacacaacaacaaaaaaagaaaactttgggacaatagccttgatggtcattgatgcaaaaatctcaaaaaaatacttgcaaatcaaatccagcaacacaacaaaaaaaaaagaaaactttgggacaatagccttgatggtcattgatgcaaaaatctcaaaaaaatacgtgcaaatcaaatccagcaacacatcaaaaagctattccaccacaatcaagtaggctttatccctgggatgcaaggtaggtccgacatatgcaaatcaataaatgtgattcatcataaacagaactaaagatagaaaccacatgatcatctcagttcaacatcctttcatgttaaaagctctcaacatactaggtaatgaaggaatatagctcaaaataataaaagtcatctatgacaaacccacagccaacatcatactgaatgggcaaaagctggaagcattccccttgaaaactggcacaagtatgctcacccaccactcctatttaacagagtattggaagccctggcaaagagcaatcaggcaaaagaaagaaatgaagagcattcaaacaagaagagagaaagtcaaacaattcctgtttgcagatgacatgattttatatctagaaaaccctatagttatagacaaaaagctcctgcagctgataaacaccttcagcaatgttttaggatacaagaatcaatgtacaaaaattactagcatttctatacaccaacaatagccaaaccaacagccaaatcaaaaacacaatcccattcacaattgccacaaaaagaataaaatacctagtaatacagcttaaaaggaaggtgaaagatctctacaatgaaattacaaaacactgcttaaagaaaacagagatgacacaaacaaatggaaaaatatccacgttcatggataggaagaatcaatatcattaaaattgccatattgcctgaagcaatttagagattcattactgtcaaactaccaatgacatgtttcacagaactagaaaaaaactatttaaaattgatatggaaccaaaaaagagcccaaataaccaaggcaattttaatcaaaaaagaacaaaactggaagcatcatgttacccaacttcaaactatactacagggctacagtaaccaaaatagcatgggactggtacaaaaacagacacatagaccaattgaacagaatagagagcccagaaataaggccacacacctacaaccatctgatctttggactccttattcaataaatggtgctggcataactggctagctaaatgcagaagattgaagctggatcccttctttacaccacatacgaaaatctactcaagatggaggaaagacttaaatgtaaaacccaaaactataaaaaccctggaagtcaagctgggcagtatcattctggacatagaaaccggcaaagatttcatgatggagacaccaaaagcaatcacaacaaaggcaaaaagtgataaatgggatataattaaacttaagagcttctgcacagcaaaagaaacaattaacagtgtaaacagacagcctacagaatgggagaaaatattttcaaactatgcatctgacaaaggactaatatccagcatctaagaagaacttaagcaaattacaaaagcaaacaaccccattaaaatgtggttaaaggatatgaatagacacttttcaaaagaagacatatatgtggccaaagagcatatgaaaaaaagttcaatatcagtggttattagagaaatgcaaatcaaaaccacaatgagaggctgggcctggtggctcatgcctgtagtctcaacagtttgggaggctgaggtgggcagatcacttgagcccaatagtttgagaccagcctaggaaacatgacaaaacctcttctctacaaaaactacaaaatttagctgggagcagtggtgcatgcctgtagtcctagctactcaggaggctgagatggaaggatcacttgagcccagtaggcagagattgcaataaaccaagattgtgccactgcaccccagcctgggcgtcagcaagaccctgtctcaaaaaaaccagccaaccaaccaaccaaacaaacaaacaaacaaaaaaatccacaaggagatattatctcataccagtcagaatggctattaataaaaagtaaaaaaaaaaataacagatgctgcaaggttgcagagaaaagggaatgcttatacactgttggtgggagtgtaaattaaactattgtggaaagcagtgtggcatctccttaaagagctgaaaacacatctaacatctgactcagcaatcccattactaggtatatatccaaaggaatagaaatcattctaccataaaaacacatgcacgtgtgtattcattgcagcacttacaatagcaaagacatggaatcaacctaaatgcccatcaatggcagattgaataaagaaaatatggtacatatacaccatggaataccacacagccataaaaaagaatgagatcatgtcctttgcaggaacatggatggagctggaggccatcatccttagcaaacgaatgcaggaacagaaaaccaaatactgcatgttctcatttacaagtgggagctaaatgatgagaacacgtggacacagaggaaaacagacactggggtctacttgagggtggtgggtgggaggagggagaggatcagaagaaataactatttagtaccaggcttagtacctgggtgatgaagtaatctgtacaacaaacccccatgacatgagtttacttatataacaaatcagcacatatacacctgagcttaaaataaaagttaaacaaaaaaattaaaaatcacaaaccaaatatcagctctcttcaagagactcatctaatgcaaggattcttacaaactcgaggtaaaggggtggaaaaagatattccatgccaatataagaaaaagcagcaggagtagttattctcatgttagatagaacagacactttaaagcaacaacagtaaaaaaaaaaaaaaaaaaaagtcattatataaagataaaagaatcaatccccagcaagaagatattacaatccttaatatacattacttactccttactatggagcttccagattcataaaaaattactaccagacctaagaaaagagaaagacatcatcacaataattgtgggggactcaacactccgctgacagcactagacagataatcaaggcagaaagtgagcaagaaaatgttgtacttaaactgcattctagaacaaatataactaacagaatttacaggacattttactcaagagcttcagaatatacattattttcctcagcacatggaacattctccaaaacagaccatatgatagtccacaaaacaagtctcaataaatttttaaaaattgaaattatatcaagtaccttcttagaccacagtggaataaaaccaataattaacaccaaaaggaacactcaaaactatacaaatgcttaaaaattaatctgctcctggatgatttgggggtaaaaaatgaaatcaagatgaaaatttaaaaattctttaaagtgaatgataatagttacacaagttatcaaaacctctgggatacaggaaaagcggtgctaagatgaaagtttatagcactaaatgcctacatcaaaaagtctgaaatgaaacaaattggcaacctaacatcacacctcaaggaaccagagaagcaagaacaaaccaaacccaaagctaccagaataaaagaaattataaagatcagagcagaactaaatgaaattagaacaaagaaaaataatacaatagatcaacaaaacaaaaagttggttctttgaaaaaataaaattggtagactattagctagattaaccaagaaaagaagaatcaaacaagctcaattagaaatgaaaatggatggccaggtgcggtggttcacgcctgtaatcccagcactttgggagtctgaggcgggtggatcacttgaggtcaagagtttgagaccagcctagccaacatgatgaaaccctgtctctactaaaaatacaaaaattagctgggggtggtggtgccgcctgtaatcccagctacttgggagactgaagcaggagaatcatctgaacctgggaggcagaggttgcatttctgtcaaaaaaaaaaaaaaaaagagagaaagagagaaagaaagaaagaaagagaaagagagaaagaaaaagagaaagaaaaaaagaaagaggaaggaaagaaggaaggaaggaaggaaaatggaggcattacagctgataccacaggaatacaaaagattatttaagactactatgaacacctctgtgcacataaactagaaaatctatagggaattaataaattcctggaaacataccacctccccagcttgaatcagaatgaaacagaaattctgaacagaccaacaacaagcagtgagattgaatcagtaatttaacaaagttgtcctcctaaaaaaagccaagggccatacaaattcacagccaaattctaccagacattcaaagaattggcgccaattttgctgaaactattctaaaagactgagaaagaaggaatccttcctaactcattctatgaagccagtatcaccttgataccaaagccaggaaagggcatacaaaacaaaacaaacaaaaaacaaaaaaacacaaaatgacagaccaatattcctgattaacatagatgcagaaatcttcaacaaaatactagcaaactaaacccaacagcacatcaaaaaggtaattaactatgattaagtgggtattatcccagggatgcagggatggttcaacatatgcaagtcaataaatgtgattcaccatgtaaacagaattaaaaacaaaaaccatatgattatctcaatagatgcaaaaagcattggataaaatacagcatccttttataaaaccctcaacaaattagatatagaaggaacatatctcaaaataataaaagctacatatggaaaaccacagccaacatcatacagaataggaagaagtcaaaagcattccccctaagaactggaataagacaaggatgcccacttttaccacttctattcaatatagtactggaagtcatagccaggccaatcagtcaagagaaagaaaggaattccaaatcagaaaagaggaagtcaaactatttatatttgccgacgatatgattgtgtaactagaaaaacctaaagatccctccaaaagactcctagatttgagaaatgaattcagtaaagtctcaggttacaaaatccatgtacacaaatcagtagctctgctgcatgccaacaacgaccaagctgagaatcaaataaaaaactcagtcccttatataatagctgaaaaaaaaaaaaactaggaatacatttaaccggggaggtgaaagagctctacaaggaggactacaaaacaccactgaaaggaatcacagatgatacaaacaaatggaaatacgtgtcatgctcatggattggaagaatcagtatcacacaaatgatcatattgctcaaaggaagcttcatattcactgaaattcctatcaaaataccaaattatttttcacaaaattagaaaaaaaatccaaaaattcatatggaaccaaaaaagagcccaaatagccaaagcaattctaagcaaaatgaataaagctggaggcatcgcattacctgacttcaaattgtactacaatgctgtagtaaccagaacaagatgttactggtataaaagtagatacgtagaccaatagaacacaacagaggatccagaaatacagccaaatacttacaaccaaatgatctttgacaaagtatagaaaggcatggaatattatttttttcaaggtagtaatgtcttttttttactttttttaaattatactttaagttctagggtacatgtgcacaacatgcaggtttgttccataggtatacatgtgcccaagttggtttgctgcacccatcaactcgtcatttacattaggtgtttctcctaatgctatccttcccccagcctcccaccccccgacaggccccggtgtgtgatattccccgccccatgtccatatgttctcattgttcaactcccacccctgagtgagaacatgtggtgtttggtgttctgcccttgtgatagtttgcttagaatgatggttttcaacttcatccatgttcctgcaaaggacatgaactcatcctttttatggctgcagagtattccatggtgtatatgaaggcacagaatattataacactgggtttgcggtgtgtaaattgctcatacattaagtagaaagacccaggtgaaccaataaaaaataacaacaacttttcaagtcatagtataataacatataaatagaaacaacaaaaagttaaaaagcagggagacaaagttaaagtgtagagtttttattagttttctctttgctagcttgtttatgcaatcagtgttaagttgtcaacagtttaaaatcatggattataagatattatttgcaagtctcatggtaacctcaaataaaaaatagaaaaaaaatgggattacatcaagctaaaaagattctgcagaagaaaggaaataatcaactaagtgcagagataacccacagaatgggagaaaatatttgcaaactacccctctgacaaggaattaataaccagaatatataaggagctcaaacaactctgtaggaaaaaagctaatagtctgattttaaaatgggcaaaaaatctgagtagacatttctcaacataagacatattttgactggaaaacaggtttatgtgctcaacaagcacataaaggtgctcgacatccttgatcttcagagaaatgcaaatcgaaactacagtgaggtattatctcacgccagttgaaatggcttatatccaaaagacagggaataacaaatgctgacaaggatgtgtagaaaagcactgttggtgggaatgtaaattagtacagccactatggagaacagtttagaagttcctcaaaatactaaaaatgcagctaccatatgatacagcaatcccactaccaagtgtatagccagaagaaaggaaatttgtatatggaagagatatctgcactcccatatattgcagcactattcacagtagccaagatttggaagcaatttaagtgtctatcagtggatgaatggataaagaaaatatggtagatatacacaatggagtagtattcaaccacaccaaagagagagatcctgttgtttacaacatgaatggaactgggggtaattatgttaagtgaaataagccagacacagaaagacaaacaacatgttctcacttattcgtgggaactaaaatttaaaacagttgaactcgtggacatagagagatactagaggctgagaagggtagtgaagggaaagtgggatagttaatgagtataaaaaatagaaaaaatgaataagactagtatttcctagcacaacatgactacagtcaacaataatttattgtatattttagaataacttaaataatataattggactttttgtaacacaaaggaagggtaattgcttgatgtgatagatatcacatttaccctgattattatacattgtatgcctgtatcaatatatgtcatgtaccccataaatatatacacatactatttacccacaacaattaaaaattaaagaaagaaaaatattcacagacaagtgaacctgcacagttcaaacccttgctgttcaaggatcaactgcataaacatttctcattcctaataaacaggagttttaatttaaaaacctaaaagtaaattaatagaattcaagccttgaatgtatgtaattgaggggctggcacataacattaggaattatactagaatactatttttttattattattatactttaagttttagggtacatgtgcacaatgtgcaggttagttacatatgtatacatgtgccatgctggtgcgctgcacccattaactcgtcatttagcattaggtatatctcccacagctatccttcccccctccccccaccccacaacggtccccagagtgtgatgttccccttcctgtgtccatgtgttctcattgttcaattccacctatgagtgagaatatgcagtgtttggttttttgttcttgtgatagtttactgagaatgatgctttccaatttcatccatgtccctacaaaggacatgaactcatcattttttatgactgcatagtataccatgttgtatatgtgccacattttcttaatccagtctatcattgttggacatttgggttggttccaagtctttgctattgtgaatagtgccacaataaacatacatgtgcatgtgtctttatagcagcatgatttatagtcctttgggtacatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgctgtttcctgactttttaatgattgtcattctaactgttgtgaaatggtatctcattgtggttttgatttccatttctctgatagccagtgatggtgagcattttttcctgtgttttttggctgcataaatgtcttcttttgagaagtgtctgttcatgtccttcacccactttttgatggggttgtttttttcttgtaaatttgtttgagttcattgtagattctggatattagccctttgtcagatgggtaggttgcgaaaattttctcccattttgtaggttggctgttcactctgatggtagtttcttttgctgtgcagaagctctttacagggatgccctctctcaccactcctattcaacatagtgttggaagttatggccagggcaattaggcaggagaaggaaataaaggttattcatttcggaaaagaggaagtcaaattatccctgtttgcagatgacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagacagccaaatcatgagtgaacacccattcacaattgcttcaaagagaataaaatacctaggaatccaacttacaagggacgtgaaggacctcttcaaggagaactacaaatcactgctcaaggaaataaaagaggacataaacaaatggaagaacattccatgctcatgggtaggaagaatcaatatcgtgaaaatggccgtactgcccaaggtaatttatagattcaatgccatccccatcaggctaccaatgactttcttcacaaaattggaaaaaactactttaaagttcatatggaaccaaaaaagagcctgcatcaccaagtcaatcctaagccaaaagaacaaagctggaggcatcaagctaccggacttctaactatactacaaagctacagtaaccaaaacagcatggtactggtaccaaaacagagatatagatcaatggaacacaacagagccctcagaaataacgccacatatctacaactatctgatctttgacaaacctgagaaaaacaagcaatggggaaaggattccgtatttaataaatggtgctgggaaaactggctagccatatgtagaaagctgaaactggatcccttccttacaccttatacaaaaattaattcaagatggattaaagacttaaacattagacctaaaaccatgaaaaccctaaaagaaaacctaggcattaccattcaggacataggcatgggcaaggacttcgtgtgtaaaacaccaaaagcaatggcaacaaaagccaaaattgacaaatgggatctaattaaattagaatactattaagtgcaacattggtccccctaagcccttacaaaaaaaatctgctacaggattatcttcagccaacaaaaagatacatggagaggccatggttaaaggacaggtgctatttaattcatttaattgtaaaactaaagttaagcaatggtgataaatatgattgtaaaatagaatgtgaagttaaaatccacgacaatacaaatacaatagtgtaattttaaaaattgaaatataggaggcaaagaggaggttaaagtacccaataaaagagttaataattctataactatatttggtggttaattggtggtgaatttagagcaaagagaagtagaaggaagaggaattatactaatttcacctttcataaagggaaatcaattgatactatacatagaggataacttaaaaagtaatgaattaagaatacatcttcaaggtgaccattagaaaaatattaaaataccccaaaactttaaaattacaaagaagagtatgtatataagattataagatctttaattatatatataagattatatatatatacacatttttgtatatataaaaaaagtaagtacagaaagcatattttttaattaaactttaagttctagggtacatgtgcacaacatgcaggtttgatacataggtatacatgtgccatgttggtttgctgcacccatcgactcattatttacattaggtatttctcctaatgctatccctcccgcagccccccactccctgacaggaccccgtgtgtgatgttcctcaccctgtatccaagtgatctcattgttcagttcccacctatgagtgagaacatgcagtgtttggttttttgtccttgtgatagtttgctgagaatgatggtttccagcttcatccatgtccctgcaaaggacatgaactcatcctttttatgactgcatagtattccatgctgtatatgtgccacattttcttaattcagcctatcatcgatggacatttggattgtttccaagtatttgctattgtgaatagtgccacaataaacatacgtgtgcatatgtcttcatagtagcatgatttataatcctttgggtatatacccagtaatgggattgctgggtcaaatggtatttctagttctagattcttgagggatcaccacactgtcttccacaatggttgaactaatttacactcccacaaacagtgtaaaagcgtgcctatttctccacatcctctccagcatctgttgtttcctgactttttaatgactgccattctaactggcatgagatggtatctcattgtggtattgatttgcatttctctcatgacaagtgataataagcattttctcatgtgtctgttggctgcatagaagtcttctttttttatatagtaatttttaaattcagacaatatatctaaaggaaatgtcacctgcctccttccctaatcccaaactgctcatcttcagtaccactgttaatgatttagtctttgttcttctagttttgtttctttttttctttttattttattattattatactttaagttttagggtacgtgtgcacaacgtgcgggtttgttgcatatgtgtacatgtgaaacgttggtgtgctgcacccactaactcatcatttagcattaggtatatctcctaatgctatccctctcccctcccccgaccccacaacaggccccagggtgtgatgtttcccttcctgtgtccatgtgttctcattgttcaattcccacctatgagtgagaacatgagtgtttgatttttgtccttgcaatagtttgctgagaatgatggtttccagcttcatccatgtccctacaaaggacatgaactcatcatttttatggttgcatagtattccatggtgtatatgtgccacattttcttaatccactctatcactgatgggcattggggttggttccaagtctttgctattatgaatagtgccgcaataaacatacatgtgcatgtgtctttatagcagcattatttataatcctttgggtatatacccagtaatgggatggctgggtcaaatggtatttctagtactagatccctgaggaatcgccacactgtcttccacaatggttgaactagtttacagtcccaccaacagtgtaaaagtgttcctacttctccacatcctctccagcatctgttgtttcctgactttttaatgattgccattctaactggtgtgagatggtatctcattgtggttttgatttgcattgctctgatggccagtggtgatgagcatttttgtatgtgtcttttgtctgcataaatgtcttcttttgagaagtgtctgttcatatcctttgcccactttttgatggagttgtttgttgttttcttgtaaatttgtttgagttcattgtagattctggatattagccctttgtcagatgagtaggttgcaaaaattttctcccattctgtacattgcctgttcactctgatggcggtttcttttgctgtgcagaaggtctttagtttaattagatcccatttgtcaattttggcttctgttgccattgcttttggtgttttagacatgaagtccttgcccatgcctatgtcctgaatggtattgcctaggttttcttttagggtttttatggttttaggtctaacatttaagtctttaatccatcttgaattaatgtttgtataaggtgtaaggaagggatctagtttcagctttctacatatggctagccagttttcccagcaccatttattaaatagggaatcgtttccccatttcttgtttttgtcaggtttgtcaaagatcagatagttgtagatatgtggcattatttctgagggctctattctgttccattgatctatatctctgttttggtaccagtaccatgctgttttggttactgtagccttgtagtgtagtttgaagtcaggtagcttgatgcctccagctttgttctcttggcttaggattgacttggattgacttgtggcctcttttttcattccatatgaactttaaagtagttttttccaattctgtgaagaaagtcatttggtaacttgatggggatggcattgaatctataaattaccttgggcagtatggccattttcacgatattgattcttcctacccatgagcatggaatgttcttccatttctttgtatcctcttttattttcttgagcagtcatttgtagttcttcttgaagagatccttacatcccttgtaagttggattcctaggtattttattctctttgaagcaattgtgaatgggagttcactcatgatttggctctctttttgtctgttattggtgtataagaatgcttgtgatttttgcacattgattttgtatcctgagactttgctgaagttgcttatcagcttaaggagattttgggttgagacgatggggttttctagatatacagtcatgtcatctgcaaacagggacaatttgacttcctcttttccgaattgaataccctttatttccttctcctgcctaattgccctggccagaacttccaacactatgttgaataggagtggtgagagagggcatccctgtcttgtaccagttttcacagggaatgcttccagtttttgcccattcagtatgatattggctgtgggtttgtcatagatagctcttattattttgagatatgtcccatcagtacctaattattgagagtttttaacatggtgtgttgttgaattttgtcaaaggccttttctgcatctattgagataatcatgtggtttttgtcgttggttctgtttatatgctgggttatgtttattgacttgcatatgttgaaccagccttgcgtcccagggatgaagtccacttgaccatggtggataagggttttgatgtgctgctggattcggtttgccagtattttattgaggatttttgtgtcgatgttcatcagggatattggtctaaaattctctttttttgttgtgtctctgtcaggctttggtatcaggatgatgctggcctcataaaatgagttagggaggatcccctctttttctatttattggaatagtttcagaaggaatggtaacagctcctccttgtacttctggtagaattcagctgtgaatccatctggtcctagactttttttggttggtaagctattaattattacctcaatttcaaagcctgttattggtctattcagagattcaacttcttcctggtttagtcttgggagggtgtatgtgtcgaggaatttatccatttcttctagattttgtagtttatttgcttagaggtgtttatggtattctctgatggtagtttgtacttctgtgggatcggcggtgatatcccctttatcattatttattgcatctatttgattcttctctcttttcttctttattattcttactagcagtctatcaattttgttgaccttttcaaaaaaccaactcctggattcattgattttttgaagggttttttgtgtgtctatctccttcagttctgctctgatgttagttatttcttccattctgttagcttttgaatgtgtttgctcttgcttctctagttcttttaattgtgatgttagggtgtcagttttagatatttcctgctttctcttgtgggcatttagtgctatacatttccctctacacactgctttaaatgtgtcccggagattctggtacgttgtgtctttgttctcattggtttcaaagaacatctttatttctgccttcattttgttatgtacccagtagtcattcaggagcaggttgttcagtttccatgaagttgagcggttttgagtgagtttcttaatcctgcgttctagtttgattgcactgtggtctgagagacagtttgttacaatttctgttcttttacatttgctgaggagtgctttacttccaactatgtggtcaattttggaataggtgtggtgtggtgctgagaagaatgtatattctgttgatttggggtggagagttctgtagatgtctattaggtctgcttggtgtagagctgagttgaattcctggatatccttgttaactttctgtctcgttgatcttctaatgttgacagtggggtgttaaagtctctcattattattgtgtgggagtctaagtctctttgtaggtctctaaggacttgctttatgaatctgggtacccctgtattgggggcatatatatttaggatagttagctcttcttgttgaattgatccctttaccattatgtaatggtcttctttgtctctttagatctttcttggtttaaagtctgttttatcagagactaggattgcaacccctgccttttttttgttttccatttgcttggtagatcttcctccatccgtttattttgagcctatgtctgtctctgcatgtgagatgggtttcctgaatacagcacactgatgggtcttgactctttatccaatttgccagtctgtgtcttttatttggagcatttagcccatttacatttaaggttaatattgttatgtgtgaatttgatcctgtcattgtgatgttagctggttattttgcttgttagttgatgcagtttctccctagcctcaatggtctttacaatttggcatgtttttgcagtggctggtaccagttattcctttccatgttcagtgcttccttcaggagctcttttagggcaggcctggtggtgacaaaatgtctcagcatttacttgtctgtaaaggatcttatttctccttcacttatgaagcttagtttggctggatatgaagttctgggttgaaaattctttcctttaagaatgttgaatattggcctccactctcttctggcttgtagagtttgtgctgagagatcagctgttagtatgatgggcttccctttgtgggtaacccgacctttgtctctggctgcccttaacattttttccttcatttcaactttggtgaatctgacaattatgtgtcttggagttgctcttctcgaggagtatctttgtggtgttctctgtatttcttgaatttgaatattggcctgtcttgctagattggggaagttctcctggataatattctgcagagtgttttccaacttggttccattctccccgtcactttcaggtacaccaatctgatgtagatttggtattttcacatagtcccatatttcttggaggctttgttcgtttctttttattctttttttcgttaaacttctcttctcacttcatttcattcatttgatcttcaatcactgataccctttcttccagttgatcgaatcagctactgaggcttgtgcattcatcacgttgttctcatgccatggttttcagctccatcaggtcctttaaggacttctctccattggttattctagtagccattcatctaatcttttttcaaggtttttaacttctttgccatgggtttgaacttcctcctttaggtctgagtagtttgatcatctgaagccttcttctctcaactcgtcaaaatcattctctgtccagctttgttccattgctggtgaggagctacgttcctttggaggaggagaggcgctctggtttttagaatttccagtttttctgctctgttttttccccatctttgtggttttatcaacctttggtctttgatgatggtgacgtacagatggagttttggtgtggatgtcctttctgtttgttagttttccttctaacagtcaggaccctcagctgcaggtctgttggagtttgcctgagttccactccagaccctgtttgcctgggtatcagcaacagaggctgcagaacagcggatattggtgaacagcaaatgtggctgcctgattgttcctctggaagttttgtctcagaggagtacccggccgtgtcaggtgtcagtctgcccctaatggggggtgcctcccagttaggctactcaggggttagggacccacttgaggaggcagtctgtgtgttctcaaatctcaagctgcgtgctgggagaacgactactctccagaagtcttcttttgagaagtgtctgttcatatcctttgcccactttttgatggggttgtttgttttgttcttgtaaatttgtttaagttctttgtagattctggatataagccctttgtcagataggtagattgcaaaaattttctcccatttatatggtgcctgttcactctgatggtagtttctcttgctgtgcagaagctctttagtttaattagatcccatttgtctattttggcttttgttgccattgcttttggtgttttagacatgaagtccttgcccatgtcctgaatggtattgcctaggttttcttctagggcttttatggttttaggtctaacatttaagtctttaatctatcttgaatgaatttttgtataaggtgtaagtaagggatccagtttcagctttttacagatggctagccagttttcccagcaccatttattaaatagggaatcctttccccatttcttatttttgtcaggtttgtcaaagatcagatgattgtagatgtgtagtgttatttctgagggctctattctgttccattggtctatatctctgttttggtaccagtaccatgctgttttgtttactgtagccttgtagtatagtttgaagtcaggtagcatgatgcctccagctttgttcttctggcttaggattgacttggcaatgcaggatcttttttcgttccgtatgaactttaaagtatttttttccaattctgtgaagaaagtcattggtagcttgatggggatggcattgaatctataaattaccttgggcagtatggccattttcacgatattgattcttcctatccatgagtatggaatgttcttccatttgattgtgtcttctttatttcattgagcagtggtttgtagttctccttgaagaggtccttcacatcccttgtaagctggattcctaggtattttattctccttgtagcaattgcaaatgggaattcactcatgatttggctctctgtttgtctgttattgctgtataggaatgattgtgagttttgtacattgattttgtatccagagactttgctgaagttgcttatcagataaggagattttgggctgagacaatggggttttctaaatatacaatcatgtcatctgcaaacagggacaatttgactcttcttttcctaattgaataccctttatttctttctcttgcctgattgccctggccagaacttccaacattatgttaaataggagtggtgagagagggtatccttgtcttgtgctggttttcaaagggaatgcttccaatttttgctcattgagtatgatattgggtgtgggtttgtcataagtagctcttattattttgagatgcgttccatcaatatctagtttattgagagttcttagcatgaagggctgttgagttttgtcaaaggccttttctgcatctattgagataatcatgtggtttttgtcattcgttctgtttatgtgatggattatgtttatttatttgcgtatgttgaaccagcattgcatcccagggaggaagccagcctgatcgtgttggataagctttttgatgtggtgctggattcggtttgccagtattttattgaggatttttgcatccatgttcgtcagggatattggtctaaaattctctttttttgttgtgtctctgccaggctttggtatcagcatgatgttggcctcataaaatgagtttgggaggatcccctctttttctattgattggaatagtttcagagggaatggtaacagctcctgtttgtacctctggtagaatttgtctgtgaatccgtctggtcctggactttttttcgttggtaggctattaattatcacatcagtttcagagcctgttattggtctattcagagattcaactttttcctggtttagtctttggagggtgtgtgtgtccaggattttatccatttcttctagattttctagtttatttgcatagaggtgtttatagtattctccaaaggtagtttgtgtttctatgggatcggtggtgatatcccttttatcattttttgttgcatctatttgattcttctctcttttcttctgtattagtcttggtagtggtctatcaattttgttgatcttttcaaaaaaccagctcctggattcattaattttttgaagggttttttgtgtctttatctctttcagatctgctctgatcttagttatttcctgccttctgctagcttttgaatttgtttcctcttgcttctctagctcttttaattgtgatgttagggtgtcaattttagatctttcctgctttctcttgtggacatttagtgctatacatttccctctacacactgctttaaatgtgtcccagagattctggtacattgttctttgttctcattggtttcaaagaacatctttatttctgccttcaattcgttatttacccagtagtcattcagtggcaagttgttcagtttccaaatagttgagcagttttgagtgagtttcttaatcctgagttctaatttgattgcactgtggtctgagagacagtttgttgtgatttctgttcttttactttactgaggagtgctttacttccaattatgtggtcaattttagaataagtgcaatgtggtgctgagaaaaatgtatattctgttgatttggggtggagagttctgtaggtgtctattaggtctgtttgttgcagagctgagttcaagtcctggatatccttgttaaccttctgtctcattgatctgcctaatattgacagtggggtgttaaagtctcccattattattgtgtgggagcctaagtctctttgtatatctctaaggacttgcttcatgaatctgggtgctcttgtagtgggtgcatatatatttaggatagttacatcttcttgttgaattgaaccctttgccattatgtaatggtcttctttgtctcttttgatctttgttggtttaaagtctcttttgtcagaggctagaattgcaaccctgctttttttttttttttttttttgctctccatgtgctttgtagatcttcctctatccctttatttttagcttatgtgtgtctttgcatgtgagatggggctcttgaatacagcacactgatgggtcttgactctttatccaatttgccagtctgtgtcttaattggcacatttagcccatttacatttaaggttaatattgttatgtgtgaatttgatcctgtcattatgatgttagctggttattttgcccgttaactgatgcagtttcttcctagcatctatgatctttacaatttggcatgtttttgcagtggctggtaccaattgtttctttccatgtttagtacttccttcaggagctcttgtaaggcaggcttggtggtgacaaaatctctcagcatttgcttgtctgtaaaggattttatttctccttcagttatgaagcttagtttggctggatatgaaattctgggttgaaaattctttaagaatgttgaatattggctcccactctcttctggcttgtagggtttctgccaagagatccgctgttagtctgatgggctttcttttgtgggtaactcgacctttctctctggctgcccttaacattttttccttcatttcaactttggtgaatctgacaattatgttccttggggttgctcttctcaaggagtatctttgtagtgttctctatatttcctgaatttgaatgttggcctgccttgctaagttggggaagttctcctggataatatcctgcagagtgttttccaacttggttccattctccctatgactttcaggtacaccaatcaaactagatttagtcttttcatatagtcccatatttcttggaggctttgttcatttctttttactcgtttttctctaccttgctttctcactttatttcattaatttgatattccatcactgataccctttcttccacttgatcgaatcagctattgaatcttgtgcatgcatcacgaatttctcgtgccatggttttcagctccatgaggtcatttaaggtcttctctattctgtttattctatttagcatttcttctaaccttttttcaaggtttttagcttccttgtgatgggttctaacctgctcctttagctcggagaagtttgttattattgaccttctgaagcctacttctgtcaactcgttaaagtcattctccatccagctttgttctgttactggcgaggagctgcaatccttgggaggagaagaggcactctgatttttcgaattttcagcttttctgctctggtttctcttcatctatgtggtcttatctacctttggtctttgatgttggtgacctacagatggggttttggtgtagatgttcttattgttgatgttgatgctattcctttctgtttgttagttttccttctaacagtcaggttcctcagctggtggtctgttggagtttgctggaggcccactcgagaccctgtttgcctgggtatcaccagtggaggctgcagaacagcaaatattgctgcctaatccttcctctggaagcttcgccccacaggggcacccacttatctgaggtatctgtcagcctctactgggaggtgtctgccagttaggctgaacaggtgtcagcgacacacttaggaggcagcctgtctgttctcagagttcaaacgccgtgctgggagaaacactgctctcttcagagctatcagacagggacatttaagtctgcagaagttgtctgctgccttttgttcagctaagccctgcccacagaggagaagtctaaaggcagtaggccttgctaagctgtggtgggctccctcattttgagcttcccggccactctgtttacctactgaagcctcagcaatggcggatgcccctccccaagccaggctgccacctcacagctcaatctcagattgctgtgctagcagtgagcaaggctctgtgggcatgggacctgctgaaccaggcacaggagagagtctccttgtctgcccattgctaagactttgggaaaagtacagtatttgggtgggagtatcccatttttccaggtacagtctgtcacagcttccctttgctaggaaagggaaatccccaaccccttgcacttcccgggtgaggcaatgccctgccctgcttcagctcaccctccatgggctgcacccactgtccaaccactcccagtgagatgaaccaagtacctcaataggaaatgcagaaatcacccatcttctgtatcaatcacgctggaagctgcagaccagagctgttcctatttggccatcttggaacctggaccagcatatttttaaatgaaaagaagatataacctactataaaaagtggtataactggccagagcccattcaagggactggtcagtcttcaaattctccagtctgagcctttcaggagtgcctcaatcccagctttctacctttgaaaacagcaagaattttgtctctgcaacagtttttcctagagccaatcacgtgtcatgcctggaacagggatcatacccaaattgcccttggcctgaataatcacaaaatccacatctgtaagaagaatgggagccaatagcaaaacctcataaactccagaagcacaatcacaggtactgactgggctcccaagcatgaccacattatcatttgcatgagtcagaaagatggtgtctggaagctaaccctggtgatcctgagaattgatcatgcaactacttttgtgaagtggtccctcctagagaacaaaattgttgtaggtagtggagcatcgctttttatgtgtgtgtgaaaatgaatagtggataagcaagttaatttaaaggccaattaatttcattgtcctttggattggcattccaacaatgttttgctagtagcaggttcatgtgacttcaaatgaagagtgtttctgcatacattaatgtttgaaaacccaaccagtatgccatgggacagcaagatgccttttgattagctgatgtcatagcttggtgccactggagactgggtcccaggttcaatttgtctatgggagctctctggcctggatgagctatgatagcaacatgttctttactgatgcttcagagtgcagatttcaactctgaaagaagttgctgcctgtcatgaatatatcatttgtcttggagaataacattgttgtagccactggccaagactgctgctgaaggctctgtaactatgatggtgatggatacttgatcttagtctccaaactagatattccaaaatagagcatgcagcataaaatgtcagccatggaacacttccacacgcatacaaaagagccacaaccacagacagcaatatagctacagagaagctgcttcataacatcatcactcaaatacctatttatgaagtggaaaagcaatattttaaaatctttttttcttttttaaaaatcttttattttaaaaaaatattgtgggtgcattgtggttgtatatatttatggggcacatgagatgttttgattacatgcaatgtgaaataaccatataatggacaatgggatatgcatcccctcaagcatttatcctttgagttacaaacagtccaattacattctttaagttgttttaaaagatacaattattattgactgtagtcaccctattgttctgtcaaatagtaggtctgattctttctttctaattttttctacccattaaccatccgcaacacctccctaaccccccactacccttctcaccctctggtaattttcgtattagtccattctcacactgctataaagaactacctgagactgggtaatttatagataaaataaatttaattgactcacagttccacatggctggggaggcctcagaaaacttatactcatggtggacagtgaaggggaagcgaggcatgtcttctcatggccagagaaggaggaagagagagcaaagggggcagtgctgcatgtttttaaacaaccagatcttgtgagaactctatcatgaggcagcactagggggattgtgccaaaccattagaaaccaccaccatgattcagtcacctcccaccaggccccacctcctgggagattacacttcaacatgagatttgggtggtgacacagagccaaaccatataagcattctactctctctgtccatgagtttaattgattttatttttagatcgcacaaataagtgagaatatttaatgtttgtctttttgtgcctggcttatttcacttaataatctccagttccatctatcttgttacaaatgacaggcttttattctttgatatgattgaatagtactccattgcatatatgtagcatgttttgtttatttattcatgtatggatggatgcttaggttttttccaaatataggatagtagatgtcttttcaatatacagattttttttcttttgaatatgtacccaatagtaggattgctggatcatatagtaagtagctcagtttttagtttggaggaacctccaaactgtttgcagttttgctatttcatattcccaccaacagtgcatgaaacttccctcttctccatatccttgccagcatttgttattgcctgtcttttggatataagccattttaacttaagcgagatgatatctcattagttttgatttgcatttctctgatgatcattgatgttgagcaccttttcataagcctgttttccatttgtacgtgatgttttagaaaagtctattcaaatattttgcccatcttttgatcagattattagatttttttcatatagagttgttttgagctttttatatattttggttagtaattccttatcagaggggtagtttgaaaatattttctcccattctgtggtttgtttcttcactttgttgattgtatcctttgctgtgctgagttttttaacttgatgtgatctcatttgttcatgtttgctttgggggtgcttgtggggtgttgcataagaagcctttgcccagaccaatgtcctagagatataccccaatcttgtagtagtttcatagtttgaggtcttatatttaagtctttaatccgttttgatttgattttcgtatatggtgagatgtagaggtctattttcattgttttgcacagggatatccagtttccccagtgccatttattgaagatgctgtcttttctgcagcatatgttcttggcacctttgtcaaaaatgagctcaccgtaggtgtgtggatttgtttctggattctctattctgtcccattggtcaatatgtctgtttttatgccagtaccatgctattttggtaactatacctctgtagtataatttgtacctctgtagtataatttgaagtctggtaatgtgattcctccagtttggttctttttgcttaggatatctttgactattctgagtcttttgtggttatacatatataatataatatatataatatatatattattactatataatataatatatatattattactatataatataatatatagtaataatatatataatatatataggtgttcccatattgggtacatatgtattttaaaattgttatatcctcttgctgaattgaccccttcattattttatagtgatcttcttttctcttcttatagtttttatcttgaaatctattttttctgatataaatatagtgactcctcctttttttggtttcaattggcatagaatatctttttctatgcttttatttttagtcaacatgtgtctttataggtgaagtgttttcttgtaggcagcagatcaatggatctttttttaatccattcagtcattctgtgtcttttgattgaagagtttaatccatttactttcaaagtaattcttggtaagtaaggacttactcctggcattttgttatttgttttctggttgttttgtgtcttctcttccttctttcattcctgtcttcctcaagtgaacatgatatttttgggtgatatgatttcgtttcctgctttttattttttgtgtattcattgtatgctttttggtttgagattaccatgaggcatgcgaatactatcttataacccgctatttaacctgataacaacactatttgcataaaccaacagtgaaaaataaaactaataaaaactcaccttaagtttgtcctcctgctttttaactttttgttgtttctatttatgtcttattgtactatgtcttgaaaagttgtagttattattttttattgtttcatcatttagtctttctacttaggataagagtagtttacacaccacagttacagtgttataatattttatgcttttctgtgtatttactattaccagtaagttttgtaccttcaggtggttatatattgctcattaatgtccttttctttctgattgaaacacttcctttagcatttcttgtaggatggatctggtattgatgaactccctcagcttttgtttgtctaggaaagtctttattagttccgcatgtttcaaggatattttcaccagatatactattctagggtaaaaggtttttccttcagcactttaaatatgtcatactactttctcctatcctgtaaagtttccactgaaaagtctgctgcccagcatttgaagttccattgtatgttatttgtttcttttctcttgctacttttagagtcctttctttatccttgacttttgggagtttgattattaaatgccttgaggcagtattcttggagttaaatcttattggtgttctataatcttctttacttgaatattaatatctttctctaggtttgggaagctctctgttattattcctttgaataaaacttctactcctatctccttccctaccccccctttaaggacatttcttaggtttgcccttttgaggctattttccagatattgtagcatgcttcattcttttttattctcttttcttttgtctcttctgattatgtattttaaatagcctgtcttcaggctcactaattctttcttctgcttgatcaattctatgtaaacactcttatgcattcttcagtatgccagttgcatttttcagctccagattttctgcttgattcttttgattatttcaatctcttgttaaatttatctgatagaattctgaattccttccctatgttatctcgaatttttttttttagtttcctcaacacagctattttgagttctctatatgaaaggtcacatatctctctttctccaggattggtctctggtgccttatttaattcatttggtgaagtcatgttttcctggatagtgttgatgctagtagatgttctttggtgtgtgggcattgaagagttaggtatttatcttagtcttcatggttgggtcttatttgtatccatacttcttgaaaggctttccagatatttgaaaggacttgggtattgtgatctaagctgtatctgctttgggggcaccccaagcccagtagtgctatagttcttgcagactcatagaagtactgctttaatagtcttggacaaatctgggagaattatctgggttacatgacagagactcttattctttacttactttctcccaaacatacagagtctctctctctctctattctaagccaccttaagctgggggtgaagtgacacccttgtggccaccactactattattgtgatgagtcagacctaaatttagtgtagcactgggtctcacccaaggcctgctataattactccctggctaatgcctatgttcactcaaggtcctggggctctatgatctgcaagtagcaaagccagccaggcttgtgtccttctcttcaagggtggcaaggccccctaggtcctgggtaggtccagaagtgctgtctgggagccagggctggcactcaaaacacaagacagagtccttcctactcttccctccttttttaaaagcagaggagctccaccccatagccgccaccaccccaggccatgagaagtactgtcatgctaccactaacattccaataaggtccaaggtcacttaagtcagcttattgtgaatgctgcctggcctgggactcagccttcacggcagtgagttaccctctggcccaggacaggtctagaaatgccatctaagagtcatgtcctggaatcagggaccccaagagcctgcttggtgctctcctcctctgtggctgtgctgatatctaaggtacaagacaaactcccctttacatttccttctgcttttctcaagcagaaggagttttgccccatagccaccacagctgataatgtgctgagtctcacctgaaactggcaagtctcaggggttcatccaaggcccttaacattgcacctggatattgctgctggttattcagggcctaggggctctacagttaggaggtgatcaatgctgccagaactgggttctttccttcaaagcactgggttcctttctggcccaggtgatgttaagaaattttttctgagagatacggcctggaataggggcctcaagactctgaccagtgccctatcctgatgtgactgaattggtatcctagatgcaagacaaagtcctctccactcttttctctcctgtccttaatcagaaagaaggggtctctattggagccatgagctgtgcagcctggggttatgggagaggtgataccagcagtcccttggctgacccagctggtgtctcaatatgttgtttgcccccgactctgccccacccagtccactatctctgggcctagttcagcactaggactcacctaagagttgtagtccttatgccctacactgtctttcaaatttatttggagacacagagagctgtagcccttggtggtgatgtttccacatactcaagttcagactgctgggattggcagttcccctctggctagggatggttgaaattctctctctgtggatggacatcagctgagtttggtttagtttacctttctgctctaacaggacagcactgatttcagtgcctcacaattgctgttttctccctccctccctccctgagcacccagatactctacacaccacatcaccactaccaaaaggaggggtggcatcagtgattcagaactgttttttctatctccttagtgcctcttctaatgatatgaagttaaaaccaggtgttatgagtgctcacctgattcttggttcttatgaaggtgggtttttttttctgtgtagatatttgttagcttggtgtccttgctggggtcaaggggagatgattggtggagttttctattctgccatcttgctatgcctcctatctttgcccgttattgaattgagtagtttattttgttattgttgagttttaggagttctttatatattccagataataatagtcccttaccagatatatgattagcaaatattttcttccattctatgtgtggcctttttactctgttgatagtgtcatttgaggtacacagtttttaaatgtttatgaagtccagttgtctattttttcatttcttgtttgtgcctttgatatcatattttagaaattgttaccaaatgtaatgtcattaacttttgccctttgtagcttctaagagataatcaagttttacctgcaccatcaagttttacctgcacaatttagtgaagaaactattctttcttaactcaatgggctcagtatccttgtcaaaattgatttgaccatatgtgagagtgtttgtttatgggatctagattctactccaatagtctatatgtcactccttataacagtaccaaaatgtcttattacagctgtgtagtaagttttgaaatcagaaattgtaaatcttccaactttattcttctctttcaaaattattttggctattagatttggccatgagattccagatgaagttaaggatgtgttgttctatatctgcaaaaaaaaaaaaatggattttcatagaggttgcattgaatccatagatcactttggtttatattgacatcttaacaatattaagtcctctaatccatgaacatgggatatgttttcctttgtttatatgttctttaattttttcagtaatgttttatagatatcattatacaagtgtttcacttccttggttaaattaattcttaagtattttattctttttcatgctattgtaaatgaaattttttataatttcctttgccgattgtttatataaagaaatgcaactgacttttatgtgttgactttatattctactgctttactaaatgtatttattagctctaacagttttttgtggaatctttgtttttatatatggcttttattatattgagataatttctttctatttctaatttgttgagtgtttttattataaaagggtggtgagtttcatcaaatgctttttctgctcaattgagatgatcaggtgggtttttcccctctttttttgagtctctatctgagtctgcttggtatatttattttattaatttgtaaccttaatatattgcaatgattaattttcacatgttaaatcatccttatattccagaaatatattccacttggttatagtctataattccattaatatgctactgaattctatttaatagtattctattgagtattttgcatcactgttcatgaggaatattaatatagtcaatatagtttatagttgtagtgtctttctctagcttggtaacagggtaatgctggccttatagattgagttagaagtattggtcctcttcaatttttgaaaaagtttacaaggactgatattattcttctttaaagatttggcagaatacacgagtgaagccaacaggttcagggctttttttctttctttttttttaatcagaagatttttttttgttactgattaaatctttttactagttataagtctattcacggtttgtatttctttgtgacttggtcatggcaagttttgtgtttcaggaattattttttcatctagattatgcaatttgttggcatacaaatgttcataatactatcttaaaattctttttatttccgtagaatcagcaataatgtccccattttcacttctgattttagtaatttgactcttctctctctgtttcttcttacatgtaactaaagttttatcaattttgttgattttctgaagacccaacttttgatttcattgattttctctgtggtttttctattctctaatttttaatctctgctctaatgtttatgttttctgttacttgctttgggttctttttttctttttctgctttcttgagttgtaaagttaggttgttgccttgagatttttcttattttttattataagtatttatagctacaaatttccctctttgcactgctttcactgtatcttatatgtttttggtatgttgtatttttgttttcatttatctctaattattttctaattttcatcctgatttctgccttgatccattggttaagagagtgttgtttaatttccacaagtttgttaatttctcaattgtacttctgttattgatttctaacttcattccactgtgctcatagaagacactttgtatggcatctatctttttaagtctatcaagacttcaattatggtcttacatatggcctatcctggaggatgtctcatgtgcacttgaaaagaatgcgtatacttttgttgatgtatagagtgttatatatcactgttagatctagttggtttattgtattaagtcctcttttctcttacttctgtctggttggtctatctatttttcagtgtggaatattgaattgtacaactattatagaactgtatatttctattttctctcattttttgcttcatatattttgatggtctctcattagaggcttaaatatttataattgttgtatcttcttaatatgttcagctttttaggaaatataatgtccttcttagtctcttttaactttataaatttaaagaccattttgtctgatattgatatggctaccccactctgttttggataccatttgcatggaatctctttctccatcctttcactttcaatttatttgtgactctgtatcaaaagtgagtctgttataaaccatgtatggttagactatgtgtttttatcctttcagtcaatctctatcttttgagtagaggctttaattcacttacatttaaagtaattgctgataaagagggatttctgttattttatgatttctcttctataggccttatagcttttttgtactccatttttttattactgtttgtgtgtggtcttgtgtgtgtttagctgactgttaaatgggatgtttagattcctttctcatttcctattggtatattttatagctaattttatggttaccatttggcttacatttaatatcctaaagttataacactaagatttgaattgataccagcttaacttcaatagcatacagaaattctgatactttacagcttctttctcacttctttcagttgtttatgttctaaaattacatctttataccatatgtaccccacaacatgaactaataattcctttaaatatatttatctcttaaattatgtagaacccaaaaggtgtggttacaaaccattgttccaataacactagcttgtacaattgcccttgtatttgtctttattgagatctttattccttcatatggctttgagttactacctaatatccttttatttcaccctgcaggactcctttgcacatttcttacagggcggatctggtggtaacaatctcccttagctttgtttatctggtaatattttaatttattccttacttttgaaggacacttttgccagatataggactcttggttgaaattttttttcctcttagcattttaaatatattgattcctgccttctactttccatccaaagttttcataatcagcatcaaggatatgctgattatcttattaaggatgccttgtatatgatgagtcacttctctattgctgctttcaaggttctctctttgtcttcgactcttgtttttttttttttttttttttttttttaaacaggttctcactttgtcacccagaatagaatgtagtggcctgattgatcatggcttctagcagccttaacatcctggactcaaatagatcctcttgcctcagcttcctgattagctgggactgtaggcatttgccaccacacttggctaatttttttgcttttcctttttttttttttttgtagagaccaggtcttcctatgttgcccaggatggtctcaaactccggaactcaagcagtcttcctgccttggcctcccaaagtgctggagttataggcatgagccatctttgacttttgaaagctttgtaacaatgtctcaatgtgagtctttttgagtttatcttccttggaattcattgagcttcttggttgtttatattcatgtgtttcatcaaatttgagaagttttcagtcattatttattcaaatattttctctgcccctttctgtctctcttccttttttttctgaaatttccacaatattgactttttacttaatggggatgcatatgtcacttagcctctgttcaccattttgaatttttttctttctgtttttcagacttgataatattcactttttaatctacaagtttgctaattcttctgtctgctcaaatctgcctttgaattcttctagtgaatgtttcatttcggttattatacttttaagctccagagtttctttctggtttctttttaggttttctatctctttactgatatttatattttgttcatacatcctttacttgactttctccccatctttctttagttctttaagcatcattaagacagttgttttaaagtatttatctagtaggtctaccctcaggactttttcagggataatttctgttgctatttttttctttcaatgggccatccttccctgtctctttgtgtacattatgattttttttgtttaaaagggaactttttaatttaataatgtaataactctggaaatcatatttgctccattttctagggtttattttgttgctgttattgctttaggttttatttattaatttgctttatagttgtaatctgtctctgtgccaaggactggtctggggtgtaatcttaaggtcttcttaagccttttctgagcttttctctggatatgtgtggtcattttctaattttccctgtatatgcagttgtcttcttaatgtctaattctttaatgtctggctctcgaaagaagaaaaagagaaaaatgaaggagttaatggagtggcagtggagctttaaatcccttggaagtcacttcagacagagggtgtagggcttgcgggaatgagggtaagtgcaacaacaatggctgcccagttctttgtttgcacttctgtgatcagaagcagtcatcaatgatcaggacacaaatccctgattttttaaggatagaggggggttttgttggtccaccctgtctcctgaaagctgtatgcaaactgttccaggaacatgtgcacagctgcctggcaggggattgggagtggggcataggtagctactactgagctaagagctaaaattgaccaaaattagctgcaatttaccatctaagccttcccctgaaagttgtatgtcttcaataaactccagagttccacagtagttctttcaaattctgtcagtgcaattgttatctagagtgttctggtgcttcctattccatctcagaatcctcctgtttggcttttttttttttaatggtttctatccctttgttgaacatctcttttttcaggtattgttttcctgattttgtttagttttttctttcttctttgttcttcttaggtcactgaaattctaaagatgattattttgaattctttgtcagacatttcttaaaggtctctttctttggggttggccactggaggtttattttgttcctgtggtggtgtcgtggttctttgattttttctttgatttttttttcatgttccttgaagtctgcagtcacttcctccagtccttactcactggcttcagaaaagcctttcaccaggcaattcactagagattctggcttgtaggttttctgctgagaaatccactttagtctgatgggcttccttttgtaggtgacctatcctttctctccagctgcctttaaaatagtttcattcattttgatgttggggaatctgatggttatgtgtcttggggatggtcttcttgtggtcttctttgctgggtttctctgcatttactgaatgtgaatgttagcctctctagctaggttgggtaagttcttatagatgatgatatggcttggctctgtgtccccacctaaatctcatgtcgaattgtaattcccagtgttggaggaggggcctgatcggcagtgattgaataatgggggtggacttccctcttgctgttcttgtgatagagttctcctgagatacgcttgtttaaaagtgggtagtggctaggcgcagtggctcatgtttgtaaatccagcactttgggaggtcgaggcaggtggatcacttgaggtcaggagttcaagaccaacctggccaacatggtgaaacccgtctctactaaaaatacaaaaaaaattagccaggcatgatggcaggcacctgtaatcccagctacttgggaggctgaggcaagagaatcacttgaacccaggaggcagaggttgcggtgagctgacattacaccactgcactccaccccgggcaacagagggagactccgtctcaaaaaaagtgtatagcacctcccccattcctcctatgtgaagatgtgactgcttccccttcactttccaccatgattgtaagtttcctgaggcctcctcagaagcagaagcctgtacagcccgaagaaccatgagttaactaaacaccttttcttgataaaatacccagcctcaggtgtgtctctatagcagtgtgagaatggactaatacagatgatatcataaatgtgttttctatgttgcttccattctctccatcagtttcagaaatgccaatgagtcatagattcagtctctttgcataatttcatatttctcagaggttttgttcattcattttcatgcttttttctttattattttctgactctattatttcagaaagccagacttcaagctctgaaattctttcctcagcttagtctattctgttgttaatacttgtgattgcattatgaaattcttgtagagtgttttttagctctatcagctcagttacattctttcctgcactggctgttttgtctgtccgctcctgtattattttattgtgattcttagcttttttaggttgggtttcaacattcttctgaatcttgatgatcttcattcctatccatattctgaattctatttctgtcatttcagccatctcagcccagttaagaactcttgctggagaactaatgtggtaatttggaggaaagaagacactggctttttgagtggtcggagttcttgcagtagttctttctcatctttatgggctgatgttcttgcagtctttgaagttgttgtcctttggatgagtatttttttcttttattctatttgatgaccttgggggtttgattgtggtataatatgggcccagctaactactttcttcattatggcaagatttttggggaccaaggctcagcttaggacacctggactgcaagctttaactcttgaggactcctttcaggccttgcctttgatctccagctccttgagtttaggaatctactgcactagaggggccagagtgtcctggccactggtcacagcattccaatgggtaatgccaaccatggagacaaagcacttcgtagggtggtggcagcagattctgttcttatttgcacatgctagcagcagcagcagtgcagcagtgtagactctcattggctgcagcagggtgctggtaggtaccagagtgccagcctttgagcaggcattcacagcagtagtagtggcagtatgtctggggcgtggggggcagtgtggaccaggggcccctgtaggcaactgtgcatgcattcatgctagtggtggtgttatcatgggagcaccggtgggtgctgtgtgtgccctctgtgcatattcatgctggtagtggtggccgcccagtgccaaggccagggccactattttctgtgcctaattttgcaccagtggcagtgttgctgcacaggtggggcacaggcagggcagggccagtgggctccttgactgccaatgcttcaacaacaatggtggtaccgctgggagaagtgggacaaggtgcactccactggcagtagtgtcatgacagggtgctcatgcatatttacgctggcagggaagggaaggctatgtctacctgcacacacatgtgctggcaaagcaatgtggaggtggctacgggtgagtgcctgtgggcaaagcagcatggaggctgctgttgggggaggactcagtgtggtgcaggcaggggcactctgctggagcactctgccagtcaggcacagtccaccagcacaggagctatgataaggacccccaggaggtacctaggggctgcactacagacaggcttagccaggctgggggcctgggagaggccagaagactgaggggtgcttaggtcagactggctctgtctcatgggcaagaccaccctatagagttcaggcctcacagtttccctagggttaaagctcttatgggagcaagttgagcctagggtgacgggcatcactggtctgctccattacaggtgctcccacaccaaaccctctgggcgctagctggagttctttccttaatgcttctctcttctctaagcagctttccctgccaattcagatgtccattgtggctaaggggtctcctcctgctgggattccagaggcccatggcgatagcaggttccttcttgactgctcaactcaccccttttgcaggagtcattggggtcagggaacaagtcgtggtgtgtggtagcccaatgcaggtttcccagctttcttctcctttagcccagcccctgtgtcttccctccatctgctctcaatgccttccctctgaagatctgataggagtgtgccagtctccccagtatcctggtctcttggtgggagatgttcccctggctgcatctagtcagccatcttagagcaggaattcaatctatgcttctatttctgttggaaaaaaattaattagactaattgcagaaggatactgaaagaaaatattaattttttgtctaaatggaagtgagactctaaggaagttaaaattttaaaaattaaagctatttttaaaagaataagtaaattggaggtagaaactacaatacccagagatcactgctagaacatgacgttgcttaatatatccaagagtaaaacttgttcttaaccttcttaaccaaataattttatctcagtatattaggaacctacagcaagtaggtaacaatgtatcaggtagaaaatctagggaagaattaatgaatccagtaagaaaacaacagggaccctttgaggcatggaagtttgagatgggagcatagaaaaggaagcaaggcactcagttggattggctcacacctaggagggatgctccaatgcaggagaaacggtaagtgagagattcctagcagtccacattccaaccacaaatgcctgcagtcctagctataagaaagccctttggccctcttgggccctgagcctagtataaggagcttcctggagtccacaagactgcattgtttcagggagggaattcgtgctgggacctctgggacccaagctgctacaatatgatgccattttgagagcagagtaaacaccaaactacatcccgccctggtgcccaatgactcctgcatctccaacatccctccacatccacccagaaggctgtagtgttgctatgccagctgacccagtggtataactgcatttctggcacctgagccatgcagcaccctacatcccagggagcaggtgatctagcacatcagagaggctgtatactcacatgccccacccaggggagcagggatcagcctgcctgccctactatggacaccactagtgcctgtatatcacacccagaggcctagggattgggccatttggctcactactggcacccatgcatgccacccagtggcctgcagactggtcctactggcctgatgacaccaccagtctctgtgcactccactcaggcaccagaggacccacctgctattgacactgccagtgccaatgcatgcatcctacccagggactcaaggagcaggccacctcacctgccagcacctgtgtgctccacccaagggcccaaagaccagcctactcagggcccatactaccaccactgacacctgcatgtgccccccagggaaccaagaactggcctactgccatcactgctgatgctcacataccccaccaagaggcctgaggaccatcccacttggcacctccatccccagcaaatccttaccacagcctccaaaaacaactgcagcctatgccactaaggaacttgcagacatctccaatactgattacagccaaagtaatcacatggagactacgctatggtgcccatccagaaccaaagccaaagccatgtacccaacttacattatagatacatcaacaggaaaaaatatttctctatggaagctactttataaaattgggaaaagtgacagttataccagctgtggaaatatcaatgtaaggacatgtgaacacaaaaaatcaagaaaacatgatacctccaaaggaacacaataattctccaataacagaccccaaaggaaaaaaaagatctatgaaatgcctgaaaaggaatttaaaataacgatcttaaggaaatctagcaagatacaagagtatacagataaatacaaagaaataagaaaaacaattcctgagctgaatgagaaattcaacaaagagatagatatcataaaaaagaaccaaacaaatcctagagctgaggaattcagtgaatggaataaaaaaatacaattgagtactttaacagtagactaggccaagcagaagaaagaatttctgaacttgaagccaggtcttttgaaataacccaatcagacaaaggtggtatgggggtgttgtggagggaggaaaagagggagggagaaagaagaaagaatgagaaggaattaggaaagcctaggagttgtggaaaacaagcaaacaaataatcaaattttagaagttgcagaaagagaaaagaaggaaaaaggcatagaaaaatactgcatattctaacttataagtgggagctaaataatttgtacacatggacatagagtgcagaataatagacattgaagactcagaagggtgggagggtgggagggtgggagggggagtgaaagaggagaaattacttaccaggtacagagtacttattcagatgtgattccactaaaagcccagacttcatcactatgcaatatattcatgtaacaacaaaattgcacttgtaccctttaaatttataccaaaaaaagaaaacttaatgaaacaataactgaaaagttcctaagtcttggaacagatataaacatacagatatggaaagttcaataatccccaaatagatttaattttaaaatgtcctctccaaggcacattatagtcagaatccaaaaagcctggatctcagtgtgcattacatgtgcctcttaaaccctactaaatatgtcttcaaaatttccactccttctgaaatattttacctgaccctgtagtcaaatgtttaagcatacagacagtaagtgagcaactctggattagaattctgattattacgtatgtgatatgagaaaattttcttactgattttttctgagctttagtttcttcatcttcaaaatcaggataagagaaaaaaacacctacattgcaggattgttgtgaaggttaaatgaggtaatgtgtacaaagtgcccagcatttaagtgtttgataaatgttaactcccattttttaacatgccagcccatttaaatggtgaaaactaattttcatctttgcactatctgcaagggaatccaggaaatgtacaattataccttttcaaactctataatacagtaaggctatattgtagtggataccaagtactagttcttcatgttcaacatggccaataaacatgatttttctctgtggcactctatcttcatttgtatgaccaaagaaacacattttaaaatgtattctatgtattgctgaactacgagatgatgtttcaaatataatttgttagcattaagaaaaataagacatactttaatgcattgccaagtttttaagttctatcaaaacagagccaaactcacaaggtctaaataaacagtactcttatcttggacgtgagtagttttatactctggaacaagaccgacaatcgtaattaacttttgttctgagtttactgtatgccagcacatattctagcatttgacatgtattatcacaaaaactccattaggtaggtaataatattccaaatttacagaagaggcaactaatgcatgaagatttcagtaatctatacagctagtaagtggcagaactgagatttgattccaggcagtctagcctggccccagaaccaatgttcttatgtacccttcttaactgcacagtaagatgcttctgttcttctagggtttttatggttttaggctttaggtttgagtctttaatccatctggagttaatttttgtataaggtgtaaggaaggggtccagtttcagttttctgtatacggctagccggttttcccagcaccattgattaaatagggaattctttccccattgcttgtttttgtcagctttgtcaaagatcagatggttgtagatgtgtggtattatttctgaggcctctgttgtgttccactggtctatatatctgttttggtgccagtatcatgctgttttggttactatagccttgtggtatagtttgaagtcaggcagcttgatgcctccagctttgttcttttggcttaggattgtcttggctatatgggctcttttttggttccatatgaaacttaaagtagctttttttctaattctgtgaagaaagtagcttgatgggaatagcattgaatctataaatagctttgggcagtatggccattttcacgatattgattcttcctatccatgagcatggaatgtttttccatttgtttgtgtcctcttttatttctttgagcagtagtttgtagttctcattgaagtggtccttcacgtcccttgtaagttggattcctaggtattttattctctttgaagcaattgtgaatgggagttcactcatgatttggctgtctgtttgtctattattggtgtataggattgcttgtgatttttgcacattgattttgtatcctgagactttgccgaagttgcttatcagctgaaggagattttgggctgagaccatagggttttctaaatatacaatcatgtcatctgcaagcagagacaatttggctttctcttttcctatttgaataccctttatttctttctctttcctgattgccctggccagaacttccattcaggacataggcatggacaaagatttcgtgactacaacaccaaaagcaattgcaacaaaagccaacattgacaaatgtgatctaattaaactaaagagcttctgcacagcaaaagaaactattgtcagagtgaacaggcaacatacagagtaggagaaaatttttgcaatctatccacctgacaaagggctaatatctagaatctacaaggaacttagacaaatttacaagaataaaacagccccatcaaaaagtgggcaaagctgtgaacagacacttctcaaaagaagtggccaaaaaacatatgaaaaaagctcatcatcactggtcattagagaaatgcaaatcaaaaccacaatgagataccatctcaggccagttagaatggcaatcattaaaaagtcaggaaacaacagatgctggagagaatgtggagaaatagaaaacttttacactgttggtgggagtgtaaattagttcaaccattgtggaaacagtgtggcgattcctcaaggatctagaaccagaaataccatttgacccagcaatcccattatggggtatatacccaaaggattataaatctttctactataaagacacatgcacacatatgtttattgaagcactatttacaatagcaaagacttggaaccaacccaaatacccatcaatgatagactggataaagaaatgtggcacatatacagcatggaatactatgcagacataaaaaagaatgagttcatgtcctttgcagggaaatggatgaagctggaaaccatcattctcagcaaactaacacaggaacagaaaaccaaacaccacatgttctcattcataagtgggagttaaacaatgaaaacacatggtcacagggaggggaacatcacacaccgaggcctgtcggggggtggggggaaaggggagggagagtattaggacaaatacctaatgcatgtgggggttaaaacctagaagacaggtttataggtacagcaaaccaccatggtgcatgtatacctatgtaacaaacctgcacattctgcacatgtatcccagaacttaaagtaaaattttttttaaaatgcttctattctatctttttaaactccaagcacttaaagtactttcattgtatatttaagttatgcaacaaaaagtttaatactataatgacagaatacatggtagagatatagaaccaattttaatctatgttacacagccaaaatataaaaaaatgaatcttatacttaataaatatcttttgaaatttttggctaactactaaaattatgactaagtcttaaaagaacaaggacttaactatattcatgtggtttagaaaataaaggaattgttgctcatcttcatttgttaatctacacgcttgtattcctttgtattaagagttaatcattatatgtatgctgccttcctcctcttggcacagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaaggtatgttaaacatattaaatttttttgttacagttaaaatttggtttacaatggtaatgggaacagagatatgggatggagatcacatatgaaagatgttaaaaaactactaatcagtgaatacctgagagcctgatggggctgtggccataactccaactccattcctcactccacctccttcctcacctctaaaaccagaatgcctctgcttataggtaactaccccctcctctgtacaaagggagacctatgcctaaatctgttccctacccttcccataataattaagagtttatttcaatcccaatggtaagctttttggtgtctctatctgtagatatttaatgtattgcaaccttaatttcctcaattgtcaaatgaatgtgaccaagaacaaaggcaagatattaaattctaaagtttgcaattttcatcttcatatatttttaaaaggaaggtctatttgcttatttatggaatgagtgtggggcggtggggtaggggagtaaattacaagagccagagaccagaaatttttacagaggcaaaaaaagggaattttgtaactttgctgcaactgtcttattgataaggaactttagagaaagagataggaaaaaaataattttaggaagatttgctatagtaattctatgctgtgaagtaagtctctatttactactcctgaaaacttttgacagtgatctatattggtcttcaaatttaaaaaaattatatttaagtttttggttttttaaatattatgctatactaaatctgatcccttagatatgcagataatgatgttatttctctaacaggtgtctgtgagtatcaactttgtatggtgatgaaccatgaatggaaaagatttggagccatataatatctagcatgttataaaagaagcaatatgtaatgattataaaagaagtagcccccttttaatttttattttttaaagagttaggatctcattctgttgctgaggttggattacagtggcataatcatagtgcactgcagcctctaactcctgaacttaagtgatgctcctgcctcagcctcccaagcagctggaggtacaggtgcacaccaccacatccagcttatttttcagtttttgtagagacagtgtctcactaagttgcccagggtagtcttgaactcctggcctcaagcactggggttacagacaggcattagccaccacaaccagccagaagtagcactctcaatcactgtaatgagaggtgggaattttgaattttagatacttctacctctaatttgtcctggattctgggaaaattactaaactctaagtttgtctccaaatctgtaaaacatataacctccaagctccctctcatctctaaattttatgacaaacaattatttttataaatttgctaagagataaaaaggagaaattaggaatactatattttgtttcctagaaaaaagtctgaggagcctgtatttatcctctttctataaaaacaattatgagttacatgtgtacctatcaagagggaaaagagagtgaaggctgtagaaagaaaaatctgaagaacttgtactctggagagattataagagcaggacaaccttgataacatttcactgagctgtatgagtttatgcttattggagcgtgcacatgtacaagtgttgatgagaggagaacctgaaaccatcctgtttttttttttaagtgagctgaagcactctcagaaagattaccactatcaacaggatggcatatagtctgtactctttgtttagccctaggcaaagttaggactgcatttgaattaaaggtaacagcctgaaaccagttcagggagataaaatttgcattttggccttggtagaaatgttaatttttagaattgtaattaccccagatatagaatatgtttgccgcagaagatttgtgatcctgataagccctttcatgccaatcgccacagtattgtcattggaactgacaagaaactgttagggattcttccaacaattcagaggtaggagggaagcacaatttaagtgatgtcagaaattcttgtaaccattactatttagactaaatcttttctctaggtaaaagaatttcaacaaacttgtgagttaacgtagagaaagaaaaatggtgagctggagctcaggagcctccaattctagtcctaggtctgcctaagcttatgaattatacttctagacttcagtttctccatcttcaaaataagctggtgaactggataagctccctctcaggtcaattaacaaacaatgaaattttacttcctcctcataattttgatttatatatattaaatctgatgttattgtggaaatatactaacaatttgtgtggtttttttttatttatttccatagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtaagagtttgtattcattcattccttcactgttactttttcaaatttagatataaggtattataaacataaatttgtattgatttggagcaaaggttataagtattctgcacaatgggaactattaagaattttatacatcatataccatcccaacatctgtcatgttgtaactttcctttggggtaaaagagtacaaccatttcttcggtagtaaactgtgtaagtgccaacctgaacaatgacatgggaaataagttcctgaaaagcactgaggaaaaccttaatgcaaaacttaaatttatttttaacaaattgaagcattacccaaagttccatgccagatcagagcatgagtgtttttacatcatccttgaagaactcagaataattaagctagaagctatctgacctaaggtggatttctaaagacttttataaccttcccatcttgtttcaaaagcatgccacacaatttctttccttttcatgctagtgcctagagaatttgaccaatgttgtaagtattgttgccaagcatatgttgtattctcttcctccttgaattatcttttttttttgaagaagagataagtatgattcctcctgttattcctaatttgttcttatcactaattttattgtttccctgtttcctatataagaaattttcagatagtttttaagtcaaaaaatttcattactctgcaggataagggttttattttaaaaggatatatattatatagaaggttacacttgtgttttctttaactagtgtgctaagttcatatgacaagattgtaggtagaatagtcagttctctactaatgtggcaaattcagatttgtgttttaaaagttaatcgtgatgacaattttattttaacatatagttcacaatgaaaaatatattttactatattcctaattataaagaaatatacacaattcttttgactggtgagttagttggagtcaaatcagtgataccataatgaattattaattattaattcaattcattatttaactcaataaaagattatatatattggacatctaatatgtaccgggcattcctcacaagtttaaaggtacagtcagcttccactgtcacacaagtttaaagctgtaagtgaaagacaatttcgtaattagaaatattctaacaattgtggttttctgtatcacaagcatagaaataagcaatccctggactaataaagcagatctctcaatattatagggaaattctttgtcattcttagcacatatacttagaccaaaaaatgatgacaaaatacaaaataagtatagatttaacttttgacactattttgtaaatatttgaaaactttttctttatctatttaataagatttaatgggaagctatcttctccaagtctctatgtcactattctttcaagactctagttaataatatgtgtcaacatcagttcattggctaggcacagtggctcatgcctataattcctgcactttggaaggctgagggaggaagactacttgaggccaggaatccaaggccagcctgggcaacatagtgagaccccatcactaccaaaaaatttttttaaatatatatatttttaaaaattgctgggtgcagtggctcacacctataatcccagcactttgggaggccaaggtaggagtattgcttgagcccaggagttcaagaccagtctgggcagcataatgagaccccatctctacaaataatttttaaaaattagccaggcatggtgtgtgtgtgcctgagccagaaggatgagcatgcagtaagccataatctcaccactgcactccagcctgggtgacagagtgagactccatctcaatgaaaaataataaaaaaattaattaaatcaaatgtgccacacttatacaagatgttaataataaaggaaatgacagaaggggtatgtgggaactctttatactatctgttaaattttctttaaatctgaaactgctgttaaaaatacactctattaatttgttgaataaagatgtatataaaggagaaagccatgagtctgggttcccatgtttgttctgtaattaaccattacaagaaagaaagtctacttgggagccataatttatggcagtaaaaagaaaggagggaaaagataagggtgacagaaatcttgtttaaatttaaagtagaaaattttgtgcttcctctttcagagcctacttattgactaactgtcccggtcttcactctccttgccatatttattttctttcctatacccatgagtctctgcccaagcttatgggaactattatgggtactgtttatgttattatggttgctgccatagcttatgggaaccattaaagaaggtttggatttaggggcatttagcacttgtccattgtcagtgctgaagtgagtgacatgctctctgaccttgaatgcatcttttttcctgtgagaacgttgttaaataaacttttgttagtcggcctaggaaaattcatgagtcaaatagtttccttagacttgaaaacagtctactttgaaatttatccactcattcaacaaacatttaccaagcccataccaccgaaataagcactggggatacagtggtccctgttttcggagacttgtagggaaaaacaaaattaaacacaaaattacaataaagaaagtataataatggaaattacactaagagaaataaagaataccatggcagcatggcagggggatttggggaagagctccctaacaaagatgacatctgaagtggaagttggacaagtttgggaggaagtgtacagtactggcgtttaagagtaattcagaggctgggcgcagtggctcacaattgtaatctcagcattttcgaagaccaaagtgagaggaatgctagagcccaggagttcaagaccagcctgggcaacactgggagaccctgtctctagaaaaaaaatttttttgaaagactaaagtcagtacagtgtgagtaaaaatctagaagtaagagaggacatggcatagctggagactgtagatagaatgatactaaatgaggatggaaaaataggcagggaatgattatacagtgccttataaatcgtgaagaaggaaaagactacctagtagattattttttcagtacaaaacttgtgatgcaaaacattgggttttttttcaagatctagttattaaattttaaattttataattgtaaaaatcaaaatataaaggaaaaaaatgaaaattctgccactagcaaactttgtcccttctctgtccccgtccccatcctcatttcctcccctaggaattttactctccactagcaacttggtgagaaatttgttaaaactcattttaagttttatttatttctacttaactctttatgctgccaactataaattattctataatgatcagttctgccatacaaagtacctagcatgctttgtaacatatataatatatatgtgtatatataaaatatatatctctcataatcaaactcaagatttaaattcatgattaaagtcaagattctccagaataaattcattctccttaccccagtggtagatgctttttcattgctataaatgaatacctgagattgggcaacttataaagagaagaggtttaattggctaatagctcttcaggctgtacaggaatcatggtgctgacatttgcttagcttctggtgaggcctcaggaagcttccagtcatggtggaaggcaaagagggaacaggcacattacatggcaagaggaaaagcaagagagagaggagggaggtaccacataattttaaataaccagatcttatgtgaactagcacagagagaactcactaatcaccaaggagatggcgctaagccattcattagggatccatcctcatgatctaatacgtcccattaggccctacctccaacattggagattacatttcaacatgagatttggagggaacaaacatccaaaccatatcaacttccaaactagttatttttaacactctttcatttctgttagtagtagaatattaacagaaatgtaattaatagccatcatactacctaaatagcctccataacttcaatttttttcttctgatcccttttactcactgccttcatactggtcatataccagtattattttcatcattgaattttcacttttggacctaccctgtctactctagagttgtcccagccttactccctaagtcaaacttattttccagcattcaattccattaaagtccatttctccattgaagaactagtaaattaatttatataaatatgaaaataggttaatgtgctttcttatggatataatataaaactggttaataggctttgtctggaaattatttaattgaaattagaatgatattatttttaatgctaagtctaaaccttgatgaaaaactttattaaagtattatttagttaaggtcttttgatataagatgggtatatttcaaatatacttatgaaattcacacattttatctcttctaaactgcaataagaactaatacaataataacattgtaaaatcaaacataatcattatatttgactgaacaagaataataaaggcctcatacacaatagtcaacatatatactccccatttataggtttcaatatttagcaccttttggagttaccagtatctcttattctatttcatatgttcaagtgtacccattgtttagctccaccttataagtgagaacatgtagtttttgactttctcagtcattttatttaggataacagcctccagctgcattcacattgctgcaaagggcaataatttcattatttatttatttattttattatactttaagttctagggtacatgtgcaccatgtgcaggtttgatacataggtatacatgtgccatgttggtttgttgcacccatcaactcatcatttacattaggtatttcttctaatgctatccctcccccaggtccccaccccccgacaggtcccagtgtgtgatgttccctgcgctgtgtccaagtgatctcattgttcaattcccacctatgagtgagaacatgcagtgtttggttttctgtccttgtgtgatagtttgctgagaatgatggtttccagcttcatcaatgtccctgcaaaggacatgaactcatccttttttatggctgcgtagtattacatggtatatttgtgccaaattttcttaatccagtctgtcaccgatggacatttgggttggttccaagtctttgctattgtgaatagtgctgcaataaacatacgtgtgcatgcatctttatagtagcatgatttataatcctttgtgtatatacccagtaatgggattgctgggtcaaatggtaattctagttccagatccttgaggaattgccacactgtcttccataatggttgaactaatttacactcccaccaacagtgtaaaagcattcctatttttccgcatcctctccagcatctgttgtttcctgactttttaatgattgccattctaacgggtgtgagatggtatctcattgtggttttgatttgaatttctctcatgaccagtgatgatgagcattttttcatgtgtctgttgcctgcatagatgtcttcttttgagaagtgtctgttcaaatcctttgcccactttttgatggggttgcttggttttttagtgtaaatttgtttgagttctttgtagattctggatattagccctttgtcagatgggtagattgcaaaaattttctcccattctgtaggttgcctgttcactctgatggcagttgctttgccggacagaaggtctttagtttaattagatcccatttgtctattttggcttttgttgccattgcttttggtgttttagtcatgaagtccttgcccatgcctatgtcctgaatggtattgcctaggttttcttctagggtttttatggttttaggtttaacatttaagtctttaatccatcttgaattaatttttgtttaaggtgtaaggaaaggattcagtttcagctttctacatatggctagccagttttcccagaaccatttattaaatatggaatcctttccccatttcttgtttttgtcaggtttgtcaaagatcagatggtgtagatgtgtgatgttatttctgaagcctctgttctgttccattggtctatatctctgttttggtaccagtaccatgctgttttcgttactgtagccttaatatagtttgaagtcaggtagcttgatgcctccagctttgttctttttgcttaggattgtcttggcgatgcaggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatattcttctatttgtttgtgtcctcttttatttccttgagcagtgatttgtagttctccttgaagaggtccttcacatcccttgtaagttggattcctaggtattctctttgtagcaattgtgaatgggagttcactcatgatttggctctctgtttgtctgttattgctgtataggaatgtctgtgatttttgcacgttgattttgtgtcctgagactttgctgaagttgcttatcagcttaaggagattttgggctgagacgatggggttttctaaatatacaatcatgtcatttgaaaacagagacaatttaacttccttttttcctaattgaataccccctatttctttctcttgccggattgccctggccagaacttccaacactatattgaataggagtggtgagagagggcatccttgtcttgtgccagaaagggaatgcttccagtttttgcccagtcagcatgatattggctgtgggtttgtcataaataggtcgtattattttgagatatgttccatcaatacctagtttattgagagttattagcctgaagagctgttgaattttgttgaaggccttttctgcatctattgagataaccatgtgttttttgtcattggttctgtttatgtgatgggtacgtttattgatttctgtatgttgaaccagccttgcatcccagggaagaagccaacttgatcgtggtggataagcttttcgatgtgctgctggattcgtttgtcagtattttattgaggattttcacatcgatgttcatcacagatattgctctaaaattctcttttttgttgtgtctctgccaggctttggtataaggatgatgtgggcctcataaaatgaatttgggaggattccctctttttctattgattggaatactttgagaaggaatggcaccagcttctctttgtgcctctggtagaatacagctatgaatccatctgatcctggactttttttggttggtaggctattaattattgcctcaatctcagagcctgttattggtctattcagagattcaacttcttcttggtttagtcttgggagggtgtatgtgtccaggaatttatccatttcttctagattttctagtttatttgcgtagaggtgtttatagtattctctgctggtagtttgtatttctgtgggatgagtggtgatatcccttttatcatttttattgcgtctacttgattcttctctcttctttattactcttgctagttgtctatcaattttgttgatcttttcaaaaaaccagcttctggattcattgattttttgaaaggttttttgtgtctctgtctctttcagttctgctctgatcttagttatttcttgccttctgttagcttttgaatttgtttgctcttgcatctctagttcttttaattgtgatgttagggtgtcgattttagatctttcctgctttctcttgtgggcatttagtgctatacatttccctctacacactgctttaaacatgtcccagagatcctggtacattgtgtctttgttctcattggtttcaaagaacgtctttatttctgccttcattttgttatttacccagtagtcattcaggagcaagttgttcagtttccatgtagttgtgtggttttgagtgagtttcttaatcctgagttcaaatttgaattgcactgtggtctgagagacagtttgttgtgatttctgttcttttacatttactgaggagtgctttacttccaattatgtggtcaattttggaacaagtttgatgtggtgctgagaagaatgtatattctgttgatttgggatggaatgttctgtagatgtctattacgtctgcttgttgcagagctgagttcaagtcctggatatccttgttaaccttctgtctcgtggatctgtctaatgttgacagtggggtgttaaagtctcccattattattgtgtgggagtctaagtctctttgtatgtctctaaggacttgctttatgaatctgggtgctcccatattgggttcatatatatttaggaaagttagctcttcttgttgagttgatccctttaccattatgtaatggccttctttgtctcttttgacctttgttagtataaagtctgttttatcagagactaggattgcaatccctgctctttttttgctttctatttgcttggtagatcttcctccatccctttactttgagcctatgtgcgtctttgcatgtgagatgggtctcctgaatacagtacactgatgggtcttgactcttcatccaatttgccagtctgtgtcttttaattggggcatttagctcatttacatttaaggttaatattgttatgtgtgaatttgatcctgtcattatgatgttagctggttattttgcccattcattgattcagtttcttcatagcatcaatggtctttacaatttggcatgtttttgcaatggctggtaccggttgtttctttccatgtttagtgattccttcagaagctcttgtatggcaagcctggtggtgacaaaatctctcagtatttgcttatctgtaaaggattttatttctccttcactaatgaagcttagtttggatatgaaattctgggttgaaaatttttttctttaagaatgttgaatattggcccccactctcttctggcttgtagagtttctgccaagagatctgctgttagtctgatgggcttccatttgtgggtaactcaacctttctctctggctgcccttaacattttttccttcatttcaaccttggtgaatctgacaattatgtgtctcggggttgctcttctcgaggagtatctttttggtcttctcgtatttcctgaatttgaatgttggcctgccttgctaagttggggaagttctcctggataataccctgaagagtgttttccaacttggttccattctccccatcactttcaggtacaccaatcagacgtaaatttggtattttcacatagtcccatatttcttggaggctttattcatttctttttacttttctttctctaccttgttttctcactttatttcattaatttgatcttgcatcactgatagataccctttcttccccttgattgaatctactattgaagcttgtgcatgtgtcatgaagttcttgtgccatggttttagctccatcaggtcatttaaggtcttctctacactgtttattctagttagccatttgtctaatcttttttcaagctttttaccttccttgcaatgggtttgagcatcctcctttagcttggagaagtttcttattactgaccttctgaagcctacttctgtcaacttgtcaaagtcattctctgtccagctttgctctgttgctggcaaggagctgtgatcctttggaagagaagaggggctctgattttagaattttcagcttttctgctctggtttctccccatctttgtggttttatctacctttggtttttgatgttggtgacctagagatggagttttggtgtagatgacctttttgttgatgttgatgctattcctgtctgttagttttccttctaacaatcaggtccctcagctgcaggtctgttggagtttgctggaggcccactccagaccctgtttgccttggtatcaccagcagaagctgcagaacagcaaatattgcagaacagcaaatattgctgcctgatccttcctctggaagcttcgtcccagaggggcagccacctatatgaggtgcctggctgcccctactgggaggtgtcttccagttagtctacatggggttcagggacccacttgaggaggcagtctgtctgttctcagagctcaaacaccatgctgggagaaccactgctctcttcagagctatcagacagggacgtttaagtctgcagaagttgtctgctgcctttttttcagctatgccctgcccacagaggtggagtctagagatagtaggccttgttgagctgtggtgggctccatccagtttgtttcctggccactttgtttacctactcaagcctcaacaatggcagacacccctccccagccaggctgccaccttgcagatcaatctcagactgctgtgctagcagtaagcaaggctccatgggcatgggacctgccaagccaggcatgggagagaatcacattgtttgccagttgctatgaccttgggaaaagtgcagtatttgggcaggagtgccctgtttttccaggtagtcagtcatagcttcccttggctaggaaagggaaatccccccaccccttgcgcttcccaggtaaggtgacaatgccccaccctgcttcagctcactctccgtgggctgcacccactatccaaccagtcccaatgagatgaaccagttacctcagttggaatgcagaaatcacccatcttctgcatcgattacactgggagctgcagaccagagctgttcctattcggccatcttggaacacgcccgcagtctttacattcttttatatagcaattgaaaggaatccttggcatttagaccttccattccccagctccaccattcttttccagccttatagtctttgacctttcactacatatcctgggccctagacaaaccaaactccttgtcattcacttaataagcccagtgtgtagtcaagtataaagcaatgatttcattttattatgactgagtagtatttcatggcatatatatatatatatatatatatatatatatatatatcacatttttaatccaattgcccattgatagacacttaggtttatcccatgactttgctattgtaagtagtgctgcaataaacatacacgtgcttgtgtctttttgatatgattatttcttttcttttgtataaatagcaggtagtgggatcacttgatcaaaagatagttttatttttagttatttgagacatctccatattgctttccatagaagttgtactaaactaattcccaccaatactgtataagcgttcccttttctctgcatctttgccaaagtctatttttttattttttattaatagccattctgactggtataagatggtatcttattatggttttaattttcatttctctcatgactaatgatgttgaacatttttttttttcgtttcttggccatttgtatgtgttgttttgaaaagtgcctgttcatgtattttgctcactttttaatggggttatttgtgttttcctttttgaattgcttgagttccttgcagattctgggtattagccctttgtcagatgcattgttggcaaatatttttcccattcctcaagttgtttattcactctgttgtttatttctttttctgtgcataagcttttcagtttaattaagtcctatttgtctatttttagttttgccgcatttgcttttgaggtcttagtcacgaattcttcacctaagccaatgtccacacaagagtttttgctaggtttccttctagcatttttatagtttcaggtcttacatttaaatctgtaattcaccttgagttactttttgtatatgttgagagatatgggtccagttttattctcctgcatatggttatacaatttttgcagaaccatttattaagtaagatgttcttttctcagtggatgcttttgttgactttctcaaagatcagttagttgtaggtatatagttttatttctgggtcttctattctcttccatttatctatctatgtttatacgagtactctgctgttttggttattatagccttgtagtataatttgaagtcaggcaatgtgatacctgcagcttcattctttttgcttaggatttctttggctattcagactgttttggttccatatgaattttagaattattttttctacttctgtgaagaatgctgttggcaaattgataggaattgtgttgaatctgtagattgttttgggcagtatggtcattttaatgatattgattcttccaatctatgagtatgggatgttttttcatttgtttgtgtcatctcaatttctttcactagtgttttttaaattttccgtgtagcaatctttcacctccttgattaatgtattcctaggtatttttaatagctgttataaatgggattgatttcttcttttggttctcagcttgatcattattagtgtataaaagtggtactgatttttatacattgatttttatatactgaaactttgctgaggtcatttatcaaatctaggagtcttttgaaggagtctttagggttttctagttataaggtcatataatcagtgaacagcaataatttgacttcctttcttccaatttgaatgcctttttttttttctcttgcctgattgctctggttaggacttgcataggagtggtgaaagtatacatccttatcttgttccagtttttagagggaatgctttcaacatttccctgttcagtatgatgttggctatgagtttgtcatatatgacttttattattttgaagcatattctttgtatgtctagtttgttgagggttttttttttttttttttttgagacagtgtctcactctgtcgcccaggctggagtgcagtggcacgatctcagctcactgcaagctccacctcctgggttcaggccattctcctgcctcagcctcctgagtagctgggactacaggcgcccgccaccacgcctggctaattttttgcattttttagtagagacagggtttcacatgttagccaggatggtcttgatctcctgacctcatgatccacccgtctcagcctcccaaagtgctgggattacaggctgttgagggttttaaaggatttttagatttttaaaattcactgaagaaaaatgaaattcccttcaggtattattatcaaaaataaaacttcatttacccttttgtcattttttagtggcatgaattcagacttttgccagaatagggccccttcttatatagacagatgaaaaaaaatctattatcattctttgtgaaaattcaatgaactagatatatagttcttttcttaatagagcagaaatagtaagtaaccctttagatgtgtgactggcaaacattgaaagactgtcaattatacacatccttacttgggcatgtagttttgaggtatttgcaattttacatcttttttcaggctaaaccaaacggaaaacaaaacaaaactcttctatttcacataagaaaagtctgaaacagaagaaataatcttggactgtggaaatataaattcaaaatgatgaaaattttttcaaacaaataagaaattaaaaattatgacttttaattaaggctgagttttccaaaagcatagtcttacagatgagtatgatacatatgttaaattgtttctgctaaacctttagtcattaataaaatattcttgcatttttttctggtcaggttccattttgtttacaaataggtttttgagggtggtatgcctcaattataggagcagatttattatgataaatactgagatcagaaagcatgtgcaactgcatcatagagtgattacatctaggcattattgccagccaagtttgataaatatgcccaataagtataattgttctctgtgtcagcccttgttgaaggaatactcacagcaatggtgataccgctatcatagctaccattaaattactcattgtgagtggttgtcccgctttcctcaggttttcttccaccagctgtgacagcttcttgatctgtccccaggtgggtggctgtgttcgacaggtgttgcttgtgacagttggggtcctcctcagcgtcagtctcgacatggctgcaaccgaggggtcctcgggatcctcccagaatctcttcctcggcatctggcttatgaaaaagtttcaggtgtcttgatggtatccaaattggctgttgattttggcctggagaaacacaagcataacgtctactccaagttattattttacctatttcccaactttttgttatcagatctccccaccaaatcagttgttctgcttctctttgcagctggtttctgtagatgctgttcagctgctgataacatctggcctttgggcaggctcaaaaaatttagttaataatgccagattcagttgtatctgcagtgttccatattctctatttccccctttctgcttttgcaactgctcttttaaggaaagattcattctttccactatggcttgtccttgagaattgtatgggataccagcaatgtgtttaatattccacatggagaaaaatgtagctagagcttggctagtatagcctggggcattatctgttttagtagaggctggaatgcccatcaccacaaaacactgcaaaaggtgatgtttaacacaggcagagactcttctgattggcatgtagcccaaagtgaaaaaaggtgtccacacatacatgtgcatatgctagtctcccaaatgagagaatatgtgtgacatccgtttgccaaagagagttaggttccaatcctcgaggattaactcctcctgtaaaagatgaagaatgtaccatttggtaagttgggcatcactggataatatttttagcttctttccaggtaatgctgtatctgcatttgagaccagaggcattaacatgggttaaattgtgaaagtgtctagcattagatattgcattagcaactaggtgatcagccatttgattcccttcagtcaaaggtcctggaagaggtatatgagccctaatgtgagtgatgtaaaaagggtgcattctacttctaactgctgtttgcaattgggtaaataaagtcatcggttgttcatctgtatgaaattgtaactgagcattttcaattaactgtgtggaatgaaccacatatgaagaatcagaaatcacattaataggcatagcaaaagcagtcaatacctcaattacagctacaagctccgctttttgagctgaagtatagggtgtctggaaaactttacttttcgatccagaataagaagctttaccattactagacccatctgtgaaacaatgaaaatacttagcaggctgcaggttgtttactgcaggaattgtaaatgcaaaccgttcacattcttgctcagctaaggggatagtaaagaaacggtcttttaaatctatgactattaaaggccaatttttaggaattatagcaggagaaggcaatcctggctgtaatgctcccataggttgtataactgaactgatgactgttaaatcagttaacattctccatttacctgattttttcttaattacgaaaactgcagaattccaaggcgaaaatgttggagctatgtgcccattttctaattgttcagtaactaattcctctaacgcctccagtttctctttacttagcggccattgttctatccaaattggcttatctgttaatcattttaaaggtataggttctggacgcttaacaatggccgccatcaagaatgatatcctaatatttggtgggaacatcgtctttccacttgaagcggtactttcaaagcttgcaaatttttttctagtcccataccagggacataccccatttcatgcattatatgttgactttaagggctatataattgttctggaattagaacttgtgctccccattgctgtaataaatctcttccccataaatttataggtacagaaattataattggttgaatagtcccaggttgtccatcgggcccttcacaatgcaaaatataactactttgatatacatcaggggctttaccaactccaactatgttaaattgagcaggttgaattggccacgcagacagccagtgctgtagagaaatgattgaaatgtccactcctgtatctaccaaacctttaaatttctttccctgaatagttatttcacaggtaggacgtttatcagtaatttgatttacccaataagcagctttgccttgtttatttgtgcttccaaatcctcctgttcgtttaattttactttttccgattcccacatacggcacaatcaggagctgtgccatgtgctctcctggctctgccttccagggaacagaagtagatataacaatttgaatttccccattgtaatctgagtcagtgactcctgtatgtatttgtacccgttttaaacttaaactagacctttctaaaagtaatcctattgtccccgctggcaaggatccacagactcctgttgggaccttttgtgggggttccccaggcagaaggctcacagcttttgtgcagcataaatctactgcggcactaccggctgtggtgggggacagatattgtacaggggtgagggaatggcctgagctggaaatgccccagtttagaacagcgcccaggatgggcccctcatggcttttcccaaaatcgggttcccatctttatcaaacctagagtgacactgcttagcccaatgttttccttttttacattttagacatatttcaggctcagcagttttcttttttcccttatctggcggcctgacttgctgattttttctacattcttttttagtatgaccatgcttcccacagttaaaacaagccccaggaaatgagtatttcctttatccactctcagtcctgccattgcctgtgccaacaaagtagctttatgcagattacctccaataccatcacaggccttgatataatcaactaaatgtgctttcctgaatttaaaaggaaaaggctcaaatgtagctataatatttccctgctgatctgggggctgtattctaacagggaactgccaagcctctaaatcaccctctcttctagcttgctgaattcctacctgaatagaactaagagtggtcgctcgaggcactgctcgaacagacactggggcaactacttttcacccagtgtcctccggaaaagaaagatctggagggtcaggccactctttttcttcaaaataataatgagggggtgcagaagggtagggatgaacctctccctccttttccactttagttttagctggcaaataagcctggtctgtaacctcttctgtacttcattatactctccttcctcctcctcatcagtgtgaaaaagttccaaggtggaatgaaccagaccccacacttgtcccattgttaccctgatgcttctgagctccccttcttactcaccatggggattgctttaagagtactcgggtgtcctccagctagttccatgttctccaaccattgctccagtgacccttcaacctggattcaagcccccatgatggatgccacttgctgagaccagctcggttggggagaccctaactcagtggcactagaggaattaaagacacacacacagaaatatagaggtgtgaagaaggaaatcagggatctcatagccttcagagctgagagccctgaacagagatttacccacgtatttatcaacagcaagccagtcattagcattgtttctatattaaattaactaaaagtatcccttatgggaaatgaagggatgggctgaattaaaggaataagttgggctagttaacagcagcaggagcatgtccttaaggcacagattgctcatgctattgtttgtggcttaagaatacctttaagcagttttcggccctgggagggccaggtgttccttgccctcattctggtaaacccacaaccttccagcgtgggcgttacggccatcatgaacatgtcacagtgctgcagagattttgtttatggctagttttggggccagtttatggccagattttggggggcctgtttccaacacctatcacttttgtctgcatcaaaatcacttgaagcattcattacaacacagattactgggccctgcccccaaagtttctgattcagtaggtctgagggagggtctgagaatttgcatttttagcaagttcccagatgtgctgagtctacaaaaatgaaaccttacttgtcccttttgtctactgatgcacagggttctgctcccagaaggccctctgctcttaaagtcttaaaattcttaataattttatcttttgatgtatgctttgtaagtaaagaccaatgagacaatggagcatgcaccaggggcttgaagcctctgctcatgagcagtctgcctcccacctacctctcacccaggcgatgacttagtttgttgggagagaggcattccactttcactttccactgcttttggggcctggagtatacatagaggtggtcggggtcaggcacatgcctggtgacattttggggcatggaagcagccatccttatcctgagttggtagtacttggtgactctagcatgtgatcggccaaccagaggccatgtctcagattgagagtcttaaccagtcctgttccaggtagctagcacttcctagcaaacagttttaaagactttctgggagtcacccctcttctatggtttgaggtggcaggatggggtcttattgctgtaaagaggagaaacttagcagccatcagactcaaatgtacttaagtaactgaagtcatgtggtgagaccctcagatgcctgtgaaagtctgcagtcatcttgcaagcattctcaagctgcaagagatatccccatacctaagaatgtgctccctcaggtctggtctggacttgaatgaccctgtcttccaccttccaaccttcctgagactgactggtttgtctcttctggccaactccctgtgaataatcatttcatagctctggagactagctattgtgtttttgctacagttcaaaatagaggttaaatgttcttatatagaatattatgaataataaaaaaagttaactttcctttacatagaacataaatagcaaatataaaaacactaaagagatagaccacagaagaaagaaaaaagctttataatttgcaaccttcaatggtacctcttctcccaattttttttttatatgttttgctcatttatatgaaatccaagagcaggcagtattaacatatgacagaataaatgagagcaatggttgccccctgagaggctgcctggctgcatgtgttcagtatgcgggttcacaggcagtatatgcattgctctgttcatttttcaaataacaaatcagtttttagctgtgtgtctcccttcaaatctccactgtttcttctgaattctgtagggcaccacgattgctttcctaacctctaggagcatcccctacctactattgcaactagcacttgtggaagtcagtgtggcgattcctcagggatctagtactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagtctggattaagaaaatgtggcacatatacaccatggaatactatacagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaaggaattagatttacagtgacaaagagaatggtggaggacaatgagcacataagagatttcaaataaaaccttgaagacaaaaagtggtcagaaaagtgctagttctcccaatttttgaacaaaaagtcccccataatttgtaggcctagtgcattttcattttgtgctaggcccacaaattgtgtagctgatcttgagtatataagataaaatagaagtttaaaaatccataattaagactgaactggagtagtcaggaagttaataaatgtttattgagcacatgacatgtccagatattataataagcactgaagataaagtaatgacgaagtcatacgaagtttctgtcctcaaagagcttacattctagataggaattgagaagttccgtggaagttgagagacaattaaagtttaaacaatgtatgtaagggaaaaggaaagcaaatatctcaggctccttaagactccaactttaatataattcttcagcctcactggaaccttaatctattgatcctaccattttcattgtcattcacccccttcatgttccccctttctaactttaatttcacagtcaagctctataatgcttttctttcatgcattgtcaactctcttgcctcctttttgctttgtttgctttgtcatacttattcagcttaatctcaaacctgattaaattcaactctacctatcctatttctagacccatgtagctgaatatggctagagaaaaatacataaccacactaaagtgtctcattttaccataaatcatcactaacttcaagtgggctcttatgctgctaggtaatcatactatattttcctagtccttgcccctgcactcctggacaacaattgcatattttcttgtttatccttttggttgtgtgtgtatgtgtgtgtgttttgttttgttttggtatagatgaggtctcactctgtcacccaggctgtagtgcaatggtgcaatcatagctcactgtcgccctgaactactagactcaaacgatcctcccatctcagccacctgagtagctgggactacaggcatgccatcatgcctggctaacaattacgtattttctctagtctctttaaatctccaaaacttgcttttctgtcttcaatctcagcaatcaccatgtgtcctcttttattgagaaaattgaaacaatcagataaaaacttcaacagctatcatcacatctaccaacctatctgcttgtatcttcatggcctgcatattctctcctgttacagttactaaactaagcttctaactaggtgattcatttaacagaatcattctatctcctggcctatcctaaagggaatcaaggttggaagcagggagagcagtgaagaggttaatacaatagtctggatgaaaaatggatagaggcttgtgtgaactgtgtggtagttattcactatattccacttatactctagactctgtttgtacactagactccacttatatactagactttacctgctttcacctacttaagaaagtcaatccagcaatttttcctttgtttcctttataataaatgtttttctttctactgaatcattatataaatatattgttatatcttccattaaaaaagagaaacaatgggttctaggctgtattagtcatgggcaatatagtagtgaataaaacagacaaaagtctttgccttcataaaacttactttctatggtagagatagataatatgtgtgataaataagtaattatatgggatattagacactaataagtactaaggaaaaaattagagcagaaaaggagataggaattcttggtcatttctcaggaaacatcttatttgacatatcagcaacgtattacacaggctaccattcctaccttaaaacacttcaaattctagagtgctattttcacctgattttcttcctaccttctagctattccttctcaatctctttagcttgttcctcctccatttcagtggacttaaaccagaatgccccaagactgattctttgaaacttttctctttatattgaagcactagatgaattcagccagcttcatgcctttaaatgtctgatggatcatacatttatatttatagtctggacctctccacaaattcctaacatatatccagctatttgatatccatttggatgtttagtaagtatcccaaacttaacatgttcaaacctgagctcctggtattcctctcattcctctcacacttttctacatctattaatgacaattccattcttccagtttctcaggtcaaaaacactggaatcacccttgacccccatatttctttcataccctaaatccaatttgttaacaaatcctgctggcacaacctttacaatacactcagattctgacattgctcaccatctgtactattaccacacagttcaaccaagcctctatccatttttcacgcacactaatacactaacctcttcactgctctccctgcttccagccttggttccctttaggatacacccaggaggtagggtgattctgttacatgaaagttagattacatcacttccattctcaaaatccttccatctcacgccaagtaaaagtctaggtctttaccatgtcctgaaagaaccaacatgatgtggctctactttatctctctgatcttacctcctatgaatcttcttggcattctagaaagtcaagacctataaagaatctgagattttattctacttgtaagctaataaagttaggttgccagtttcgatgctgatagaagacatgaaactcctggctcagggacaaaggataatttattattcacaacagtcatagaatatcagtattttgtgctggtttcctgaaccctaattcccacaggatgatgaaaagaagccttcccttctttattagtttgctcaggctgccataatgaaataccacagactcagtggcttaaacagcagaaatttattttctcacagttctggagactgaaactctaagttcaaggtgccagcagggcagatgtctagtgaggtctcttcctttgggttgcagatggctgccttcttgctgtgtgctcacatggcctttcctttgtgtacacatagggagggggagagagagagagagcatgtactctggtatctctttttaaaaggacactaattctatcagattagagccatacccttatgatctcatttaatcttaattatttccttaaaggctccctcttcaaatagatccatagtgggggttggggctttaacatatgattttttttacaagaggttggcaggggatgcaaacattcagtctataacactatttaaaatttatctaccttttttcaagaattcctatcttcttttctgctttttttccttagtactcattactatctaatatcccatatgattacttatttatcagacatattatctatctctaccctagaaagtaagttttatgaaggcagggacttttgtctgttttattcaccactatattgactatgactaaaatagagcctagagcacatagaatgtacttgatactgtatgtattgattgaatgaaggttgtagtcggcaaggctggtgatttgggaaagctggagtaaagtacactcctagccagtgagttcttctttaagaggaaagtcctaattaattaagatcttattattgaagcccataagtttaagcatactttgtaagtgtatttctgaagtagtagctgcttatgatttagatttacttgagttttttccagttggaaaagattaaagaaagaattctaaacgattaataatacattgtttggaaaacttaaaccctgtataaacctaatgaacagaatataatcaaagcatttatgactaaaaattaagaaacaaagcagctgttttggcaagggcagcttattgagaaattcattttgatgctgaagattgtatgcaatgagtataagtaaaatggctttcaaaatgtggatttcttgtctttttaacctactgtcagccatctctaaatcaaggatgaaaagatatacttagaaaagtctttctatggcaggtagttaggaaaatgtggttttactgaacagcaggatcaatcctaggttaattttaattaaatcattcttcagagctgttggcatttttccttcatgggagattgggagagatgttcttttatcccttaacccttaaactgcagcacctaaacctctactcccctagcctctgccgttacccttatatacatttatagatttcttagttttgaagtggatttaaaaacacaactaagatattagatcatcccaatatactcttttcaatttgataaattttaaggactttgtaagtactttctaaatgaatatacttttatctgtcacccttcccttttcaagtctctgtcacatgtacacccttgagacattatcagtctaagctaacatactttctctgcatgatgtaaaaggacaaaggaaagaaagggctaatagggtactgcttagggaagattctggaaatatccaaagatcaatagagcccaaactacctcctaagctttatagtatattgtcctccaagactggtgaaaatcacctataggcaataatctggcatacattgtcaaccttggagaatccaggtgagtaaaacccctttctgtgtaaagatgcaaaagcctacctaagagctgaaggtaattgttttgtctttttcatacaattaaaattgccaccgtgaattccagatattgaaatttcttcttgtttgattttgaagaaaaatcaagcattttctagcaaattagtctatgaaataagaaaatcaaataagattgtgtgattatttttcagttgaagttatttcaataaataaaatatgtacatttttaaaattttcttttttataaaaggactttaagggggactatatagtataatgaaagaatcgtggggtaggaatcagaaaaatctgagttctaatctaggctgtgacctaacttgctgtgtgacctggcccaactttcataatctttctgggtctgttttttcttcttttttaatataatgagagggtttgaccagttgacgtcttaagttccttttagacctaacattctatgattccaacttattataacagatgagctcacaaatctacaaattcatatacattagggcaatattatgactctataggtataaattatcacaatgtaaaactttaattccctatagatgctttagaatgaatttgacatgtcagtgatgtccaattgtttttataggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgaggtacttgccttcttataaattatctggtaatcacaacaataccagcaaggtacaatcctaaaaaatatatgtgttatgtgcagatgttatcaagaagcaaactgagattattgtttcattatgtttctggatgttttattgttcaacgatttgatgagagtttgggggttttgtgttttgttttggtttttcttttctgctaaaaatgcttggcattgtgagtgaaatatatttttaattgttttgaaggaatctaagaaaagaatgatttttcaatcattcaacaaatatttattgagcatatctcccagatgctacactaagcactggaaataaaagatgaataagctaaatagaaaagaagttaacttttacttttcctgtgtttgatacttcacccaagaaatttacatacagagtttcatttgatccttagaacttctctaggacataggaaaataaactattatttgcatcctccattttacatgtgttaataaagttacacagtttgcctgaggttgcaagtctaggaaaagtgaggccagtctgataattaaaagttatcagatacttttaaaataaaatattggtcaagagatttcattctactgttagtgaaatgaaataaaatttacgagacacaaaaataattacctaatgattttatgaattcagcaaatagctcataaacgtatactatatagaagtcactgtcatttttttaatatctcacttatttccaaaaatcattgagatgagcactgtgctaggcctgtgaaggatataaaaattagtagaacatggtcctaacccttaagaaactcactgtctaacttgggagataagatagatacacagacattataacaaaaagaaaatataaattccaacagaggaaatatgggattgaattttctagccacaaactaagttcccagagttcaaagtcacagcatagttgaacatgtattataaatgaagagttgttgggaggacagtaacatggagaggtagtttgaagcaaattgttgacgaccttgaatgtcaggctgagtttgacatttatcaattaataggaaatggggttttaagcaggtaattaaccttctctagccatgtgttaggacatacacagggagggagaagttgagataggcttttgaactgaagtggtgtctgtattgaaggcaacgaggaaacaggtgtaagggaaacttattgaatgcaaagctgattggttatgaacagtaatggaagttgttaaatctcgaggttagaagagagtttaaaggttaaaaatttttttgaacttagataacggttatgttattagcatataggaaagtcagaaggatttgaaaaagccaataaagagaaatttaataataaattgagaataaatatttgaaattttaggtgttataagccatccagcagaggtttagcaataaatttaagatttgcactcttagaaaaatatatgtggaaggtccagctttggaagtcatctatgtaaatgcatcagtaaaagttatgtcaggaaatgagataataaaaaagatagcataaaaagaaacaagaaattgactgagctgaggatagaaacttgggggtattctacgtttatgtagtgaaagaaagaataagatgcagcaaaggagattgagaagttattagaaagataggaaaggaccagaattgtataacttcattaaataaaaagagaagaatattaaaacaaaagaggttgtcaagaggtagtaaaatatagcagagaggtcaaagaatttgggtacaagaaaaaaacagtagatctcacaactggtgggatattaatgatctttgagaaagcaaatcttagcagcatggtggaaacaaaagctaattttcaaggagacaagaatagaggcagtggtatagatcagggtttagcaaattaatatccaaaacaaaatcgacctccattcccctatctgattttgtacagcctgcaagcattaagaatggtttttacatatttaatggttgaaaaaactcaaagagaagaatatttcatgatatgtgaaaattatactaattttaaatgtcaatgcccataaataaaggttttggaacacagccacacccatgtttctgtatattgactatggctgcttttgcactacagggcagagttgaatagttgcaacagagactatatagcctagagagcctaaaatatttactatcataaatatttatgggcccttttcccctggtattgattattctttcaggaaattttgtggttaaaagagagatgagacaggaaagtcgcttaagagtgaaactaggttttgagagtgtttttttttttagatagggaaaatatgagcagatttgtaggtcaagggaaagtagtaaaggagaaaattttgaataaaaataatcattttatggtctgttcattctctcatgtatttctgattcttttctatctagttccccctttctcaaactgtttttagaaatttctgataaggtcatttcaatcttgtttgaaaatgatttaactcccatacatgcctcagatttgggggggaaaaaaggtctatttgtgtatgtgtgtaaatgtgtgtatctctcacacacatacattgagtcattgataaatggtatctgtcttcctctgtcctttataaaagctgcttgacatgataatggttactttgatattgtgtcatagtagaaattcttcatgtgttcctgaggatcctcaaaaataactgaaaaggaaataattttgatatgattttaataatacatatacataaagtgtagctaggaaacaatggtatgtactctgctctatggtttaaagaaatgaatcctacaaattagcatgcacctggcctcattcattttcccatactgagtatattcccaggatctttccagaccctatcagaaggtaactctcctgagcccagtcttctcaagtcctgggtttctgatagatatcaggtagctagccagtggttacttagatcctaagtacccagactcagaaaagcaagtttgagagtagagaggagaaatagaagaggcttatctttgtatgaattctcaaacttggctgtaagagacactttttgtgagatccacctttagttacccgacactatttctttattaaagtgtcctgcatagaagaaagtctttttttcttctgttataagagcaattgtttcctagcagttagcaactgacttgctctttctcttttcctacctgaagtgactacacctctttaattttcttttcttggcttacttgttattatacaatatagacaatgtagcacatcagaaaagtcagttggaacctcttcctcaactccaccctttaatttgactgaatctgtcatggaaatctgtttaactgggattggtttggactcatatcttaaggagcttagttaccagaagtgctataacagatcatcttttaatatctttttaagatattaggtaattctttcatcaatgaagcttttgaatccagtgtgtaatttacgtttacagcacatctcaattcagacgagccacgtatcaactgctcaatagctacatgtggttactggctaccatattggacagcacagtgcttagtccaatagcacagatttcaggtcccattttacatagtaaatttccaggtctcaaagtatagttacaaaccactttgataaaggaaatcagtatttttttcaaggtgctggttttatgatctaggacaatgtaaaatcattgtgcacacttagaatcagtataatggtttcaaaatttaattacaagtttaccttttcccttttggcattaaaggactgattaaaaggcaatgagactggttttcttcagtggtttgtaaaactggctcgaaaaacagtatccaaaaggacattctgatgaatattttagcaaaattatctgctacattaggataagcatatagccatggggtaagacaattcagatggtattcatttggatgtgcaaattctgatctattatttataacttattctcattcccttacagtcttggccatatttacttattagtcatgcctccagtgcagttgccctaagttatgggtaattttcatttcctgtgtatagagtgagtaaaggaatggggagcaaaaccacttcatttccaggcacagtgaactggacccacaacacatctctgtcagttttgccttaaagaaagacaatagaccaagtatgcagtcagacactttctagctgtggtgtttctgacatagccaaaggctgtcattgtaggaacatgtgaagtgctacaaaaagtgcccctgaaattgctggccactgcatttaatccatcaagaacatttgctaagcatctatgtgaattaaaagaactgtgcctgtgatttttatgattttatatgaaagtctagtttattggatcttaagacccatgtccaggaacaggagtcagcataaggatgctgacctctcctggctgtgcctgtgactccagagtcctgtcttactgtgacttaaagtttgatggagagaaaactgtaggatccatttctgccaggaaaccagggtcttcctgtttctaacactgagaatgggcacccagtggtctgagaacactttctgggctaacaaggtcctcacacagggctgagaaagaaagtgttccccctcctgggaagcacatgtagaagttaagagcctgaatctcttctaaaccaataattgacctctaggcacccaccatactactgctaccttcagggcagaagacactactctttgtaacccagccaccaccaaaaagggaacaaaaggaaggaaggaaggttaagccattggataatactgaatctgtttccctagtgacttagtcttagagcaagcataacatccaggttaatttttgtaagatttctccttttattatcaccctcatcatagttcccaattatctcttaaagtttaagtggtttattgacattagtatttctgataatagtttacaaactactataaacaaatttgtaaacattactatttctgatgaaaataaagttgtttctccctccaaaaaaaaaaaaaaaaaaaaaacaaaagaaaaagaaaaaaagaaagtctagtttattaccactgagccttgaagataagaagaaacaaccaggccgagtatggtggctcaagcctggccaacatggcaaaaccctgtctctactaaaaatacaaaaattagccaggtgtggtggctcacacctgtagttccagctactcaggaggctgaggcgtgagaatcacttgaacctggaaggcaagattgcagtgagctaactccactgcactccagcttgggtgacagagcaagactctgtctcaaaaaaatataaaaataaaaaaataaaaagaaacaaccataaaataatagaataaaaattactgtttttatgtaaatatctgcttctaacaacctgcatatgatatatggatttacttttttccattcagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggtaggtcaggagttacatttatgaaaaagacattggacatggttgagagaatgagaaagatgtctaaaaacaaaaatattattaggtcagacaataattatgcccttccaataacatgttttgaatatatattcttcattttgagcctaccaacttctagtatggttctaggtattgcacagaaataataagaaagagggagacaatggaaagatcattcatattaatagctaatctttttgtttattttattgtttttgcctatggagaatcttataaaagattataaactctcccctcagggtggaaaatatgtatgtaaacacaaaaatttctataccattcaaggagttcaagaactcttgaagaaaccttgtgattaagggacacacaaaataaacatatatcctgtgggttagaattgagcatttgtcttttattgtagcagtaagcatagcctagaaacaggatagatataaatgtctaaccttctgtaagaatggtcacaacattttttaaaagcatcttggacatttaactatttaacccccctcattttacaaataagaaaactaaaacatatttattataatacaggggttaagagcataagctctgaactattcgagttgtattttggctcctccatttctgtgactttgggcattttacttaacctatctgtacactctactttggagcattgttgtcagaatttagtaagaattcatataaaagactgagctcagtgcctggaatatagtatgtttttttaaataaataataataaatattactatcatcaccattgtcattctacagataattattgagtttttttctatatgcctaatacttggctagactctaggaacatgctaataaataagatacaagtccctgcctgctagtgtggagagacagaagtaaacacaatcacactactctgtggaaagtgctatatatggctgtgccagtactggggagacatataagaaggacacctgggttgatggagcagaagggaggtggtttaacccgttgactctctaacatgctttttaaaaattttgtgaccaccctcacttaaggttaaacttttacagctatcctgtttctagtctatgcctactgctacaatcagagacaaatgcccaattctaacccactggatatatatttattttgtgtgtcccttaatcaaaagaagttagagaaggattatgggcacaactgacttccaaatggtaaacaggagttatccagttgactgaatggttgggcatgaaaaaggtaagatactttagacagaagtagtggcatgcaaaagcctcacggctaaggaaactgccaaaaaagtgcagaattgggagtggaggtgttgtgctggagaattagtcgagtagatcttgcagccccttgtaagctacctaaggaatctattatagcatttatcccaagggcagtggtcattaaaaagttttagcagatttgtttattaaaataaatattctggttatagtatggcagttggttttcaggaagcataaggatggagaaaagttagcagattcaatagccataaagtgtaatcaactggatttagggttattagataataggagtggaaaggaaggaattagtcatttctcggtttctggcttggggaaccaaatagatgatgttgccatttccaaagagaagggcttcaggaggaagagcacaggtctcagtagaggtaaagggagatgatgcaattaaaatcatactggaagttcataggaaaccaatattaggtcacagatctcctgactcagtctaagttcctttctccacactgatggttcttcaactttggtctgctttagaaaaagctggggagcaaggtctggtaaaaatgtagataacgagagtacatctatgtagagtctgatttcatatatgtggaatgcagcctggatatctgcatttctaacaagcatttctctagtcattgtaaagctcaccaaatattgaaaacaaatgtacttcaccctatacagtagctgcctattttgactcgtttaaattatctttaatcattttatagttttgtactcctacaaaaatagatccaaccttccacataccaccaaagctgtcctatttcatagggcagtctatgcttggttcagggaagggtaccaggataaaaaagaagctatagtgactgaaaaaggatcagaagtctagtggtaattattgagcacagatggaaattaatcctagggtagctatattagcttcccatgctttgatggaaggaagaagagaagaggataaaggaaaattttagaatgtttgttactatagaaggggaggaacaaaagaaatgccagagggagaactgtgagcacagcaaaaatcaccatgaaaatatatgaaaagcagactgttttttcatgatgtgtcctactatatcacagtgttacctttttgtatattaattgattttttagttgttctaatgcttttttctgtgaatttgatgcaggacatgctaggagatttgtttactcccatagagacaccagaagctcaaaacagaggctttctcaagggactgtttggtggaagcggacaaacatttgacagagaagagctctgtgagtaaattcctgattatagaaatgtattgcaaaatagaagacgtttctgtgtatgtgtatttgtgtgtgtaacttaatgtaatatgtgatctcaaattctagactacgtattttttgcatctatcttaaagtttgaatatttgtttccttctgtaccataaaaatcatttccatttaccaacatggaaagtggtcacttcatattaggaaattgtttaacaaaagtgatacatataattcatacaaataatgagcaagctaataaatatctcatttgcaagtagatcatacctgcatggcaatgtgaaggtattcaaaaaagtctggaaaaaagatttttgaatctgcttgactttaatcactgctggaaaacagattccttattcagaatgtaagatttataaatcctacagaataaattactttaaaaatctaccagtgagactttgataaacaaaatcaaaaagtattattgtttatcaaagtctcactggtagatttttatttatttatttatttatttatttatttatttattatttatttatttatttgagacagagtcttgctctgttgcccaggctggagtgcagtggcctgatctaggctcactgaaacctctgcctcccgggttcaagcgattctcctgcctcagcctcccaagtagctgggattataggcgcccaccatgcctggctaatttttgcatttttagtagagacgaggttttgctatgttggctaggttggtcttggactcctgacctcaggtgatctgcccacctcaccctcccaaagtgctggaattacaggcatgagccaccacacccagcctcactggtagatttttaaataataggaagatactagggaaaattttcagagagaaggtatgaatatattttccagaatatcctaccatcatttggtcctatagatcaaaattctctttctctggaacttttatgcaaaaacatctaggttccttcatacaatagaatattatttggccatgaaaaggaatgacgtactgatacatggtacaacatggataaaccttgaaaacatcttgctaagtgaaagaagccagacaaaaaaaaggccacatattgtatgattccatttatataaaaggtctagaatgggcaaattcagaaagactgaaagtagattaatgattgccaggggctgaggcacagaaggaacagggagagactgccaatgagcatggagtttctttttggagttatgtgtatgttctgcaatcagatagtggtgatggtcgtacaactttgtgaatacactaaaaacaagtgaattttgcactttaaatggataaatgttatgtgaattatatctcaataaggctattattttaaaaaaattagattccatccactcttattttaaaaaaaatctagaatccattccaatattacatccttgggaattctaactaaatttctgccaaaatagctgtttttttttccttaaaaataaaaataaaaataaaaaaagaatctcacttggctgcccaggctttagagtaaagtggcacaatcatagcccactgcaaccttcacctccctggttcaagagattctcgtgcctcagcctcccgagtagctgggactacaggcacatgtcaccactcccggctaattttgtacttttggtagagacagggtttcaccatgttggccaggctggtctggaactcctgacctcaggtgatctgcccacttcagcctcccaaagtgttgggattacaggcgtgagccaccgtgcccagccacaaatttttaacatatgtaacttatatgggtaaatgttatgtttgttttataaatcaattttttaacacacataaccatcattcatatattcatataccccatttttcagtatttacagagagagagagagacagaaagagagagaaagagaacctgtggcctacaaaggcttatacatgaaggtgaaccaagaaggctgaaataaaaactcaggcagaaatttaagcaaatgatcaggcctaagcttggaacaaacattaatatgggttaaatatgaagtcacatatttgaatattccaattcagcatcaagaaatgcaattatgccatattgtatggaacacacacacatacaaaaggcctatgataacaatatatctcacagtctctttcttagcatttttcttaagtgctaacatctccaaatacatatatgactggaccaaataagactctcttttaatgagaattatgacagtagaatgtaatactagtactttgtcttggtgacaagcttgactgtttgaattactgacaaaatgttttaaattgctattgcatatattctcagttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgaggtaaactgcctaagtaaatacagacatcttcatacaggagtaactttaaacatttaggatctgcacaagaaagcttaaacagagatccacataagtaatcctgtatgagaatcatggtaacctagatctcttctaagtattataattctcccagtgcttgggagataaaaggttttttaaaaaaatactttaatgtatcgatacttctttaccttaggggataattaaagaaattatccattggttctgatacatctgggatccacatcctccattttgtctcagtcatgaaaaatcattttctatcagctgagtctttacagcttgtttatttttaaaatctttctcatatgcactttatttcacaaaataaaagaagccactcagtttgattataagttttgagatagatttgcatgattagctcaaaatggccttgctttgaatagcacttttaaagtattttagcgtcttatggtggctattttttctttgcagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacacaatcagtttcatttctatcaccttcagaatgggttgctgtttttagcacaaaccatgcagggttgggtcacctcaaagcattttcttcagcctggcttgtactctataggggagttggtagtaggtgtggggaatctataggaacaatagagttagctatgagaactgacttcacaaaaagggaaatttcacacaccccaatttcagcttctaaagtgatatattttaaaagcttcatttgtatccttgtctgccagttacacagtatattactgttcaaacccagtagggtctgcaatcgaaaggtgctcttgcagcctgacattcacaaaccaaactggtcattctctttagtgtgattcagtaaaatctcagttaatgttttgggaaagggattctgatttatgacatttctgatttacaagggctttccttagaaaatacctttcggtttgatacttaccactggaaattggttcgatacttaccactggaaatctttataaaatatagtgatctgtttgctatcttggtctcagtcatcattatagacaatagaaatacataaagagtttaatgatacaaaatcaatgcttttgtccctaggtcaaataatataagccactagattatgtcaatagatgccaaacacttgtcccttattaaagactcttttaaagctggaataaagaatatccttaacatgatacaaggtatctataactcaccagaaaagcaccagagtcaaaaccaaatagagacacctactaccatttaacatgattctggaagtcaaaagttataggaatgtatatatacacattccaggacccatcctgtaatatgttgtttcgtcaagaaaagttttaattatggttttggcttattgaatttttgtttatcaaggtctcattggatttacatttgtgtttcttaagacttcacaattttcctggatttcaggttattttattagccaaaaaatcgtatttttatttcctttttagtctaattttttgctagaagttgtactttctagcaaatgtttctagtggtacaatgttctcagtaattttgaggagaacaaagatgagtgaaagagttagataatgtacactaggatagcatttctcagagtccttgaatcctcttgttaagaaagcctctctgaatctcccagactcctgtgaacagccttacggtaacagaatctggcttggaaacacagacattacatgactgtataatttatagaattataaaattatatggtaaaaatattaaagaaacttaagagtaggatctagaaaatactagtggccaaattgcaatgtattctttgtaccatctgtttcaaagacttagttttctgattttcagaacaaatactttatcgtttctgtattttaaaaaaaactaaaagagtaaaatattagtttattttagaaataatgaaattcagtccaaagtagcagtacatttgatgagtatttctgaagccttcaataagatttaacttgttttaacttgatctacatcgagatttctcaaaagcagcactattagctgaaagtctttgttgtggggaactgtcctgtgtattgtaggatgttagcaacatccctggcctctgtctactagatgccagtaagaacctcctagtaatgacaatcaaaatgtctccagtcattgccaaaatttctcccagttcacagccactattctacatcatacaaagaggtagattgtgtgaatatgtaatatatgttgttgtataaaactgtacaataagtatacaatgtcttagcaagataaattattatacccaaaattacatgtgtggttcatatgcaataagatacaattttgaagaaagcttataggaatcagtgaaaaataacaactacagaatattttaaggcacacagagaaaatatcaaaaaggacattatagcatttcactgtagaagtgcttaaaaccttggcctcagtgaatagatcaaaagtttataattagcacaccaattggaagtaaacaggtgcttctcaaatgcttgaaaagaaaaggctctttgaagtagttaaaacgtgtctttcaaaattgcttttataagcccttccttaacgtaagggtaacttcatctcacaaactcctggttagtggaatccaaattaatgaggttttactgtatcaaaattatttttataattcaaagagatgatagcaataagaagaatctaatgtggatgtgatttttctctttgaacaattctgttctgttgcactgaccttagcacgcacgcacacacacacacaccatcgccaccactaccatcatcatcttatcctcatctttggaaaataagtactgttgatccatgtaatcctttgcatagtctcatctttactatctttcttctatttcggaacataagaaaaatactcctaataacttggacaatgatacagaaagtgactctgagccttagttaccatcaaaattacattctatctgctaaagcgacatcagaagataaggcttgcaaaccacagtcccaacaagttgaccttgtctccctatgatttccttggaagataaggcctttttagtgttacagtagaaaatgggccttttcatttattcatctgtgagaagctagaggtatttgtttccctgataataacgtgagcaatagtccctaccttgaaatcatccattagtcttggagtttggagggaggaatgattgattcctcatttgttttaatcacctacaaaagcagtactactgactttgcttcttacacttcactgagccccagactttagggccccaatcattgtcaagatcattgtctaactggaactctgaaaggacagtgacagaactgaatgagatgttttccagtgattcagtcacaaagacaattttctcagatcttttgaaagtgattctcaaataaataaatcaaaatccaactcctttccctcaaagtttctagggatctgaaggaaaaggtttactgttggagtccctttttatgtgacccatgtaccagttttaaaggcatcatctatactttatctacatgaagggatcaccatgactttgagagaaaaaagaatcagattaggcctaacattggttgaagaagattaaaatagattcttatattcaagcagaagggaaaaatgaagccaatctagaaaagtaagctaaaaatcctctccttggcttaggatcattgggtcaaactgggagtatatctgtgtgattacaacctgctgctatgagaaaaaagaattgtaacttgaccatgttggctcacacagggcaatgcaaaagaagtcaaaacattcatatcaggtcttggtatctgtgtcaggagaaacgtggtggctttcacagcttcttcacctctgtcctctgtcatgcaactccatttttggctaggtactatttcacatgcacactgtcctgggtgccagaaatacttgtggtgtacttggtttgagcagtacctctagtatgcaccattccagggaacatggttgtcaacataacaagtttagtgtgtgtatttgcagacaacatagccctgaaagcatgaaatgtagaataggtaaggtctgtcttagaaaaggaggaggaagtaccaatttggtgcaagaagatcgtggtgaggaaggacatgggagccacagtgaagtgaaagaggctttaaggaatcagatgcacagatggatgctttgatttacacatttatctagaggagtgattctcaaccttgactgtacataagaatcacctcaggaaatttttaaattcccaattatattaaaatcatttggagtgggaaccagacaccaatatttgcgaaagcctccaaggcggttctaatgtccagccaaagttgattatcactgctttatggccaactaaggaaaccttgtttgtctgccttggctggtgctccagccccagttctgagtggtcagggaaggcaagatgtaagatatagtaatggtatttattctgtatgtctcacagaacaaaagcatttgagaatttctgaccaggcagtgctccatcaactcttaataatcatctttgtgatattctcctatgtgacttgtccatcaattattccaattcaaaggtctaggttttttttcaattgtcttacacatgtgacatcacaagataccagaagtagcacagtaaattcaagagcatataaagctaagtggaaaactaattcttcatatttagacagtggaaattctcaaaacaatcatttgctaaattaggtccaaatttattattcattcttcttctggaggagacatgggtaccaggtacctgttctgctgtaggtatatttcactggacttggtcttagcaaaaaggaagaacaaatcttcctttttgattgttatctcaatcaaaagctcccagggccacttggatttattttcttagtctttggacatgtgtttaaaggaaaagaatacctgtaacttcctatatgacatccagtgccctgaaagggtgcttacaccttcaaaaaaggagagtccagcctatcaaaggcagtaacacataatgagaagaaactcagagttattgcctttcatactgctttccctctgctgttggcccacccttcttgactgcaaagccagaaaataaactagatggtggttttggacaattgtacacaggaacagaatctctaataacctataatttttagtacttaattatgtgatgttttattctaggaaataagaaacagatgacatcattgatgtatctttctttcatcttcagaatttttgcatcttttcagaaaatgacaaattactatttttctgttgcactcagcaattgtgactatacttaacaaaattcttgtagtctgtagagatatcaataaaattgtatatgtttgtacata

SEQ ID NO: 803 - DNA, 325489 bp, Homo sapiens
gtcagagctttgggggaatttattgagagcaggttttgcgtaccaaaagggtgttgggcttgcatctgtcattggcaggtgtcactgctggtggtctctttactgccatcagttggtcggccagactgcaacaaccacgatagccacaagcagcagtaaaatcaccatgatcatccctggaaaaaagcagcagaaaatactacttttaatgattcctaccagaaaagcatcacacattctgagtgtctgcagagactcagagggatgtagttccctctgagccttcagtttgtacgaagtggagagaggtggtcggtggcctggggcgccgctgctgctacacagctctggctttgcaggatgctgagtgcagaaggcaggggcctgggtgtggccaggcccccccaggcagcactcaagccaggagggggtgaggcccctaactctagcatctgtgtacaccttggaccacaagggagggcgcaagctgctgacgacagccaccctcactacccaatcagattatgcattgatgacgcattgataaagcaaagggcttaggagagcattctagaacccatttctccattctccacatggcttcactttgtgttcttgagtccaagatccttaagtcacccatttgtaaaaatattcaccgatagaggtgcttgttttgatatatactttttctgctagtatttgctagtttcatttcctgacgtttttggctggagagcacaggccctcctagccagcccatgctgggtgccactctgccttccagccccgccctgcctcctctgggtcgtgtgtctgcactgaccattgcctgttccttcacctgatgctgatgaagtgggccccacagaatgcagccctcacttagtgcaatgagctcactgtctcccatgttcgcttgcccagtatttaacgagtgtttaccacgtgccaggtaccagcggcgacaaggtatagcataacagagaaggggcgccctactacaaagtaagcactcaagaaaggtttgctcactgaagagtccttgagctgccaaggccccacgagagaggtgggtagcagaggaggagaggtccatgaaaatgcttcagaaagtaacagggagagccacgtgtgcagggtcacatggttgcacagccatcaggactgctgaacgccacggtagtctgtggcatatgttcgtgagcaaagaaaatgctaaatttcaattagacatttgtgaacataagagtccaatttgctttccggtccaagttcacgggcttcccgaatcccctccacagatcctcagggttcaatgtggatcaggccataccaatcttaagctcaacccatgtgggcactgcaccatggttttgaatattgaagagacttaaaaatgtatggcaagtggctgggtgcagtggctcacacctgtaatcccagcactttgggaggccaaggcgggcggatcatctgaggtcaggagttcgagaccagcctgaccaacatggtgaaaccccatctctattaaaaatatatttaaaaaaataggccgggcacggtgcctcatgcctgtaatcccagcactttgggaggccgaggcgggcagatcatctgaggtcaggagttcgagaccagcctggctaacatggtgaaaccccgtctctactaaaaatatatttaaaaaattggccgggcgcagtggctcacgcctgtaatcccagcactttgggaggccgaggcgggcggaccatgaggtcaggagatcgagaccatcctggctaacatggtgaaaccccatctctactaaaagtacaaaaaattagcctggcgtggtggcaggcgcctgtagtcccacctacttgggaggctgaggcaggagaatggcgtgaacccgggaggcggagcttgcagtgagccgagattgcgccactgcactccaaactgggcaacagagcaagactctgtctcaaaaaaaaaaaaaatattagccaggtgtggtggtgggtgcctgtaatcccagctacttgggaggctaaggcaagagaatcgtttgaacacgggaggcggaggttgcagtgagctgagatcacaccactgcaatacagcctgtgcaacaacagtgaaactctgtctcaaaaaaaaaaaaaaaagaaaacgaaaataaaaaaaaaaactagggcaagcttctttgtcatctacctgtgactgtggttgcatttttctgatatgggctctttctctgatgatccaatcttttgagaaacgcttctcttggggccccaaggtttctcccccgtcttcctgtagatgaaaacctcatcctagtctacctcaaggctctgccaactttggttcatgggccaaatctagctgtgctctgtttttgtgcaacccatgagctaacaatggtttttatatttgtagagggttgtcaaaaaggtaaaaggaggagatgtgacaccgtctgtggtctgcacagcctaaaccgtttacgacctggcctcttccagaggcttgctagctcctgctctccatcatcatgatgatgacccacctgcagcatcagttcgcccacttaggcgctggccttcaatgcgctcttcatttctttcatctagggatttcctttcttccttgtaaattcagccctgcattaacatttgtgggtgggtggagttacactattttacctcacatttcaagatgcttgcagcaagaaggcaggggtaggggtgtgtgtgtgtgtgtgtgtgtgtgtgtgtgtgtgtgaatatcttagtccatctgcagtgagaaggtagggatacgggtgtgtgtgtgtatgcgtatgtgtgtgtatgtgagaatatcttagtccatcttcttgccagaagcagaagaacaaatcttttcactgatttctgctccagaaacatcttcaggttgaccaaaagctcccctgggcaggagcttcactagttcttggttattctggtgcctgtgtggtgatcagctgaagacttggtcctggctgggtgaaggtttatgttgcgcaacatgaggagaagataacgagaatgaggaggcaggcacaggctgggatggggcgaaggggcaatccctggcactccagggcctgggctcaccctaagatgacagggaggggctggcagctgaggagatgagggagaggatgagaggtgttttaggaagaggtactgctcctgaagctccagtgggatcacagttgggaggacacttgggcccagaagctccatgcatcaaggcaggctccacactgaggctctgatggcctggagcagaggccagtatgaatgaccgtgaattgtcaaatcagggtgattatgagaagagcggagcaagtgacaagaacaaagaaatcaagaacaacaactgattgggaagaagaaaacacacatctggttttggttcatacacccggagcgtgaggtccaagggaagaggcctcaaggcatgcgcagtcactgccatccctgatttggctccctgcagtgagggactgctttccccggtccctgctccacgatggaactacagcaagcttttcagaatgtaaaggagatcaggtcacctccttgcttaaatcctccagtggctgaaactgagatccaaactttacagtggccaagggggtcttgcacagtctgacccagcaaccctgcagccgcactctgcgcgctgtgtttgagccatcctggctgtctccggtgcccccaacaggctgatgcagaaggtaggggccctgcctcccagcttcgacacgcgctatcctttccatccgggagctccccactcgtggtctagttaatccctcaaactcagtggcattttcccaaagaactctttgtcatcctccagttacctgtgccctctttgcccccctaagtttccatggtaactcttattaaatcttttttttttttgagatggagtctcgcgcccaggctagagtgcggtgacgtgatcttggctcactgcagcctccgcctcctgggttcaagcaattctcctgctttagcctcccaagtagcggggattacaggtgcccaccactatgcccggctaatttttgtatttttagtagagacagggtttcaccatgttggccaggctggtctcgaactcctgacctcaagtgatttgccctcctgggcctcccaaagtgctgggattacaggcgtgagccaccgcgcccggccttgaatcattatttaggtactcagttactgtctgtctctcctggacacatgaacatctacaccagggactgtgggttctcgttcaccgccatatcccccgtacctagaacagagcctggcacaggaaagaggcacacacacacgcgcacgtgtgtgcatgtgtgtgtgtgtgtataaaacaaatgagtaaatgtattgaatttttggaagggataagaagagtcaagagaggcatagaaggagtggtcagcagagagggagaagctgagaaaatgtggcaagaaggccaatgagtaagaaaattcaaaaagtggccaatgccaacccacaatactacagagacaagatagaagaatgctcttccacagaagagctgcagagacctttcatagtacagttttagcgcatggtgggtgggtctagtggaactattattaatacagtggtggctaagctgctaatttttctaccacagatgctgtgaattagacaaactgtgccccaggaaaggcatgacagggcacacattatctataaaaaatgaaaatgggccaggcgctgtggctcacgcctgtaatcccagcactttgggaggccaaggcgggcggatcatctgaggtcaggagtttgagaccagcctggccaacacagagaaaccacgtctctactaaaaatacaaaaattaaccgggcatggtggtgcacgcttgtagtcccagctacttgggaggctgaggcaggagaatcacttgaactcgggaggcggaggttgtggtgaactgagattgtgccactgcactccagcctgggcaacagagcaagactccatctcaaaataaataaataaataaataaataaatatataaataaataaataaataaataaataaatgaaaatgaacttgagtgatggacatcttggacagtaagctgataagatgtgataaactgggttcttgtcccaagatgaaaaggaggattttaggagccatgacaaataaggcttttatattttaaaccctttcagagcaaacagggggagactttaaacaggcttaagtaaactggtatatactgagggtcaactgaggaggtcgttttaagatggcaggtgacagcgataagcaaaagccaactgctgtcttttggattctttgggtcaaagagaaggtgtttatctaccttagcacggcaatcctttttctttaagaagtttggctttcttcgaatgtgatcccagctctggcacctttctgaatggagtttctctcctctgaaggatgtttcggaatgagtaagcagggatctttttgaagccagggaaagctgagccacaccgttcatgaaacagtcatgcgtgccaggtttggcactaagtgctatgggtgtattacttggtttaattctgcacagtaagtaaccctcatctctgttttatatctgaggaagctggggttctggaaggtgaactctcctacctaaggccctctggcgggtaagaggaagaactagaattggaatccaggtgggtaggacccctctgcccacacgctcacccttgtctacaccagtggagcttgagtggaggcatcctgattcgagacagtgtgggggtccctcggggagagaggctcagactcactggggttgaaacaccgggatcaagagtttcttctcttttcatcctcttctctttctccctccctccttcccttccttaacgttttatgatggaaaattttaaacatatacaaaagcagaccgaagggcacgcagaacagtgatgagcccatccgtcagctttcgcaaggatccattcatggcctgtctggctttatgcaaaccctcacctgctccctgtctcctgcatattattttgaaacaaattccagacataggtcatctacaaatatttcagtaagtatcactaaaaggcaccattaaaaagacacacacactcccccactacccacataaccacagagggtctgacggttcctaaaggcagaggcagggaagagctggcaactcttctgatgtaggaaggtggctccagtttcaggggcgcagccgacccccctgccggagggacatgggacctcacatcgtactcggtcacgtgtgaaaagcagaacttccttcttctgcctcagaatagttcttaaacctcaggggggtctactcatccattcccccagctaaggaaatgtttgacatttcagaacaaggaaagacagttgaacttctgggaggctgccaacttcttaaacaatgaatgctctctgcccccaaccctagcacagaacacctgctgcggctcctgacttcgggatcgtttctctgcgcttcactcagctcctgccctgggcccgctggcacctggcgaggcagattttcccttccaatactcaagagtccctttcaggggcaggcatgggatgccagggttacaagagtggaaaaaaatgtccatttcctttggtcagtttaccagatgagtattactcaaccacttacaatatttacaagtccagctcatggcaattaaaaaaagatgtaagaaaacaaactccttttcaaactgggagaggatattaaacacagtctctcaggaatggtgttttctgaagactcgtcatctggagtcatggtccatacttttttccagtgaaacactggaaacgagcaaaatacggagcttgtgctgccaacgcccctgccacaagttgggtgtaggtaacagctctcagtgcttactgacatggaggaggaggggaaggaggagaaagaatctggaggctgacttttcgagagagtgtggatctctgtgttggccacttctgccctgtagctgcaggggaacgtggcaagtaggctgatgggaaagcaagaggcagggaggggtgaagggcgctttatccaggagtctttttatctggttttgttgcaaggaaagccgccttagctgcctactactattttggttgtcttgaaccaaaacacatattctggccaggcgtggtgacttatgcctgtaaccccagcactttgggaggccaaggcgagtggatcacctgaggtcaggagattgagaccagcctggccagcatggccaaaccccgtctctactaaaaaatgcaaaaattagccgggcgtgatggcaggtgcctgtaatcccagctacttgggaggctgaggctggagaatcacttgaacccgggaggaggaggttgcggtgagctgagattgcgccactgcactccaacctgggtgacagagcgagattttgtttaaaacaaaaacaaaaacaaaaaaagcatattctttttgtttgcctcgcttttcacaccagaagagttaggccaactggcaacccacacgtagctactaaacttaaagatgaacagaggacacttcttagggacaattcctaaagtttgttttatttttttggcagttgtgcctgtcaataggtgacatttgcttatgtattaaccagtgatcagtctcactgttcaaacagacttttcacggcagactcctgagctgaggtggggaataagcaggagaagagacaaaactggaatatttatcttcaaaagttcatgtaaatgttccctttaatcccacgactgggcaaatacacgaagaaaagagtagacgccgtgcagagaaggtgagcgtatttacattctgatttccagattgagaggctggagaatggtggctatgcttgaggtctctgcccagacctgcccactccaggggctgtgtgtgctctgctgggggacccagagtgtgacactagcagccttcctacagccgctgctcagctgcgccaggggaaaccaggcactgggggtgtggagaggaggacctacctgcctctgatcacacccctcttgaatctatcttaccccacagttctacattttaatttccgccgaataatgctttcattaaaacactgggcaaaagtcatctctggttttctgagtttgttttgttcttagcctggcatccaactcaactctgcaggtttttctttctctgtattgtgggccaggcttcctctgtggctccagggggttgcatctgactcatcaatggagtctctgcccgctcccctctgagtgtagcctcagcccattttccacccgccccagggcagggccgaagccttgaaggctcatcctctgtatttcatgtcctccatgaagactgctcagcccgtacacagccagcttgtcctggaatccgagggtatctgcagcaaggccattgctcttaaatgactcccttccacctttggttctttttttattaataattccttcctcaggccatagaatctccaaaaacagatcaatgcagtctggtgcggtggaaggggtactgattttacagtcaagaagacctgacttctaatctgccactggtatactatgacacgttgggaaagtttaactctggagctcagttctaccatctctgaaacaagactgaaaaatcctgacttcacaggcttgttgtgaggatttcggaagatacagtacatgaaacttctagaacataactggcactcaataaatggtaactctcccaacaataattattactcctcgtaataattacaccctgcctgaaacgggtgcctagtggtcgcaggtgctccgtaaatgtcctgcaacagagccagtctctcagcttaacaacagaaatcaaatgtcactctctccaaaagagaaggaagagtagcaaaaacagaggaacacctgggtggcatttagtgtagaaacagagggagcaattctctccgaggcccggcggtgatgagggcgtccgggaaaggttggaagttcagggtggaatgtctggcagcctctgtgtcagttattagctacaggaagggcagctgtgctgggcggaatgctggcggcggtcagcaggcaggcagaacacagccaagtggacaccaggtgagaggaactgtgaaaggcccagactttttaaaagccagtgaggaagtggaggtcagagcaggggtcacaggacggggtcacaggcaggaggaggagaaggttaaagcaaaccacaaggagcacccgactttataacacattcagctacgcgggagaaaaggtggagaggaacccaggggcccctaggggagcctgtgcgtctggccatgctgcataaataacaataataataatgacgatgaaaataatagtcatagtgtccgggcatggtggctaacgcctgtaatcccagcactttgggaggtcacggcgggtggattgcatgagcccaggagttcaagactagcccgggcaacatggtggaaacctgtctctaatttaaattttaaaaaagaaaaagaataatattaatagtagtagtgtcacaagaacagaagtcaagaataaagcctgggcaacaatgcgagatcccacctctacaaagagtatttttaaattagctggctgtggtgatgtgtggctgtaatcccagctactcgggaggctgtggtgggaggactgctggagcccaggagttcgaggctgcagtgagctgtgattgcaccactgcacctcagcctgggtgacagagtgagaccctgtctcttaaaagaaaagtcaagaaggccgggcgcggtggctcacacctgtaatcccagcaatttgggaggccaaggcgggcggatcccctgaggccgggagtttgagaccagccgggccaacatggtgaaaccctgtctctactaaaaatacaaaaattagccaggcgtggtggtgcacgcctgtaatcccacctactcaggaggctgaggcaggaaaattgcttcaactcgggaggcggaggttgcagtgagccgagatcgtgccactgcactctagcctgggcaacagagtgagactccgtctcagaaaaacaaacaaacaaacaaacaaacaaacaactgtggtcttttggggtggctctttagagtggccaggccagtgtcccccatgtgcctgggtgggtttgtgctgaggcaacactgggaagagagaggcacctggcaccctcctcaccctggaaactcagccctctccccagaaggccaggcccctacctggagagaattcactcccagcctgagctggtgcccagcaccgggctgatgaggcactgctctgcaggaacacagaaacgtggaaagaatcaactggaaagaaggcagcaactgtcggaaaagagaacggtgtgaagagagacatctgggggccagagggagcaagagaatcaggagaaggtggcctggaaggggtgggggttgggatgagagaaaaaaaggactggtctagaagcaggaaattaaaaggaatgaagactgcaggtgacggggcagagagctggacggcagcctagtgaaaggcaggttcctgggatctggggtctaggatccaggcatgagcacctggctgggcgtcaggtggccgtggagcagcagtcacggccacaggactctggtgaggccgccgcttggtcagtggagaccgcatgtgagacctcacggcccggccagggcgagtcaggtcagagtggctggtgaggctgtcccagtgctgaatagcagcactgccctggtaagatttacccaagagacttagactcacccacactagaactgatctcttatctgttgagtgcctactgtgtgtcgggtccaatgggtgcaaagacgtatacctggctcttcctgggtctgcgggtctcatgagaaaggcagaaaaatcaaccctatctctacccacgcccaacacaaacacgaaactctgcagatgatagccgttccttagagggagtgtgtaaaaactctgccgctattgtcgcttcctgcacagaaagtgctgaatagtttgtaggccccatctgtgttcttaaggtgttattcatttcccttccctgaaataagctcagctcagcaactgccacaagtcaagggcagaattcaattgtaaatagataatccttcatatcagccaccaagagcagcaggttaggagttgtcaagccaataatttaatgccaattctctggcacgtcaatatttgctaagaaatatcccttcattgtgctgtgtgttacccctgggaatgtgaatctgtctggagtctggcagaaattcaagtgtctttgaaaagacagtcaggaactctgttacggatatcttgttttgacaattccctcttgactgtcggaagattcctgcaaggttccagtcaggctgtggattcggcattacaaacccctccgtttgtcctatttggatactttacctggcaccaattagggacacctggcagggcgacaccagggtattactaccaaagttctacaaaggcagggcagagaggcatcgctgctaccataaggctttgtcaatacaccaaatgcttatctcatttgttaaaaggaaatcatttgaccaacacgcaaaagactatggggtagatctgaattgagccctgcgttccatacatcgaaacaacatattcctggggtggcccagtagccgtgtctgttcaacttaaccctgcctccatacgcacagctgatgcaacagacctcaagtgaggccaacaaggttctcttctccagggattttggattttgaactgagcacaattggggttcagtcacagtaatggtaacactcgaggggtgggccacaaacttagctcgggaggtcccaggccctgcctttgctcagacttgtctttatacttggttggctcaatcatccctcgggttcctgcaaataactcaacatcactcaaataaattacatgttttttgtttctttgttttttggtgttttttgttttttttgttttgttttgtttttttgttttttttgagacagagtcttgctctgtcgccaggctagagtgcagtggcgagatctcggctcactgcagcctccgcctcccaggttcaagcaattctcctgcctcagcctcccgagtagctgggactacaggtgcgtgccaacatgcccggctaatttttgtatttttagtagacacagggtttcaccatgttggccaggatggtcttgatctccagatcttgtgatccacctgcctcccaaagtggtaggatacaggcatgagccaccacgctcggccacaaattacatgttttttaacctaaacgagccaaagtcatctctgcttatttgcaaccaagatcttttagcagagtgatcagcaaaaatcaccagttgtgtctagttaattggaaaaacataaaagtcatattagcatgcttttgctttactactttagtcttgaaaggatagtcccaagatgttgcctctgaggacaccccgtctgggttgcatctccttactctgaaggggctaaagtcccaacagaaatatctgttgactgcactccagcctgggtgacagagtgagatcctgtctctaaaaaataagcaaaaagggacgggtgcgtgcggtggctcacacctgtaatcccagcactttgggaggctgaggagggtggattacctgaggtcgggagttcgagaccagcctgaccaaaatggagaaaccccatcctctactaaaaatacaaaaaaattagccgggcatggtggcacatgcctgtaatcccagctacttgggaggctgaggcaggagatcgcttgaacctgggaggcggaggttgcagtgagccgagatcgcgccattgcactccagcctgggtaacaagaatgaaactccgtctcatatggaattctaatataagtagtatctaatgactagcttttttcacttaatttgtcttaaatgtctttcacagagacctacctttaatctttttagtggctgcagactattttataccttaatttgttcaaaagataccctgttactagactttgaggttatttcaaaatttttgctatgaaaaggaatgctgcagtaaacatctttgaacataaacctttgtgcacgtgtacacgaatttctgtaggatagattcctacatatggaatcctggggcaaagagtatgtgcattttttattttgatagtctcgctaattgtattttctgacggcatttctctctcccaaaccacatactcttcatatgatgtgactttgacattgctctcatcaagaggtaggacctgggtcccctccccttgaacctgataagccctttgtgactacctcaccaacagaatatggcagaagtgacactctgtgactttcgactctgggtcataaagattacacacccttccaccttgctccttcaggatagtcaccatgtgagtagttcaactgctagaaggctgccatgctgcaaggaagcccaattagtccaaatggagagaccacatggaaggaccctgagatcatgagaagacagagaaaagagatgcccagccagccccactgggttccagcttcaccactatactgactatattacaactgcatgaaaatcttcagccagagccaggcagcagagcccttttcaaattcctaacccacagaattgtgaagtgtagcaaaacaattgttttacattgccaaatttggggtgatcttttaccttttttgagacagggtcttactctgtcgcccaggctggagtgcagtggcatggtcacggctcactgtagcctccaccttctgagctcaagtgatccccccacgtcagcctcctgagaagatgggaccacatgtgcatgccaccatacttggataatttttaaattttgtgtagagatgaggtctccctgtgttcccagggctggtctcaaactcctgggctcaagcaatcctccctcctcgacctcccaaagttctgtgattacaggcatgagccactgcacccagcctgattttttaaacacagcaatagataaccagaatgggtaggttctgccaaactgcaaacaacaattctcagtagtaatataagaacaagaaggcaaatccttttctgggcatttctagtgaactagtaatgcttcatgtggttttaaattttcaagtagaaaaagcatttaaaacaatatgcatatatcatagtaacttcggaaagtaaagaagatgagaaaagaaaggccaggtgcagtggctcacgcctgtaatcccagtactttgggaggctgaggtgggaggatctcttgggcccaggagtttgagaccagcctaggctccatagggagacctcatctctacaaaaaaaataagaataaaattacctaggtgtgatggcacacacctgtggtcccaggtactcaggaggctaaggtgggaggatcacttgagttcaggaggtagaggttacagtgagccatgattgtgccactgcactccagcctgggtgagagaacaagacccagtctgaaaagaaaaaaaaaaaaaaaaaaaagctgtcaccttcccaaattccaaacttttctctttcacggtcacatatcctattattttacaagcaatctttgattaatactatagatgtcctaaagagtcaaagtgaatatgagatgggctccagttccagggcaagaggtttctggggcccagattggggcaggagagctcaccctcttgaaacaaagctaacaagaacactctggatggggcacgctagtcgcttagagccttcccactggggatccctcctttcctgggcacactgtgtatgggcccactgggggcctggctcaggcaggtcccgggcaaatgcacattgcccctgccaccacagtgcttctaacaagagccatgcccggcaccattactggcgctaggcacttgctatccactttgtatacattatatacgttacacattgagcagctcaatacacgtttactcaacaaatgaaacagaaggtcctcactcctgacgtggttgggaaagcagaaataacactgatatcctctgtgtcctgcatctctgttgtggcttttgatttaacacatgttgcctgagcacctgccaggcactgttctaggcactggggctgcaacaatgaaccaaacagacaaaaagctctgccctcaccaaactgacgtcctagtgtgtgtttgttgggggcgctggaggggggcttcagtgtgtgaagacagacaaaaacccagatcagtaactaatgtagtggactagaaggcggtaagtgctagaaagaaaatccagctcctcttcccctattgcttatcatacggggtggctgaaaggcacacaccccctttccctcgagtcctagggataccagggagggagtgctgatatggtccataaaccagacatcctagagtgggatttggaaacattgcgggtaagactagggtgccttcctacacgccatcaggaaactgccatccttaaacgttaataagatgtaggcttagaaataacacattacaaaagttggttggaatgaagggtgacgtaatgacaactggaaacacagaggggtgttattatggagtggagaaaaaggagattggagaggaagaagttggcagtgggtgccagcactttccagaacaggggtgccccagccagcgcaccggagcctgcttggtctgtgaggacatggggtcctttctgaagtgagaagcagtgagccacctcctggacagcagctcttcctcagatggcccttctggactattctatgcccagatgagaagtgtgcttctgaaactgatgacgcttgcctgtattagcggccgttttacttcagcgccgtgctggctgagagctgcaaagtgttggccaccagctggtggctgaaatcaagaggaagccaggtcacggtggtggaagtaggatgaaatagtagacacacgatgtcaccaagagtgtagaagaattcaggtaaatgcatttccagtaaggtgggatcactagtgccgcttctggtgctctgggtggagagccactctgtcatcctggaggctactttggcccccaactcatctccacattcctctggcctccaaggtgacatggactatatataaccaagggccacggtggggagggcagaagaaatatgactgtttaagggcagtgggagaaaagaaaaataaggggctgatgagagagcggccagacgtgggccttttgctttcagccaagtcttttcccaagtaaccacaacatttgtcatagttattcagtgtggctctgaagcctgtcccctttgtcggggcagaaaaaatgggctctcctgtgttcaaaaggtcatctctactttcaagtggtcaacattccgcagtctgaagctccctggcccactagcttccagtactgtgtgtcacttcccacgtatgcggcaaaatgacagagtgtgtgaaagggtgaacgcgtgtgtgagttcagggtttccctctttggaagctgtatggcataagagctgaaacaccatgggctgcgagggcagactgcacgtgttcagaccatggcactgtcatttgagtaagggacccaatcctctatgccgaaaagtgggagaataataaccctccactctcagagccatcatggagacaaaaagagagaaaatgctgagtgccaagcatactacccggcttatggtaccttctcaactgagattagctactagtctcacctgctggaaattgttcttgctaccaacgtggcattcctgatctccaatctttggatagaaagcgctatgacccttccccatgtgtgatggccttcagtgctcaatgctgcccatatcccccgtgttgtgtgacaccacagcacgagtgagacctctgagctgaacgcagcagcctcctgccatcgggcgcaactactctcagtacaaccaaacatggctgccaggcttttcttgaaaaccttctctagctcactctacagactctatcatgaaaacagactttgagatttatgcactcaaaaaatcctccaacagcctgtatacctatatgtataaaaatgcttaaattcaccaggcacagtggctcatgcctgtaatcccagcactttgggagccagaggcaggtggatcatctgaggtcaggagttcaagaccagcatggccaacatggtgaaatcccatctctactaaaaatacgaaagaattagctgggcgtggtggtgggtgcctgtaatctcagctgctcaggaggctgaggcaggagaatcacttgaacccgggaggcggaggttgcagtgagctgagatcgtgccattgcactccagcctggggaacaagagtgaaactctgcctaaaaagaaaaaaaaaaaaaaaaaagcttaaattaagagcatttcaatgaaaggccattcagatttgttctcacggaagggatatgcatcttctacccagaccctcccatatgctctcctctctaggccttggaaccctaatttaaggatattgctgcagtgagatgcttaatggcagaactagggcgcaaccaactcagcacactggtcaactgctaacctttcactaggagcaacacgagagcctcagagttgtgagccctgtgggcaccatgaagattggtggagtaagaacaaaaaaaaaaaaaaagagagagagagagacttcaaagttgctctacactggatcgtggaaaaggagcctcttaccaaaagtggcagcggggcttagagtttgatctaggaaatacacaagagcaaaggggcagtcaggctgcagagctctgaccccgagcacatggtatgcaaacaggagtattcacactctgcagtgcaagagcctgtccttcatcttgggggatgaggccgcagtgatgtccccccgattcagtactatccccaaacaattcaccaccctaaagacgtcctcctgtgaacagcagattatctgaggatccctaaaagtggtccttcacatagggaggctgccattttcggagttggctgttagtgtggcagcaaacagctggcattcctaagtaaaaactcagagccagaactggtgctcttcaaccccgactcagctctgagacacagacctgcaggcaatgtgggcagattcaacaatgtcactactgagcctactgaaaacaagtggacaagatcccaagccatcaattctagaacatggttggcgtaaaagctgttgtgcatggattctatcagcaagaaggatcagtagaagtatttgaggccaggccgggtgcagtggctcacgcctgtaatcccagcactttgggaggctgaggcgggcggatcatgaagtcagcagatcgagaccatcctggctaaaacggtgaaaccccgtctctactaaaaatacaaaaaattagctgggcatggtggcgggcgcctgtagtcccagctactcgggaggctgaggcaggagaatggcgtgaacccgggaggcagagcttgcagtgagccgagattgcgccactgcactccagcctgggcgatagagcaagactccgtctcaaaaaaaaaaaaaaaaagaagtatttgaggcccaaggagtcactgtggcagagtggaaagactgggaaatgattgcatctggagcgtcacttctgaggataaggtgattggggtacacgtccttctcctctccctttcccttaagacgctccagcgtaagggcttaaacagaccctcaagacaccgtcctggaaagaggcagattgatggccacagctgagtgtcagaggttacatattagcatgttcaagcctataccagggacgtgtgtatcacatgccatgcaaagaacacaaaatatctgcccttccaatgtctgctgctagtgcaaataataaaaggtgtttgaggataatattaaaatgatgtcatcaccttctgcttatccactcttctggaaaaaagtaagatagacaacccaaaaggtcagatttggctttgcaatattggctggcttatattaaacatggtctgtcagagatttcagaagtcatttcaaagcaacattaaaaagttgaattatgacacattcctaacgaaatgatccagttttcccaccttggcctcccactccgagcatgccacactctctcacacctctgtgccttggcagggatcgttcacactgctttggggccctctgccagcttctctgcacccagcacaccagcactagctttaggcctcagcttgaaaacacccgctcctcagggacacctcctcccccatgcccagggtaatcctaggattgcttttctatgctgcttctgtatactaaacacatgcggtacagaaattaacatgttatttggttaaactaacaattaattggattcatgatttaccttccccgatggcccataaattctttggggttaaataacaggccgtgtgtttccaatgtctgtgtctcctctcgtgcctagcacagagctcacataatacatatgcaacatatatttatgtttttgttgattggatagcagctcatagcttagactcaaatatcttaatacctggaatatgagcagtcagcagtaggaatttcaaaggactttcttttttcttttctttttgagatggagtctcgctctgtcgccaaggctggagtgcagtggcgcgatctcagctcactgcaagcaccgccgtctcctgggttcacgccattctcctccctcagcctcccaagtagctgggactacaggtgcccgccaccacgcccggctaattttttttttttgtattttttagtagagacagggtctcaccatgttagccaggaatggtctgatctcctgaccttgtgatctgcccacctcggcctcccaaagtgctgggattacaggcgtgagcaaccgtgcccagtctcaaaggactttcttacttgatggtagttaacatgggaatattccagcagctagaacagtacttggcacatagtaagtgctcagtaaatatgtgttaaagaaatgaatgaatgagtgaagaaatgaacgaatgaaagcatacaaattatcaatagaataggtaatcaaggagtagtggttttaaagaactgtaaagcattccagtaaagtaagtccagttggtattgctaaattcaaaatcaatatattctccattagtgatatgaatttaaaattctaggagaatatgttctgtatttactttgcaattaaatgaacagagttgcattgtagtgaaatgatgggattttaccagatgctcatgggttcctatcacagatgattttagactcacaatttcagacaactgggcccattttgtattgaatcaaatcgcctcagttcatgtttcattcattccttgtaactttttgtcaccctctattgggagacattctcaagacattaccaaaaatcacctaacgacagaaatgtttgtgtttacagcatggcaactcacagtgtgacgtgggaccaggagcacagatcactgaagagactgttagaaatgcaacttcaggctggacgtagtggctcatgcctgtaatcccaaaactttgggaggccgaagcgggcggatcacttgaggtcatgagtttgagaccagcctggccaacatggtgaaacttcgtctctactaaaaatacaaaaattagctgggcgtgatggcatgtgcctgtaatcccaattactcaggtggctgaaggatgagaatcgcttgaacccaggaagcggacgttgcagtgagccgagatgcgcctttgcactctagcctgggtgacagagtgagaccctgtctcaaaaaagaaagaaatgcggccgggcgtggtggctcacgcctgtaatcccagcactttgggaggccgaagtgggtggatcacgaagtcaagagatcgagaccatcctggccaacagggtgaaaccccatctgtactaaaaatacaaaaattagatgggcgtggtagcacgcacctgtagtcccagctactcgggaggctgaggcaggagaatcacttgaactggggaggcagaggttgcagtgagccaagattgtgccactgcactccagcctggctatagagcaagactccatctcaaaaaaaaaaaaaaaaaaaagaaagaaagaaattcaacttcaagggtcctacctagaaacctgttttaacaagcctccatgtgactcctctggtgctgaagaaattcttcacaccatacaataaaatatcatctgttaccatgatagaagaaaccgtggctttctctggcgactataagtacggataatgggccagggctccctagctggaaggaaagtcactgtcctgggggcaaagcaggtacccagtgactgtccctgctgatgatgcaccccgagaagtggagcaggctgggatgtgtttgacacaaagccctcttgctgtcctaatccacacccacgccaatatccctcagcctcatttcctcttgacaaagacggttctgttctgagggggtgtgtgggaccaacagcagcagctggggtggccaaatgaccgctcttgcttagaatagagagggattcaaagaatgatctctgccagattgccgggctttgctgtgtcacatcaggctgacacagatggccttggccactaaggacgctgccttcttcctcacagaagcccgaggaaatgccctgagaaggaacaaggaccagataactacccggcagggagtggctggtaggatttcagcttgaaatgtgatctctggatgcccatgagccagtgtggcatttatttccaccgcatcaggggtcccaaccttggataacatttatatttctagagcacctgaagaacaaagattccagattgtaaggtgcaaaataagtcacaagggggtgccttctcactcacacacagctagccacagctgtctgccatcccagagcgtaccccgaagctagcgcgccagcgagctagttttaaagcacagacaacctctccattgctggctttcttcgaacaccgtgggtgaggaaatgagacagagaatgtctaatgattagttccttatggtccttacattcttgaagtatattctttacgcccgctggaacacttctgcattcttgatagcatgattgcaatataagttctttcccttctgagcactgtcttttattgacacactaaaatatcctaggagcaggatgggtcttcccaccttcctcacgcccctctttccccactgccacactctccgcgccattccttgttctctttctaagaacgcaataaacatttcagcacaatcttttcaatccacattatttataatattccgaacatccatcgagcctggctagaatgcgaagcaataaatcaaacttaacaacaacaaagaaggaagggggaaaaccgccctttggcgaggcgaaagcctgagacgtttcattccccgaagggtttagttatgttaggaaaagtgagatggggatgagacccgaggtttagaatgacatagaggcaggaactggaatctataggcataatcataactttgtataaacctcaaacaaacttacctctctggggtgtcatgaggataaatgagatacgtgggaagcactccgagtgcctcgaacgagagcaactggagcccaattctcctttttgggtccaaaaggtcatctttcttggaagggagagggctaagagctcccccaactccctgagcgccagtctttgctaattaacatcccctctgcaggtttaactaagatgggggtgagcctggaagcagggcctcgaggtagggctgctaggtcctggacccagtctccacccccagcagggacccctctccccactgccagcgaggaccacgccaggccacacacagccaggggtgtccctgcagaatgattcagctcctgccgggggtgggaagtagagctcgtcccacatcctttcctcatggcgctacgcaggttaacactgtctgactttgtcttcgcaaagaaagaatctagctccacagtttgctgatgatttcaaaatttatctaaacgaatgtggaggccagtacaggctattggctaattgcagaattggcttgaggcctttctgccttggcgatttcccacgcattcccgtctcacgttggaaatccaagctgtttgggagtgggcgtgtgtttgcgtggcaggcctcaatgcagcggctctgttgctgtctagtctaacatgctctgccgtctgctctcagtggtcccttctgacagtttcctggatataaaggggtgcttcttttccagtcttgttgaatggtactgaatataagattagaataactgaatcacaatccacattttagtcattacagtctcatgttagctctggggaaatgaccataaccggtacttactcatgagaattttctaccaaaaagtcagacaagaaagtcattttcttatgaaaagtgtcaaatgtgccacctactctggctttgccatccctcccctctgcatgttaacctcacttggtcttcttaaggtacagataatgccttcctgcccagatctgttacctgcttgctggcttgggtggaggttagatctcaaccactgttctggaaaggatttgatcatcagcttggctttgttcataacttcctgcagtaaaaaaaagtcttcaaaaaacccaaattcacgagtgatatagacatttgtttaaacaaagtcttcaggccgggcgcggtggctcccagcactttgggaggctgtaatcccagcactttgggaggctgaggcgggcggatcacaaggtcaggagatcgagaccatcctggctaacacggtgagaccctgtctctactaaaaatacaaaaaattaaccgggcgtgttggtgggcacctgtagtcccagctacttgggaggctaaggcaggagaatggtgtgaaccccggaggcagagcttgcagtgagccgagattgcaccactgcactccagcctgggcaacagtgtgagactctgtctcaaaaataataataataataataataataataataataataaacaaagtcttcaaaaatacaacaatttcttttttcttttttttttttttttttgagacggagtctcgctctgtcaccaggctggagtgcagtggcgtgatctcagctcactgcaacctccacctcccaggttcaagcaattctcctgcttcagcctcccaagtagctgggactacaggcatgcaccaccatgcctggctaatttttgtatttttagtagagatggggtttcaccatgttggccaagctggtctcagactcctgacctcaagtaatccgcccgccttggcctcccaaagtgcagggattacaggcatgagccaccgcgcctggcccaacaatttctttatgatgtctctaagtcacagaaaccaacaaaatcatcattacttgactgttcaagttaagggtctctttacaacttccacttcttttgcttctgatgacgcaaccatcctcttgagctccggcctcccagggctgagtggttcacccagacctctggggtcccttccttggtatatttccactttcactccaagcgtccatgggaacttctttcctttgtctattacctcctaggtggagctcttctgccttcctattttcccccatcgcctctaagtaaagggctggcttcactgacgcagggagacatcgctgctctctgtctctcctttagtgccttctccctggtcaatggagttccactattcccacccttacctatttacatacaccagcaacttctctttacttagaggtgtaagtctgctggagagcagactgtctagctactgaacttcccatctgtgtgatcatgagccagccatttaacccatctggacctcacctataagatggggataacaggttgggcgcagtggctcatgcctgtgatcccagcactttgagaggccaaggtgggtggatcatgaggtcaagagtttgagatcagcctgaccaacatggagaaaccccgtctctagtaaaaatacaaaaattagccgggcatggtggctcatgcctgtaatcccagctactcgggaggctgaggcaggagaatcatttgaacccgggaagcagaggatgtagtgagccaagatcgtgccactgcactccagcctggtcaacagagtgagactctgcctcaaaaaaagaaaaaaaagaaaaaaaaaaagggcgggggataacagtagcgtatatataatgtgctgcaataatgtcaatgacacagtaaatgctcaataaacactcacttatcttattattaaggcttttccagtcatgcttcatggtgtgcctacagccccttcaaatgggatctttttagatcagagctctggctgaggtgtgagtcaaggtggctgcggtttctatctaccccctgatcccacccatcaagccatagggccctgggcatgcagggcaagttcagccgatccacaggctggccagcagcccctgagtgattttggtccagtacatgcaactgagctggataaggattattttctctgaagttggactaggaaataaggagtgatgcaggcttaccaagtctgccttggttcctaacgaagggaacatgtttctttaaagtaaccccatctttttttgtggaaatgtgagtgattctgtttcattttttccccaaccaaaagatgtcccaaagaacaaaagtttaattaatatatatcccaggctacagatgtatgtgctttaaacgagggacagattttgactcaaggaatacatttctaattgtaaaattttgggtcatcagcaagatgactgaaaggatctccatcacttccgaaattagaacttttaggccactgttgagatatctaagacatcaacaaaattagttttttgtcagcttttcttgtttttgtttgtttatttgtttgttttttttttttggttgttgtttttgagatggagtctcgctctgttacccaggctggagtgcagtggcacgatctcagctcactgcaacctctacctcctggattcaagccattctcctgcctcagcctcctgagtagctgggattacaggtgcccaccaccacgctcggctaatttttttgtgtttttagtagagacggggtttcactatgttgggcaggctggtctcgaactcctgatctcgtgatccgcccgcctcggcctcccaaagtgctgggattacaggtgtgagccactgcactcagccaccttttctttttttaaagagacgagatcttgctatgttgcccaggctggagtgcagtggctattcacaagtgtgatcattaacacacgacaaccttgaactcttgggctcaaacgatcctcctgcctcagcctctggagtagctgggactacaggtgcataccactgtgcctagccagaatcaccttttaacatccatggctatttcaaatctagagtttacagcgtcagtaggtttaatgcggatgaacatcttcatgacttaaaaatgagtaaggaacacatccttttctggttaacttccttgtcactctggagaatgtccctaccgctatttctcaaatgagaggacctgaagttctctggagcacggggtgtggatggaggtataagagaagggatagctggaaatgatagtgggtgaaggttagtgagggcagggtctcaatgagtgagggcagggtctcaatgagtgaaggcagggtctcaatggctcatgaaggcatctaggctgaatacacagaagccagtcagcctccatctgcttctacccaactctgtaccaggtaccatgttaggttctgggaatacaacaagggtcaagatagacatgatacctgtgcctgaggaattgacaggctaatgggggagtcagacattcaaacaaccacacaataaaatgattacaaatcatagagaagcattaagaaggaaataaacaagatgttatgacaacagttactttaatggggtggtcagatatggctttctgatgaggtgatctgttgagatctaaaagtaaataaagctgggtgaagaccatgccagccaaagccaggcagagtgggaagcacagagcagctagggattcatggaatggaaagaaacccactgtggttagaactggccagtgaggagagaaatcaaggtaaatttggtgagagtgtcagggctaagtcctgcagggccctagaagccatggtaaggagttggattttatcctaagtacaagggaagcaagtgaagggtttaagcagggagcggcaatatctcctttaggttagacagtcatttatgtcacagtgtggagactggaccggagggtatggtgtccaggtccaagtaaagccaacaagacctctttgagagaactatcccagcatctgggtaagagggtgacatgaaatggggtggtggcagtggagacagagggattgaaacatactttagggccggatgcagtggcttacgcctgtaatcccagcactttgggaggccgaggcaggtggatcacctgaggtcgcgagtttgaaaccagcctgaccaacatagagaaaaccccgtctctactaaaaatacaaaattagccgggcacggcagcacatgcctgttaatcccagctactcgggaggctgagacaggagaatcgcttgaacccgggaggcggaggttgcgatgagctgagatcacgccatttcactcctgcctgggcaacaagagtgaaattccatctcagaaaaaaaaaaaaaatagaaacatactttagaatgccacagcttctttttggataagcaagggcggctatagtgagaggagaggaggaaacaaaatttctaccttgaataactgggtcaatggcatgctatttattgagacagaaaactaggggtaggtggcgttctggatatgctgcagagggatttaagctgacatatcaaaaagttcttggatatgcagtataatggagctcagaagagagatcttgggcagtggcagtgatggtgacaggttgagagcccaaagaagagaggagagaggaaagatcacggggaggcggagagcaggggagggagatcgggcagggtgggtgcagggggtaccgtgagtatgggagcttctaagacttgggcccagagctgctaaaggggcactggaagggaggactctggctctgtcactatctgatgaggacagcagcagagtgactacagcaagcatttacagagagtctattgcacatcaagcactgtactcttgatcttccatacccctctctaatccccatcatcacactgtaaactggtgttactattattgtcattattattctgtgtgtgtgttttttgttttttgttttttttttttgagatggggtttcactcttgttgcccaggctggagttcagtggcacaatctcggctcattgcaacctcccgggttcaagcaattttcctgcctcagcctcccaagtatttgggattacaggcacccgccaccacgcctggctaattttgtatttttagtagagacagggtttcaccatgttggccaggctggtctcgaactcctgacctcaggtgatccacccacctcgaattccttacctcaggtgatccacccaccttagcctcccagtgttgggattataggcgtgagccactacagctggccatcatcattattattaatgaacctgacgctcagaagcattaagcaatttacctaaggtttcagagcttttcagtgttgggcctgggatttgaacccagctttgactaagtttatcatcagagttgactaactcgaacatatagtcataacaataaagttaaggttgtacagaagtagaaaaagacctaagataccagtaacacagcttccaaaccatcttctctgctttcacagccaggtgcccagctctagactagactatgatggacttctcactgtcttccctgctacagaacatccccagaagcaacaggtctccctcatgctgccaacaacaaccctcttcttcactgtgacaagcctgaccccatctgttttttggttttcctcttcaagaactgcaggagacaaaattattatttgcagataatgagaacacctaacgtggaaataacaaaataatccacagaaaacccttttgaactaaagaaaaaaggatagcttaaaatacatcaatagattccaactcctttctcataaggcagttaaaatcaatcagaaaatataacagggtgtgatggcttacatctgtaatcccagcacttcggtggatcacttgagcccaggcatttgagaccagcctgggcaacacagtgaaacctcatttctataaaaaatacaaaaatcagccaggcgtggtggtgcacgcctctagtcccagctactgcgaggcaggggtgggagaattgctcgagcctggctggtcaaggcagcagtgagctgagatcatgccactgcactccagcgtaggagacacagtgagtaagatcctatctcaaaaaaaagaaaaaaagaaaatcaatgaaaaaagtgtattaataactgatgaacggccgggcacagtggctcacgcctgtaatcccagatctttgggagaccaaggcgggtggatcacttaaagtcaggagaccagcctgactgacatcgtcaaaccccgttgctattaaaactacaaaattagccgggtgtggtggcgggcgcctgtaatcccagctacttgggaggctgagacaggagaattacttgaacctgggaggctgaggttgcagtgagccaagatcgcaccattgcgctccagctggggaaacaagagcaaaactccatctcaaaaaagaaacaaaattttaaaaactaatgaacagagaacaaaggaatgaacaaaaatggacagaacgactttttgaaaattccacaagtttactgaggaaccgtaaaagaaaatatgaacaaagacagatccataccatatttctggatgggaagactcagagctgtgtgcctgtcagttctctccatgttaatataaacatttaactcaaatagcaacaggatctttcaggaacctgccaaattactgtgaggcaactaggactattctcaatctgcaggcaaggaaactaaggcttagacaggttaagaaagcacaatctgtcgtaaggaaattgatgtggaggcacagtagggcacacctcagtaacaattacaaagatgttggatgcagagttgtgtgtctatgtgtgtgggccacagataagcaggagagtggattgcacagggccctaggtgtgacaaggaatctgggcaatagagaggctctgagaggtttcagcgggaagaagtaatggtggagggggagggttcacagacgcaaatctgcattttccaaagctcctcctgacttcaacgtggagaatggactagagggggcagaactggaacaggaaggcgatgcaggaagtgacaggagtgatccagaagatgacagaggctgaagtcaaggtgaggctgtgggaaggaaaagcagtgttgtggatttcatagacactcaggaggtggaattggtgaaaactggcatcggacgagatgtaggggctgagcagaagcagggatgattcctgggtatttggcctgagaaatggagtggttggtggtcttgctcattgagatagaaaacagaagaaaagcagggctggagaagatcgtgagcctagttctagaaatcttggaattgctgcgagcaagttttgacagcacgatatttggttttcttccactgggattacagagaacttgtcttttgggtagtgagccacaggggaaattttcctgtttgggtggggggctgggtgcagacccacctctactgtgagtatcctaactgtgaagcagacacagtcccttggagtgactataaaaatattaaaaggctgggcacagtggctcacgcctgtaatcccagcactttgggaggccgaggcaggtggattacctgaggttaggagtttgagaccagcctggccaacatggtgaaaccccatctctattaaaaatacaaaaatcagccaggtgtggtggcacacacctgtagtcccagctactcgggaggctgaggcaggagaatcgcttgaacctgggaagtggaggttgcagtgagctgagattgcaccactgcactccagcttgagctacagagtgagactccatctaagagctcaggtatgggtctagcatcgacagctgctggaggcctctccaccagggccctcctggggccttctccccactctcctgttggaggcctcatcagatgccacttctccatttcccccctctatctgagatttccagatggacattttatgtttttgtacatttgataaatttttgtttggtactgatgacatgttttgttttgttttgttttgagatggagtctggctctgtcacccaggctggagtgcagtggcgtgatcttggcttactgcaattttggcttcccgggttcacgccattctcctgcctcagccccccgaggagctgggactacaggcacctgccatcatgcccagctaattttttgtatttttagtagagacagggtttcaccgtgttagccaggctggtctcaaactcctgacctcaagtgattcactcgcctcagcctcccaaagtgctgggattacaggcgtgagccactgcacccggcctgatgacattttcttactataatccctcctctttgccttggtagagtacatttcttcattcattattccttccaacattacattatttgaaagtatggtaagacagggttcaacagaaaggcacgcagttggtgcaactggaagctatcctctttatgaatgaaacgttagtgtctccaggtgtccgttttcttcgcttaaaactgctggcatcatcttataactcagacttagctattcatcacggtggaaagaaaaagtcagccaatggaacataagccttcttccctacgagacactcctctggccaacctatatggccacaaagggcagaattgagattctcctgctcacctggtggccgcatgcataaccagcctaaagaaaatttctgagagaaaatatccaggcaagagctaacttgcaaatctgaatacttgaaatgagacagtcactttatggagatgaatcttttttttttttctttctttaccaaaactgaagaactgcacatgtatgtcctctaacaagtagacatctaaagacaccagcataggttgggtagaaagtcaagaagcaagagagtttacgtatttgctgtagaacctagatagggattccaggggacaagagagcccaggacacctgacaggtattcttgataggaaaaacagagcactcacaattacagatgttgtgaccctggtccaaataatatctttactctgacaaaaagctgtggacaattagaaattacttttcttaaactaaagggttttttcctttctataaatattcaaccttctgtgtttgaaatagaattctcaggcaaggagaggtggctcgcacctgtaattccagcactttaggaggctgaggtgggcggatcacaaggttaggagttcgagaccagcctggtcaacatggtgaaaccccgtctctactaaaactacaaaaattagccgggtgtggtggtgcgcgcctgtaatcccagttactcaggaggctgaggcaggagaatcactgaacctgggaggcagaggttgcagtgagccaagaccatgccattgcactccagcctgggtgacagagcgagactccatctcaaacaaacaaacaaataaaagaaatagaattctcagtgttttcatgtcactggggttaaagtataaactcaagaaaagtaccatgagaacttggaatgtggagctttcgcaatggatagaacgacattcttttcatttaataaggttgaactgtatgcatctttcaaaattaaaagcaatgttttcaataactgcatgtttccaacaaccttggtctctatggattaaattctatttcttttcatttctggaattattttattaatcaaacacaaaattattatagtctactcagaaaagtctgatggaaattgtaacctgaatcatattcgaggattttcttttgaagcagaaagccagcaattacagtactggaaaaggctgttttactgtggtgtatttcctcgggagaggaaatgatttttgagaatactgaagccttttttattctaaagtaggctagcaacacctgtacacaatctttctagacaacaataagacttttctgaggtttcatgtcatgatcgtttaatttaatagctctgagagtttaaacaggacactcatacctcagttaactggcatggtcagtgaactggggattccagttaacttaatttttccatcaactaatagtaacccatttatgcaatgaaatttcctcagcaggatacaggggatctgcacagctcttttcagatatgtacaattgtatggtttgtctctaagttttccttttttaaaaaatcagcatcttgccttgtgtaaatcttcaaattaataaaccaatgatcaactacaagacggctcaccaaaacaaataagcaaaaaaggttaggtttaactctgatcgtcttagctaaagaaaataaactacggagaaaataaaatattttcttctcaattcatacagcattcacttaaggcaatggtctgcaccctggagatacggagataaacaatacatgtttttttggacctcagaagctcacagtttacatatggataaagtaggaaagttcagaagatatgagcaatgacagttgtttaaaaaattttttttctttaaaagtgtataaagctactcttgtttttgaaaagtcaaggcaaatgaaacatactttttgaaataatcagggaaaaaaataagtttaaagtttcctctagatcttttaatcagcagaataataaggactgactttatatctagacttcgacttagcagaattagaaaacttcaaaagtcctagaaatatcacaggtaaatgggtaaaattaacctcaaaaagtttctgacttgactttctaggggccgaaacacgcaagatccttctcagttctctcccttagtcttatgttttaattaacagaggcaaagtttttcaaagtcatgggtggggcttgctttatttcctctgatggtttccagcagggaaccttggccttaggatcttaagttttctggaatactaggttccattctcccagcttcccaggccccacccccctggagattctgattcagcggttccgggagagggcccaggaatttgtatttttagtaagagcatcgtgtgattcttatcatcagggaaatctggacactatggataataacaatttgcccacgaatcacaggttgtgggtagggcttagagagaaaaacagattcccaggccccaaggctcagggaatcagcttcaggaagcctgggctcagactcaggaatctgcatttctaacaaacacctcaggcaacatctggtggacggaaacactgtctttggtgctgagccaccaaactctattctgcaggtgttggatataaaacaaccagaatcagcagaaaccagtgtagaggtccaaagtagtgataaaaaaaaaaaaaaaaaaggagaaacatctgggacatctccgtctacctgaggccctggactgctgggtgtcttcaataccacatttcctggtctgacctagatgggccttttctctaaggccggcctccagaagccagggtgaagcccagaacattacacacaatgagatgcccatctgttcctgcatggggcagatcgagggtgcctatttatccaagcctggtagtcccaaacagtgatcaccctggttaaataaatacaaaaaggcaaaacatcttttggaattgttacatgctggttatatcatgcctgaaaattgcaaatgaaactagtacatgtaccaatgcctggtcataaatgaacacattgtttactacaaattctgctgaaataaacctgtcttcacatacagttgctaaggcacttgtgcttagaaaaacaaatactttaaagacaaacaataccttcacattttcccttcaaaagtgactaatttactcaatacttctgaaaaattgtaacgaacttcttctggaatccccatattaccgcatcccacacttgccaataactatatggagcgctttggaaacgccgagggaaatagcagacttggtaaggcttaaaaaaaaaaataaggcaagatcatagatgggatgaaaaactcaacttgaatgcttccccgtgaagtcagtctacgtttgatccaaatggttgaactccaaaagcacctcagcagttcagctctcttgatttcaaacccctgcccacatggctcaaatttgcaacttaaatattcggtatgaaaacgaaagttatttaactgttagcacaggctctcttctccaaaagagagtaggaagggcatacgtttcggcccacacacatacgccgatctttgacttctaaatatcagggcacaacacacacaattattttggctttgggagacaacactgtctgttatgttggggtgggtagttacaaaaaaatattgtcttgaacactgccagagctgacgattttatgcatgtgtagtacaaacggttctttttcattttggaaagaaaaagcacttaaaaaaggtttggtagggaggctctgcagcgatatttcacctcaatacatctttcaagtttgatagcttgtaagctcacggctttggttcttgtcttcaaccttcagacaactctaagctggctacagcagctgcagaggctgagtctttaaatgaaataaagaaataattgcttcagggaacaaagggaagcaaaaaaaaaaaaaaaaaagtcctgttagctgaactatgtggccccttgggacggtgtgtggtgtgtattcctgatgaatattgttcggtgtggtaaaggaatccctgcaaaaccccagagactcagaaaaagggtggcgtggtagtagaaacagtgggcttcagaggtgtacctgggttcgagctgaggctatgccactgaccagctacgtgaccttgagcactggccctcacctctcagggtctttgcctcttgtctgtgatatgggaatgacattacctgtctcacggggctgtaaatgaggcctggaaggatgatgtatgtcatgtgttgatttcacgtgggcaaactgaatgcccttggttatctctccccgctccccaaactctactagtggggaatggtataaatatataaaccaaaagaacaggagagaaaatgacatcccatcagatacagcaacaaaatgtcaggagatggaaagcagatggataagtcatcagtgtcttacagtagatgacgatgaaacctaaacagcagatttggggtggggcaggctccatcaggttctcctgcaggtgaggctaaaaacagggggactagttaaagactatatgagggccagatgcaccccaggtccctgccaccaccgcacacaatcaggcaaactacctctcccctatcttctcaggagagatgttcacaggtgaaactggactggggagcttgaaacatgggggcaacaggcacagaagaagaaagggatatgacgagatgctggaaatagggagatgaaatcctggttttcatagggcatgagaagctggctgtcccctcttcctgtttggctcccagacaattaacagccaagtttccactcattaggggggactacagggctcctctcagcagtgatggactaaacaaagacaaaagaaatgcagatagtcctgtttgggatccccaatcaatgactaggtcctcccctgcctgataatgcttctgtgaaatctgcaattcaacagatcccacccatgcctatagaactttcatatgtctttttacattcttttttttttgttttgagatggaggctcactcggtcgccagactggagtgaagtggcacatctcggctcactgcaacctctgccttctgggttcaagtgactgtcctgcctcagcctcccaagtagctgggattacaggtgagcaccaccacgcccagctaatttggtatttttggtagagacagggtttcaccatgttggccaggatggtttcaatctcttgaccttgtgatccacccgcctcggcttcccaaagtgctgggattacaggtgtgagccaccatgcctggcctacattctttaacattaatgggtagccaagcatcactagacatttgacaaggggggggggggggagaaaagcaaaacaaacaaacaaacaaacaaaaaaaaaaaaaaccaaaaacaaaaaaccaaccttccccctgaaaaaaaaaaaaacagaaaaaggaatccaatgacaagatacaacgcaaagaacagaagaaaatgtgaaagaaacaataattacaattatcatagagataaaatatgtaatatctatgaaattagaacagaataaattaaaaaatcagaaagccttggagtgaaaaaggaagacagcagctataaagaatttcaatgggccgggcgcggtggctcacgcctgtaatcccagcactttgggaggccgagacgggtggatcacgagatcaagagatcgagaccatcctggctaacgcggtgaaaccccgtctctactaaaatgacaaaaaaattagccgggcgtggtggcaggcgcctgtagtcccagctactcgggaggctgaggcaggagaatgccgtgaacccgggaggtggagcttgcagtgagccgagatcgcgccactgcactccagcctgggtgacagagtgagactccgtctcgaaataaataaataaaataaataaataaataaataaataaataaaagaatttcaatggaagaattttaagactcacttgaagaaatgaacaaaacaaccaaaaaatgaaagacagaagagaaaataaggaaattcaaggattaaactatgaaacccaatatccaattaaggggtgcagcagaaggaaagaaaagagaaaacacaggaggtaatcatgaaagctataagaaaatgttttgagaactgaaggacatgaattttcaaactgaagcgttcacaaaatacccaacacaataacgggggtaagcggggaagttatgctaaggccttctgtgtgaaatttaggatgctgggactaaagagatgctcctaagagcaaaataggatgtacaacaaggttctggaatcagacaggcactggacttctctatggcaataccggaagctagtagtcaaggcaagatgcctccaaaatttggagtgcaaattgtttccggcctaaaattttatatgcagtcaatcaatcaacaacaagggagataataaagatagttttggacaagtactatctcaagaaaatttatttcccaagtactctttcttagaaagctaggggaggcttaagggggtaaatcaagcaagaaaatgagttccaggaatgaagggctccaaaagaagaaagagttgatggaaagtctcaagaagatattaagaaggcctagcagaggagtgctgtcctagacagctaccagtttggactggtttagaaggacgaggactccaggagagctgaccccaaggaaaatataaaaaagacagattatttgatgtgcatctgacgatacccacaaattttttttttttttagtttggtagtaatttagggcaagaattataatagacaaaggggaaaatccatcctggctaacatggtgaaaccccatctctactaaaaaaaaaaacaaaaaatcagctgggtgtggtggcgggcgcctgtagtcccagctactcgggaggctgaggcaggagaatggcatgaacccgggaggtggagcttgcagtgagtcgggatcgcgccactgcagtccagcctgggtgacagagcaagactccgtctcaaaaaaacaaaaacaaaacaaaacacacaaagggaaaaatgacaataagttccaaaaaaacacaaaatattgcatgagaaaggagatctaattacaataaactacgtagctctgttaatgatattgatatggtcaaaatgaaaacaatgagtgataactaacaattgtagtttaactctgttggtagcacagagaaagaagtgtgagtgcctgagcatgtgtgtgggcggacaatgaaagaactaatcatttcccacaggaggaagttaagagacagcttctagaattgcaagcaaatcgagtcatgtcagtacaagtacattatttagaaataagaaagcaaaaccaagaagagagtgtgaaagagttgaaagtaccttcctttggagagtggggtgtaggggaaggaaggtgaaacaggtgactcttgctttctgttttctcttttgaaatacaccctgcactatttgtctttttaaattatgccattattttgactcatcaccaggtgaaagtctatgtcaaatgcatgccactgtgtgtggattgagggcaggtgtagggcaggatgggggtgagtgccacctgcatctgaacgccatggaacacgcaggtattgggtgttagagacagaagagaacacacattcattacactctcctcttggctgctcagcaagcacgtgtgcgcgtatacgcacaaacacacacacaggtatatacaatttcaagcaaatttgatacatttatcaaaatataattatcccaagcacaaccaaaactgcattcacttccttcccaacgggagaaaaatctcaaatcacatcttgctacagtatagcgagggaaggaggggcctctgtggtacaagtcccagatctctggttaatggtcatcttctcaacccagttcataaatagttctccatattatgaccaagtaatttagttatttccaatatatccgatatatacctgtagacaaatgccctgaggatgctaccaaaagctcctgtttggaaaaggggaaaggcacacattgccacccagtccaggacgtacatgcttcttattagggtgcagtaaccctgtcccctgggaggctcattcttgtctaatgtcctctgctgaaaaagacaaccctttgggggtttccgcactacctaaggtcagcttcaaaaagggaatgttgcatagccatggtgaacatggaacaagttctaggaagaaatgaggatccagaagtagaatcaacccgaacaaatattactgtcaaccaaatagagtttgtgtgtgttgtataaaatcactgtagaattatatgcttcaattactgagattaaatattcagtatcaggaaaaagcttgcctttcttaaaaagtatgttttggctgggcgcagtggctcacacctcccagcactttgggaggccgaagccgaaaagtcacccgagccgaggagttcacgactaacctgggcaacatggtgaaacctcgtgtccactaaaaacacaaaacattagctgggtgtggtggtgggtacctgtagtcccagctactcaggagggagggaggatcacctaagcctgggaatttgaagctgcagtgagccatgatcacgccactgcactccagcatgggcgatgggagtgagactcggtctcaaaaaaaaaaaaaaaaaaagtatgtttctttcctttcctattaaatacttccattgtggtacacatcatatttccctttctgtgttggttttccaagattctatcctcagtgctaaatttaatgctcaaatatggtattagtttaggaattggacatattttatttacgttctcttctacatgtaaacattttctattctttaacagctttgagattttatatatacatacatcttttattgtaaactacccatgtcctctttggaatacataggtcacaaattataaataaaatctatcttgggataggatttgagctatctttgctaaactgccctacaagattcctagagattgaggttggggaagaaactgggctttgaacagtccaaaggctccgctagccagtctttattgcttgctgttttatcttaagtctggttctgcaggctaaactctgtgaacgtattcatttatttatgcttttgtgtatattttggtgttgtttccaaggaaaagttctctttcaaatcctcccgccttgccttagttgaactaaggagaagtgggattttctcctgtgttgatgtgttcctgagtgttggatggggtgctgccagctaaccagaccaggactagagctaaggaagaagctgctggagctggggcagaggcactgggaatccaggaggtacaggactggcccagaggtggatggacggagtccctgcccacagggcaattcctttacacaaagaagaacctcagacaaataaatgggtactaaacatatgaacgatataagggtagagcaaaggcatcctggaagtcagtgtcacggtctccaccgtggggcctgtccgtggggcttcagcattcactggcgtgggagacctgcagcttaggtgtgtcaccaccgtgtggtggaagggagagtgacaggcatacagagcccagtgggttcccagttcagagatttatggtgcttttctaagccacagcttgaacaaaaatagaatctgtttattaaacttgtctctttcataacacaacacagacttcagaaagataactttacagcagacaaaataaagaggaggcactcatatttctccagctacctgctaatggctaatctcgagcatgctttattctgaggcctacaggaaggagtttcctcctctcacctccaactaaaaagaatcccctttctttactttggcattgaaccccttcagcagcacagctcacagtcctggccctggcttactagggcttgcagaatcatcttgcttcaccaagctggtttggaagcagcagaatttcctcttgagccaacaagtcttcccctcgctgaatgctctctggctgtttctaagaatgtgctctgcagttcccatgccccaagtcctcagatgccactagctattcagctctcatgccccccatcttctctccaaacacaaggccttacacccaaccagcaagcaactctaggaagattattttcaagacagattaaagtaacctgacagaaaatagaacaaaacatgaatatccggtatcatcatggatactggttggttaagcaaatttaaattcatttcaccaatattattgaattgggtacaatcactaaataaccactgggacacagcagccagggacctccatgtctcctaggtagataaagaaaaataataatgaatagtgagagcatttacaaagtgccaagcattgttctgaagaatacacatgctataattcatttcaccctcacaaatctcccaatgttgggtagatcccatgaatacttctagtttctaggcagtattctaggagtatctaagggatgctcgaggtctcacagctggtaaccaatggagctggattccaatccagaaagtcagattgtagacccctcaaaacagtgtctgcagccactgccttacacggcttcctggggaagtcatcccctacctgtaatcagcttatgaggacctcacagaagatgtggaattttagagactttttttttttttaatgagaacattataacttgggcatgaggtagctatgaagaattctcaaagacctgattaaggtccttggataagtgatgacagtgagataggaggtgtaagaaggtccggcggtctacccagaaaatgttaccataaaaatagaatactgtcattaattttgaagtgaatacgacactttgtactttgcaaagaaccgtgacatatatgttatccattttaagctttgcagtaaccccagatgtcatgtttaactttttatgtggtcaccatttatagtacttttttttttttttgagatggagtctctgtctgtcgcccaggctggagtgcagcggcacgatcttggctcactgcaagctccgcctcccgggttcacgccattctgctgtctcagcctcccaagtacctgggactacaggcacccgccaccacgcctggctaattttttttttgtatttttagtagagacggggtttcaccgtgttagccaggatggtctcgatttcctgacctagtgatctgcccgtctcggcctcccaaagtgctgggattacaggcgtgagccactgcccctggcccaagtcttattttctccatcttatagatgaagcaaatgatgaagattccacggctagcctagaggtggcctagggtttgggtcttctgatgtctattgcagtgctgttggtcacatcttgctaatttggccccagggtcagcaaagaactcttagtgagagagatggcgtaacacaagataggaaggaaaggaaagatatgaagtctggctggaaggcctaatggtgataaagtgaaagaggaagagaactcgtattttctgagcccttactatgtgcaaaaccctatggtgggcctcaatggctcaggaaagctggaaatacaacagaatcactgaaagagaagattcctgcatggaaggcaactgttgcttctccatcaggatcagctctgagtgagggtggaacatctgaagccaggcgtttcataaacaggagctttggcagtcttacactctttagagcagacaacaaggagcagacaggaatcaggaatcgctccttagagacttccagggatgggaagaatgcatgggaaaggattcttaagaaggtgtgtgcagaggagggtacttcattgatgaaacataaggaagaactaggggccagggaaactctagtgttggtaagcattatggactgaatcgtatcaccccaacattcatatgttgaagcccaaatcctcaatgtaactgtatttggagacaggaactttgaaaatgtaatgaaaatgaaaatgaggtcataagagtggggtactagtccaataggactgatgtcattataagaagaggaagagacaccagagggctctttccttctctgaacttgcatactctgagcatgcacagaggaaaggccacgtgagcacagagcaagaaggcagccatctgcaacccaaggacagaagcctcagcagaaaccgaccctgctggcaccctgatcttggatttctaatctccagaattctgagagaataaacttctgttggctaagcaaccccgcctggtattttgttatggcagcttgagcagactaatggagtgagccttgttggccctgccacctccctggctcttggccaacactaatttatatttgaaaactcagagtcacctcttctatgaggtctttctcattcatcctagccatttcttccttgatgcctcctctctatgtgaagggatcttatcttagaacccataacactttattgacttagtcttttttaaaacaagcctaactgttcctattagactccgagccccttgaaagaagagaccaccttagtcaactttatagtcctggtccctagcatgtagcagacattcaataattgtttatagacaaattaaagaaatgaacaaatctaggatattatcttgaaaatgtaggctgggaccaggcacggtggctcacaccagtaatcccagcactttcgggagctgaggcgggcaaatcacgaggtcaggagttcgagaccagcctggccaacaggtgaaatcccgtctctactaaaaatacaaaaaattagctgggcgtggtggcaggtgcctgtaattccagttactcgggaggctgaggcaggagaatcacttgaaaccaggaggcagaggttgcagtgagccaagatcgcgccaccgcactccagcgtgacgacagaatgagattccgtcccccctcccccccaaaaaaaggaggctgggtgcagtggctcatgcctgtaatcccagcactttgggaggccaagacaggtggatcacctgaggtcaggagttcgagaccagcctggccaacatggtgaaaccccatctctaccaaaaatacaaaaaattagccaggtgtggccaggcgcagtggctcatgcctgtaatcccagcactttgggaggccaaggcgggcggatcacgaggtcaggagattgagaccatcctggctaacacggtgaaaccctgcctctgctaaaaatacaaaaaattagccgggggcggtggcgggtgcctgtagtcccagctactcaggaggctgaggcaggagaatggcgcgaacccgggaggcggagattgcagtgagccgagatcgtgctactgtactccagcctgggagacagagtgagactccgtctcaaaaaaattagccaggcatggtggtgcatgcctgtaatcccagctactcgggaggctgaggcaggagaatggcgcgaacctgggaggcagagcttgcagtgagctgagatcgcaccactgcactccagcctgggcgacagagactctgtctcaaaaaaattagccaggcgtggtggtgcgtgcctgtaatcccagctacttgggaggctgtggcaggagaatagcttgaacctgggaggtggaggttgcagtgaaccaagatcacaccactgcattccagcctaggcaacgagagtgaaactccatctctcaaaaaaaaaaaaaaatgtatattagtgtaaatgtaaatgttatgacatgattaattaatgaattcattcattcaacaataaacttgtaaatggctggaaggaaaaaaagaagtaaattgttgaaagactaaaaaaaaaaaaaaacaaaccaagggcatttctagatagcgaagacatgacaaaatgaaggattagctggattagctgtgtaagtgaatataaagcagttatttgtagtaaccgcttgccatgcagtatgattttaattatacttaaatgtaaaggatagctgtacagagtaggggctgtgtgagctccaaggtgagacaaaggtggtggctgaatcctgcctctgctaatactagttgggtgattttagacaagttactaaacttctctgggcctcatctcattatttttttcaacataaatcttactcaagtataatacatatacagaaaattacataagctgtcaagagacaagctcaatgaatttactagttgccttatcttgtaaatgggaagaataacagcatctgttcatacaggacaggtatgaggacttcatgacatgatgctttggaagcatttggcatggtgtccaatgcacagtgaacctccaaaaacgtcagctctcatttatgtttacctcattaaactgcaatcttaacttgatgtagagatgttcaaaccttgtatcattttgcatacagtctgatagcatatgcccagagtttgcaaaaaaaaaaaaaaaagaaaaaaaaagaaaaagtgaatcctgctcctaatgtggtttagtgagtatagaaactcatctttagaactgagtatgagaatctcatcactgtcacccttcctgccactcccacttaatggaatgattcttcatctacttaaaatgccaaggaagcttagagtcagggccagaggtggcaacaaaatggatgtggagatgcttccttggttggtacatgaaagagagaaagacatcttttatttcagcattcgtgacttctcatacaagctgaatagaggtcatcattccagggctaggcaacagcaagtactcaataaatgtttgttagccggatgcagtagctcacgcctatggttcccattacctgggaggctgaagcaggaggactgcttgagcccaagagttcaaaaccaccctgggcaacacggcaagaccctatctctaaagaaataaaaataacagtaaaattagccaggcatggtggcacacacctgtagtcccagctgcctgggaggttgaggcaggagaatcacttgagcccaggaggtcaagactagcctaggtgatatagtgagtgtctgtctctcaataaatgaatgtttgttagctggggatgcagcaggagcatcttctgaaagaagggcaagttgggaccccactgtatcttaagcggtgttcctataaacaaagttattccatgtacctagcaagggtggaccaagtggttacctaaatagagatgacctgatgggtaaaaagaagtcctttcttttcccaagtgtcttccccaaacagcttcaggatacccaaaattccactgctggtagattcctgtttgtcacagtcagcctcctcctccgttcccatttaaaatggaaatgtcactggctgggaaagcacactctgtttctgacgtgggagcatggatgaactgatgggagtcctttcctcttgagcagaagaagatggacagtaaaagtgtcagtgactgaaggaagcatggatgtgagcacatgtggagcgtgagttggcggaggtggaactttctgacctctgtactttggccagcccagccctggcacccacaggcacaggagagttcctggcaatggaaaggctgatgaggaaatcagctcaggttttcctaagtgctcttccaacatcttccttccactgccacgtgcactcctgctttgtctttccctcttccaagtaactctctgtgagcaaatgtacttctgttattccactttaaaaaccaaaaaaaccgggccagccatggtggctcacgcctgtaatcccagtactttgggaggccaaggtgggtagatcacctgaggtcaggagactgagaccatcctggccaacatggtgaaaccccgtctctactaaaaatacaaaaattagccgggtgtggtggcggacatctgtaatcccagctactcaggagactgaggcagaagaattgcttgaaaccagaaggcggaggttgcagtgagccgagatcacgccactgcactccagtctaggcaacaagagcgaaactctgtctcaaaaacaaacaaaacaaaacaaaacaaaaccaaaccaaacctgagtagcatctgtccttgcaagcattcctttgcaactcctcagaagatccaggctcttctaagtagcagcagcagatgtggcttaaaacaagatgcttgaggggaatttacagtctgtgaccaattagccagatgcactcaccttcccacctggtttttctcttgtcggtgttttgcgagccctctctcactttccttgattctctgttggtagaaggtcatttccctttggcctaggagtttgcagtctgaggccatcttgggttcacatctgcttctggacttcagatggcactggtgaccaacacaagccttctccaacacacactcacgcaggcacagtgaccttttctcccggatgcatagctcatcatagttttccacattttttttgtgaattccaacttcagatggtgcaaatgtggtcacatggttaattcccaatctatgctatacagaatgctgagccttactgtgtctgcatgtcatttcccaagcaaaccgaggaactgtatttcagccacaaaacctcgatgatttggaaggaaaagaggggattgcctgcgtccgtcttcattcttacgctttttttttttttttttttttgagacaagagtctcactctgtcgcccaggctagagtgcagtggcgcgatctgggctcactgcaagctctgcctcccaggttcacaccattctcctgcctcagcctcctgagtagctgggactacaggcgcccgccaccacacccggctaattttttgtatttttagtagagacagggtttcaccgtgttagccaggatggtctcaatctcctgccctcgtgatctactgcctcagcctcccaaagtgcagggattacaggtgtgagccaccgtgctcgggccattcttacattatttaatactggtcataccacttcctgcttccagtcagtgaagtagagttaccgctgtgtctagaagctaccgctttaggctatttgttactctaaatgtaatgtaaactcctttcctttcagtttgggtttgcctcaatcaactacgtttgccaacacttggagatgtagagagctttaagttgttatctcgtcaagatcttggaacctaggcagggcatgaacatcaatcacccaagataaacatttgtttcaccagtgtttataaatttctggggttgaaaattccccaattaggcagggtgcggtggctcatgcctataatcccagcactttgggagaccgaggcgggcggatcacctgaggttgggggttcgagaccagcctgaccaacatggtgaaacctcgtctctactgaaaatacaaaattagccgggcatggtggcgcatgcctgtaatcccagctacttgggaggctgaggcaggagaatcacttgaacctgggaggaggaggttgcggtgagccacggtggtgccattgcactccagcctgggcaacaagagcgaaactccatctcaaaaaaaaaaaaaaaaagaaagaaagaaagaaaaagaaaaagaaaattccccaattatttaaaaaacctgtgagtcatgacctccccaaatcacaattatggtaaactcccctcccccttttattttgcttcagctagtttgagttgggttttgaaccttagaaatgttttgtagttttcttcgtagatctacttcttgttgagcttttatagctatcgtgaatgcaatctgttctccatctgtgatgttttctacctggttatgagtgttatatgagaatacaatttttgtatatttattttatatctggcaaaggacttggcgttcttagtttttcagttgattctcttgaaatttccaagtagacaactggaaatatttgcaagtaagatgttaattttggcttttcctctttatttattttgcatattgcagaggttgtgccttccaaattaatgatatgtattagttatgagatgggacattcttattttgttcttttttttttttttttttttttgagacggagtctcactgtcacccaggctggagtgcagtgatgcaatctcggctcactgcaaactccacctcccgggttcacaccattctcctgcctcagcctcctgagtagctgggactacaggagcctgccaccacgcccggctaattttttgtatttttagtacagactcggtttcactgtgttagccacaatggtcttgatctcctgacctcgtgatccacccgcctcggcctcccaaagtgctaggattacagacgtgagccaccactcctggccccttattttgttcttgatctgatcctctagtttttcaccattaggcaaaatgattagtaatgtttagtttgtgatagttattatttagcatgataatacagtgtgtgtcctttaattcctagtttctgaagagtaatttttaaaaaacaacaacaactaagaacagatactgagctctattaaatgcctttttagtatctactaaggtgattacaaggctttactccatttattaatgagatgaatcatgttaatatgtttcctaatattaacctctctttgtacacttgagattaatttggcttgggcacagtgctttacttttttttaatttttattttatttatttatttatttatatttatttttgagatggagtctcactctgtcgcccaggctggagtgcagtggcgcgatctcggctcactgcaagctccacctcccgcgttcacgccattctcctgcttcagcctcccgagtagctgggactacaggcgcctgccactatgtccggccatttttgtttttttttttgtatttttagtagagacggggtttcaccgtggtagccaggatggtcttgatctgacctcgtgatccgtccgtctcggcctcccaaagtgttgggattacaggcatgagccacggcgcccggccagtgctttactttttaaatagaaaactagatttattttgctattgttttaggtagggcattttagggtaactatattcataagtgagactggcatccagatttgtaagtaaatgttatctttgttgggtatggttattagagttattctaaattcatatagtgaaataggatgccttccttcttttctgtattctgaaatagtttatataacatagaaattatttttcctggaaagtttgaaatagtttgcccataaaactgcctagtaccagagtattttggggaggataattctttgtacactcctcctgtttctttctcagttactgttccatttatgttctctaattactctttaaactattttgggaacttgaagttttctagaagatcattgaaccgttaattagtataaatttataaatagtattctctaatttttaactcagcatctgtgtttatataccccttctcatccttaatatggtggttttgttttttttcttttttgccaaaatacttggcagacatttgcctatttaatctgccttttcaaatagatagtttttatatttattaataaacctactgtttatatgctttcaaatgcactgacctcttagtttgtcctgcattccttaagttggcttaatctaaagtcctaaatggtatccttaagttacctattcttatttttttctatttgtatattccctggatgctttgaattcataactgtgcttaaatagccaccctgctctaaaagctctaagagtgagcagaagcggtgtggcccacttccaggcatggacacataagcagcacacacttcatgctcttttccgcttctgaagtgtagccataaggtgcccatgacctggctttgaccaaggagatgaggatccacagagcactggtggagacaagacagagagaaagtgggctgagaatgactccatgaaaaggcaaaaccacaggaatagaagtcagatcagttgtttccagggtctgggggttcaggggatgaggagaaggcactggccacaaaggagcacaagggaactcatattcggggtggtggaaagattcagtatttttattgtagtagtggttgtagaactatttatgtttctcagaactcacagaattggtcaccgaaaaatggtgaattttatatgtgaattagatctaatatagattaaaaaaaaaaaaaaaaaggaagagacaggcacagtgggtcacacctgtaatcccagcactttgggaggccgaggtgggtggatcacaaggtcaagagatcgagaccatcctggccaacatggtgaaccccgtctctactaaaaatacaaaaattagctgggcgtggtggcgcattcctgtagtcccagctactcaggaggctgaggcaggagaatcgcttgaacccaggaggcggaggttgcagtgagctgagatcgtgccactgcactccggcctggcgacagagcgagactctgtctcaaataaataaataaataaccctaggaagaagagacttctccctccaacctagactgctcactccagagctgttccatgaaacacaaatacagttctacattctataagccacaatactgttataatatggttgcatctctctgttgtagtacctttaccctagtgtgtgtgtgtgtatgtgtatgtgttacacaaaagtattaacactgataaatagtagaattggagttagttcattttctaagttttgttcatctatattttcttcagtaaatgtgatttcgccacacataaaagaaaatataagaaatgttgcatattttagatctatatccagccaaaaagttaaattactagggcttaaaattaatctctaaaattagtacatgattaaggcggctttcaaaatcagtagaaatagggatgaacttttaaaataaatgctaatggaacaactgagtagccatctgtaaaaacatacacttcacaccaggataaactccaaatggatcaaaaacttaaatgcagcaaacaaaaccattaaaggtctagaaaaaaaatccatgaaataattcctttatgttatgtggagataacctttctcaccgtgacttaaaatctggacgtcataaaagaacaggttgataattacgactacctaaaaattagaaacttttcatgacaaaaaaaaaatcatcataagcaatgtcaaaggccaaataattaggaaaaaaatatttgaaattcattatcacacaggatccatctcccaaatttataaaaagtctctcaacttggtaagaaaaagatcagcaatccagagaaaatcagcactaagaacatcaacagactgttaagaaaaaaaaaggaaatacaaatggtcattaaaatatatccaaaggtattctatttcactcataagaaaaatacaaaagagtagccgggtgctgtggctcacgcctgtaatcccagcactttgggaggccaaggtgggcagatcacctgaggtcaggagtttgagaccagccggaccaacatggagaaacctcgtctctacaaaaaaatgaaaataaattaatacaaataattagtctggcgtggtggcgcatgcctgtaatcccagctactcgggaggctgaggcagaagaatctcttgttgcagcgaaccaagatcgtgccattgcactccagcctgggcaacaagagcgaaactgtctcaaaaaaaaaaaaaaaaaaaaaagaaaaaagaaagaaaaaagaaaacgaaaaatacaaaataaagctcttaggtttaatcatatgaattaccaatgttctacgatttctgacctacacaaatggtaatttcatgtggttcaacttaatacaatgaaataatattttttcctctatcagactggcaaaatcccacaagctgagtgccataatctttccacgagactgtgaggcgatagtcttatacaatgcttttgggagtataaaaccactttggagggcaatctggtaaaattgatcaaaatttccactctgggaaccatcctttagctatacctctacacatataaaagaatgtatgtgctaggtacagatgagtgttcacaatatgctacctttcatatatgggcgaaaaaaaaaatatgtatatatatatatatatacagtccctgacttatgatggtttggcttaacgactttttcactttagtatggtgatttcagctgtatacagtgaggactcacagaaccatcctgtttttcactttcggtatagtattcaataaattacatgagatattaaatattattattattattattttttgagatggagtctcgctctgttgccaggctggagtgcagtggcgcggtctcggctcactgcaacctccacctcctgggttcaagcgattctcctgcctcagcatcccaagtagctgggattacaggcatgctccaccacgcctggctaatttttgtatttttagtagagatggggttgcaccatgttggccaggctggtcttgaactcctgacctcgtggtccacctgcctcagcctcccaaagtgctgggattacaggtgtgagccaccgctcccagccaaattacatgagatattaaatattgtaaaaaagacttgtgcttgatgattttgcccaattgtaggctaatgtcagtgtcctgagtacatttaaggtaagctaggctaaactatgatgttgcgtaggttaagtgtattaaatgcattctcaattaatggtattttcaacccacgatggatttattgggatgtaactgcattgtaagttgaggagcacctctatatgcacttgatttgcttgtatggtgatgtatgcgtagtgatgctgtggtcaacagtggacagcatatatcatggtggtctcataagattacaggtgccctatacaggtcccctatacaggtgcatcttttttttttttttttttttttttgagatggagtcttgctctgtcacccaagctggagtgcagtggcatgattctggctcactgcaatctccgcctcccaggttcaagcgattctcctgccgcagcctcctgagtagctgagattacagatgcgcaccaccattcccggctaatttttgtatttttagaagagacggggtttcaccatgttggtcaggctggtcttgaactcctgaccttgtgatcctcccacctcagcctcccaaagtgctgggatgacagccatgagccactgtgcctggccacaggtgcaccattttaaaatcctttatgttgtacttttattatactatttatacgtctagatacataaatatttatcattgtgttacaactgtctacaatattctgcatagtaatacagtgttcaggagccaaggagcaacaggccataccatatagccaaagtgtgtagtaggctatgtcatctaggtttgtgtcagtacactctgtgatgctcacacaacaaaatcacttaatgactcatttctcagaacacacccctgttgttaagcgaaacagacctgaaaactttctcaaagcagttactcacttagggaaggagagggagtggagaagacagggagcggggaatcaaattcctcagcgtagatgttgttcatcgtattggtgattgaagtaaatactcaaaataaaaaacaaattaagggccaggtacggtatctcacacctgtaatcccagcactttgggagactgaggtgggtggatcaactaaggtcaggagttcaagaccagcctggccaacatggtgaaaacccgtctctactaaaaatacaaaaaaaaaaaaaaaaaaaaatagccatgcgtggtggtgcatgcctgtaatcccagctacttgggaggctgaggcgggagaatcacgtgaacccagaaggcggaggttgcagtgagcccagatagcagtactacactcacgcctgggcaaccaagcgagactctgtctcaaacaaacaaacaaacaaaaacaaataaggaatttaagaagtaaaactgcaggttttgacaattaaaatgaatcatttacgccgggcatggtggctcacgtctgtaatcccagcactttgggaggctgaggagggaggatcatgaggtcagcagtttgagaccagcctggccaacatggtgaaaccccatctctactaaaaatacaaaaattagctgggcgtggtggtgcatgcctgtaatccctgctactcgggaggctgaggtaggagaatacctggaacctgggaggcagaggttgcagtgagctgagatcctgccactgcactccagcctgggacagagcaagactccgtctcaaaaaataaataaataaagtaagtaaataaataaataaaatgactcgtttaccaaggtcttataaatcatcagtgccactgtgctgcatcatttatgtacttacaactattttttgccatcccccccaccaaaacaaataaaaaaccataaatgtgaattccatcactaggctgacgatcctgactgcctccctggccagtttctccaccttttctatgtcctgcttgggggagggctgacccccacatggggcaacacctgggctctcctgacttcggtcttcctctcgggtcagccaaaggaggcactggctggaggtcagaggtcaaaaggctaaagctgggggattggagttgcttctcctgttctcttcttgcatcagcagtggttctggcaatggctgcatccccttttaagcaaatttcctgtctgctgtgatctcctactgagttctagtaacactattttctccctcttactccttagggcctggaagcggggtggaattaacagtttcccactattgtttattcttaggtgcccgtcagggatcagaacgcgataccccagagtatggcactttggcatgctgagtactttgaactgagggagactgggaggcatcagaaaagcagggcctttctgaccttctcccatcctcctgtttcctgcccctctttgtcctctgagtcacagaagccagaattcctcttcccagaggctggtcttagaagctagaactcttctcccccaaaagcaagctataaaacctagaaaggtcactctctcccttctcccttgaagaccctcattccaaagggtttctgccccatacctgggagaaaggaaagctacacagagaggccaagaagacggaggttagcgatagaaaagcacaacagatttatttaatcaaagttgtatatgacgtgggggccttcagcaatgaagacccaaagacccaaggggaaaatgtccatttttatgcttagattcaatgaagagtggacagccatgtagaaatgtgatcaaacaaagacggtgtgatctaatagtaatagactgagtggggaaaccccgcaggacctgtctgctcagattcctcttggtctgtctgtgtgacattccttcctcccggggatagggcaggacccctttggaatgaaggtcttatgatctactttcagacaaggtaggtcagggaatttctttatggccagctcctacacagaaaggcagagtagaattagaggattatttctacgttttgagggagaaaggttctagttcctatgactcaccttggtgaaaaggaattacagccaggcgtggtggctcacgcctgtaatctcagcactttgggaggccgaggtgggtggatcatgaggtcaggagttcgagaccagcctggccaagatggtgaaaccctgtctctactaaaaatacaaaaattagctgggcatggtggcgtacgcctgtagtcccagctacttcggaggctgaggcgggagaattgcttgaacctgggaggcagaggttgcagtgagccgagatcgtgccatagcactctagcctggaggacaacagtgaaactccgtcaaaaaaaaaaaaaaaaaaaaaaaggaattctagtttctatggcctgccttgggcagaaagggaagcaggagaaggtcagaaacagactttgcttctgaagcccttccaatgtccttcagttcaaagtacacagaatgtcaaagcaccatattttggggtatcgtttgcaaagccccaacataattgacatggtgttaaaaaccccaaggataaacataaaaggaacctaaaaaaatacaatcagaaattttcaggaagcctagttttctttttttttcaaaagtgatttttctagttgtttgcttccaataagcagcttattctttaaattctgacttgactaataaggggggtaaggggtggcaaattagggggatcctttgaaaaaaagaaaacaagaaccttccccattcttccaaagagccaatatccagagctctttgcaaaactgttagtcctatctctagaaggacatttttctcacccatttatattgtaacggaaaatatcttccacgaagcaaacatttttgagatttcagctttcaaatgcacggtacttgtgataaagggtgttttcaagccctcttcttcacttaacctgccagctaacatgggaaaccattagctcaggctgctacaattaactcagggcttcttcttgaaaggctcacacaattcccagctacttatcatgcaaacaacctgggagactcattttccttgcaatgcggtgggaggggtaaattacggagataagtagattattggggaaaaagtcacactcggaggccttatgaaatgattaaactctgggaaattcatccccctaaatccctggcccctgatagtacacattcattactggatcctgggtaatgtacaatgaagaacctcctttagaagcaataaatactcccactccgctgaattttcacttaactttttaaacagtgagttctgtagttttgatgagtgagagtcatcatatacgaagcaaattaaaggaaagggaaggggtcatgagacttgtaagatttttaaatactgtactgttttgctaaaataggaaaagtacaaatattaaaataaaaccaataacatataactctagaaaaatagggtcttactgacttccttggattaacttcataaactccatatcaacagaaaccatttcatatttgattaacagccttgttcaaatctattatgacaaaatatatactctctaagaagtatttcctatagcaaatatttgtcaatagtcaagttgactcttattagtcaagttgactcttattagtcaagttgacgaacagcctgaaatgatgtttcggaaagaaaaagtctaggaaagtaacttaaatgaatgtaaccatgagctggagacagaaaatgaaccctcatttttctggcaaaagggggaaaaaaaacaacatacaaacacacacacaaaaaaacaggcaccctgataaccaaaatcctaataagagaacttcgtggtggagactgttagtatcagcgttgactttctactcccagctactgaattgcagattcagattgcaacctcaggcattccaaaatacagcagtgcactcacttaaaatcgctcttggaaatacgcgaggaattgctaactctctaagtaaagctgagcctttttgatagaataaaacacatctgcttcttccttataaatagactattcactacctggaggaattcagtcttgcccccacctgtctgcttaaagtgaagatctgctttgtgaggtacaatgtaacctgctcttgtctcaatacaaaaccttcagtaaaggctataatttatcaaaattcttggagctgcttttgtatgtgagcaaagagtgtgcacctgttttgggaggagagtgggacaggatgggctgagatgaatcttgtggggttggggaggggtggtccacggagatctgttctcatttgatttatagtaaggctattccaatttttataaatgaaatacctgaagcttggagaggttaagtaacttacccaaggtctcgatgttagagctgggattcagatctacactgattttggaacccaaagtctaaatactatactagacttatcttggaagacagtagagaacacaatcctagtttgatatctcaaattgctgtacttcacttatgggagtagacattcctggatggaacagaattgaagattttgaaagaggaggagtcggccgggtgcaatggctcgtgcctgtaatcctagcactttgggaggccgaggtgggcggatcccaaggtcaggagttcgagaccagcctgacccacgtggtgaaaccgcatctctactaaaaatacaaaaattagccaggtgtggtggtgtgcacctgtaatcccagctactcaggaggctgaggcaggagaattgcttgaacccaggaggcgaaggttgcagtgagctgagattgcgccactgcactccagcctggtagacagagcaagactccgtctcaaaaaaaaaaaaaaaaagaggagaagtcagtggggtaatacagaaaacccatccccctggctattcgcagctgcctgaaatatgtatctgcaatggaatgatatgtatttcacaacagaattgagattcaaatgagaatgcacagcaagaaagtaagacagaaagaaacaattttcactaaaaaaacttggtgtatatattaatgaagaactgcttttagaaactgcaatatgtaatattaacagtgagataataatcacatttatagttaaatagaaagaaatgtttttaatatccatgaaatgaggcacatatatcttggcatccctatttgaactgtgattaaaatagactgacggaatataaacagagtctagttattaagaacacagtcagtctgaagcccagttcaaccacttactagctgtgtggccttgggtaaatcactgaacctttctgtgcttcagtttcttcatctgcgaatgtggatattacatgtccctatctcattggatggttgtgaggattcaatgaaataatacatcgaagtacttgaaacagtgcctgataacatggtaagtactttataagtgttagtgttaaattctctttttttcttttttttttctgagacggagtcttgctctgttgcccaggctggagtgcagcagcgtgatcttggctcactgcaacctccccatcccaggttcaagctattctcctgcctcagcctcccgagtagctgagattacaggtgcccgccattatgcccagctaattttttgtatttttagtagagacggggtttcacctgttggccaggctggtccgaactcctgaccttgtgatttgcctgcctcagcctcctaaagtgctgggattacaggtgtgagccactgcgcccagcttcgttaaattcttattaaacacataaaaaaacctatataagcatgagactctttttttttttgttttttgttttgagatggagtttcgttcttgttgtccaggctggagtgcagtggcgtgatcttggctcaccgcaacctccacctcctgggttcaagtgattctcctgccttggcctcctgagtagctgggattacaggcatgcgccaccacgcccagctaattttgtatttttagtagagatggggtttctccacgttggtcaggctggtctcaaactcccgacctcaggtgatccacctgcctcggcctcccaaagtgctgggattacaggcgtgagccaccgcgtctggcaagcatgagacattttaagggatatcataaaagatagtaaatgcacaggttaaaagagtaaggaaattcagtgctggtgggaaggctgttgaatactcactgagttgaggcttatacagaaatcacgcaagctggactgatttgttaggagagcaaggcagaattatgagacggaaggtcacttgggttaaagagcaggtctgagtggagttagaaagtggaatgacaggtggttacattacagagaggaatttttagagttagaggtagaacagttccagatgtactaactccactctgcagtcacggagatggagaaattatgacctagagtgttggatagatcgtcaaggtagaatcttgcgtccccaggcatcctccagggaaatgggttaaagaggtcactgtgggccaggcgtggtggctcaggcctgtaatcccagcactttgggaggctgaggtaggtggatcacctgaggttgggagtttgagaccaacctgaccaacatggtgaaaccccctccctactgaaaaatacaaaattagccaggcatggtggcgcatgcctgtaatcccagctattcaggagactgagacaggagaatcacttcaatctgggaggcggaggttatggtgagccgagatcacgccattgcattccagtttgggcaacaagagtgaaactctgtctaaaaaaaagaaataaataaaaataagaggtcactgtgaattgagtgtcaaaatcctcaaggaacatgggtgggtgataagaaagtcaaaacgtatcagtgaggggttttcgttgaagatgtcgacatccactgcagccggtttagcaaaagagggctttttaaaaaagggaattaggagcttataaaaccttcaggacaagcagaaaacccaaccaagttttgaggattcacaatcagcaccaatagatccaataatccaacaggacagttcctacagaaatgccactgctgcagctgtctgccaagggttacagagaacagtaggaactaggtgccagaatctgctgaacacaaagagccaaatgtccccagctgccatgcccatcacaagatctgatcccctgtgcacagctaacaccctgtaagggtcacttctatctctaagtctttttgagacggagtctcgcttctgtcgcccaggctggagtgcagtggtgtgatctcagctcactgcatgcaacctccacctcctgggttcaagcgattcttatgcctcagcctcctgagtagctgggactacaggcacgtgccaccacacccggctaatattttgtatttttagtagagacggggtttcactatgttagccaggatggtctcgatctcctgacctcgtgatccacctgcctcggcctcctaaagtgctgggattacaggcatgagccaccgtgcccagcctctccctttaaattcccataacagtttacctataggtctctctatttactttaagttctcataagagtttacctacatttctctgacatcactgatctcatttggtttaacagttatttatatacacgtcttaactcccctactgaactaagctttctaaggcagtgtatatgatctactgacttctgtatttttttcccagcaaccagtgtaactccttgctctctaaaaatgtttgatgaatgaaagatgaattaacactttcatgccctctattatatcatttggtgatttccaatgtccgtgaggaatagaattgccaggtagtcagccaatttgttttgaggtttattctaaccaaaatgctaaacttctaaaaatgctcataattctgggtcttgctatacttatactacagacttcccattagatcatgagattgggaatatatattttatatctgtttttttgttttgttttgtttttgagacggagtctcactctctctcccagtctggagtgcagtgatatgatctcggctcactgcaagctccgcctcccaggttcataccattcttctgcctcagcctcccgagtaactgggactacaggcgcccccactcccatgcccggctaattttttgtattttttttttttttagtagagacggggtttcactgtgttagccaggatggtctcgatctcctgacctagtgatccacctgccttggcctcccaaagtgctgggattacaggcatgagccaccatgcccggccgcttatcttttatatctgtatataccctgaggaatatcctaagccccccagccgactgaatggattccccttggccaagggtagcccagagaagccttaaaaaactgagttcctggctgggcacggtggcttacacctgtaatcccagcactttgggaggccgaggcgggcagatcacgaggtcaagagatcgagaccatcctggccaacatggtgaaaccccgtctctactaaaaatacgaacattagccagtcgtggtggcatgcacctgtagtcccagctacttgggaggctgaggcaggagaatcgcttgaatccgggaggtggagtttgcagtcagccgagatcgtgccactgcactccagcctggcgacaacgtgagactctgtctcaaaaaaaaaaaaaaaaccaacaacaacaacaatagtaacaaaaacaagaaaaaaacaaaaacaaaaacaaaaaacaaaaaaaacctgagttcctggccatgacaggatgggaagtcagacacctcattataccccctccctcactaaccaccataaggctttctttcctaagagttaaaaaaacaaaaacaacaaaaaaaaaaaacaagcagcccttttgagacttgctccactgctgatttacccaactgaccagcattccctcctggtaagagaccatggaccatggacaggttctggccagtttacagaggctgcacgcagcatgcttctgagtcttccatctcaccctttgatgtaaagagcccaattctaatgcatttaaatgctaagtctccaccccagagggaaaatgtgggatgcgtgtcacatgcatttgtttactacacatgcacaacccttttcataaatattcataactcctataacatgttgactatgtatatttagccaacctgttcagcataaattcctgtctcatgcttccctctctcaaagtgcctgcttttggtttctatcggaggctatgcttcccagcctgcaggatggccggcctacaaaaataaagctggtgggcatggtggctcacgcctgtaatcctagcacttcaggaggctgaggtaggcagactgcctgagctcaggagtttgagaccagcctgggtaacatggtgaaacgctgtctctactaaaatacaaaaaacattagctgggtgtggtggtgtgtacctgtagtcccagctacttgggaggctgaggcaggagaaaggcttgaacccgggaggtagaggttgcaagtgagccgagatcacgccactgcactccagcctgggtgatagagtgagactccatctccaattaaaaaaaaaaaaaaagtaataaagctctcctttccaagtatatgaacctcgtgattcatcagttgacacccctataatgtctactgtaggacatgctcaaaggacacgtgatgacttgtctaagttcagatgttatctgggacatgtggatgggccctgaactttgtctaagtatgatactgtaatttataatgagaaatatatatttggccttgtttaatttcctggcagctgatcctaaaacctttggaatctctaaagtgataagtgtctttctgaatgttaatgagatgatggctgactgggggctcctagatagcatcaggatgggggaacagaggaagcaactgtatgattaggaggtttgaactttcagccccatcccatgacctccgggaagaggagagcagctgaaggttgagttgatcaccaatggtcaataatttaatctaccatgtttatgtaatgaagcctccacaaaaacccaaaagtacagggtttggacagcttccaggctgctgaccatgtggcggtactgcgagggtggcatgcccagagagtgcatggaagctctgtgcccctacccataccttaccctgtgcatctcttatatctgcctgttcattgtatccttttacaataaatgagtaaagtaaatgaagtgtttcttggagttccgtgacccattttaagcaaataatcgaacccaaggaaggggtcctgggaacccccaatttacagctggtcattgagaaattccagacactttgacttgtgattgacatttgaagtaggggacagtcttaggggccctgtgagatttaactctaattccaggtagatagtgtccattgcattaaattacaggacatctaattggtatccgccagagaactgatgagcaaggaaaatcattcacacctggtatcagaagtgaagcattgcgggtgaggagagtggaataggaaaagacagtcggttcttttttcctatctcacgcactaaggtgtctataagatttctgtatgatatatttgtgtagatgaaaggaataagggacattagactggatttactctggaaaagatatgatctaacacaagagaggacaagaggcataaaagagccatagctctgtaacaatgaagagaactgaaaaagaaccagtggtgaaagaaagagctctatacatttctggaagacagaacgtaaatgggatagggctgactactcaaatcaaggaagtagtacggcctagaaaacacatgaggaagagccggcactgaagagggcaccaacctgccaagcacacccttgagatgtagagatggcaaagcatgagtgagaaatggggctgaaaacaggattcactgaagatctttacacagaccctcccgcttaccaagtgataaaaccgcgccaggcaaataagtgtcttatctatccacaaaaagcaaggctgttggccgggcgcggtggctcacgcctggaatcccagcactttgggaggctgaggcgggcagatcacaagggcaggagatcgagaccatcctggctaacacagtgaaaccccgtctctactaaaaatacaaaaaaattagctgggcatggtggcaggcacctgtagtcccagctacttgggaggctgaggcaggagaatgtcgtgaacccgggaggtggagcttgcagtgagccgagattgcaccactgcactccagcctgggtgacagtgagactctgtctcagaaaaagaaaaaaaaaaaaaaaaagtggggctgttttctctacacaaatcaagcaaactatctctgggagactggagctgctagtgtaggtaggtgttgctgtcctagaacagagtcctctgctttctggaccatgtcagggttggggcagggagtttccccagtgacctggatgcgaggcccatcaatcagccagctccatccacatttacatagagcttcccattggcctttctacttcccaattcttacatatgaactcgctctgaagatacatcacacacttgagcaaagtctatggcatgctatagaaggcacagaataagcaaatagaaaaactgactctagaggacacagaaataattttttttaaatacttcaagttctagggtccatgtgcacaacgtgcaggtatgttacataggtatttatgtgccatgttggtttgctgcacccatcaactcatcatttacatgagatatttctcctaatgctatccctcccccagccccccacccaccaacaggccccagtgtgtgatgttccccacccaggacacagaagtaattctgataacagaagagaacttgaaaacaaaatacaacatgtggaagactcttgttagtattcttgaagaaactagaaaaaaatattgtacccataaaaataatgacagaatccaatggagaaggaataatctagaataagaaagagcacttggaaagtaaatgacccacaccctaaccatgttttgacatttcagaacagcaacaaaagaaaggccctaaaagcttccagagtgaaaaacgaacaatacggcagtaacaagataaataaaaacaggtcacaaacaaattggactcgtgtcagagttctcatcagtactggagatgatcagacattaaagctccgaagataaactattatttagaattctatacccagtaaaactatcaagcatgaggatggtataaagcatttttccacatgtgagaattcataaggcataccactcttgcccccctgttttagaaggtttagaatatagttcaacaaaatgtgaaaactgtgataaaagggaaaaaatgagatcagagaaacagaataatcacacaggataacaatgaatagaaatgccagaatgacaagcagttctcaaaacaggggtgcagagccagtgcggattggagcagaagatagcatgtagaagggagctctccaggaaaatcaataaagagtaaatgacaaactagcaaacaaccaaagaaataaatgaataaatacattcccctagagattatctgatgaatttttccacgtggaaattagtactgtgaagcattttaagagatgttgatatattaaaaaattacccacaagtgcattaaaaactaaagaaaatcccaggactttgggaggccgaggcgggcggatcacaaggtcaggagatcgagaccgtcctggctaacacagtgaaaccctgtctctactaaaaatacaaaaaattagctgggtgtggtggcgggtgcctgtagtcccagctactcaggaggctgaggcagaagaatggcgtgaacctgggaggcagaggttgcagtgagccgagattgtgccactgcactccagcctgggcgacacagcaagactctgtctcaaaaacaaaaacaaaaacaaaacaaaacaaacactaaagaaaagaaaaaactgcattatcgatacctggaaaatttaagttatacaatacagaaaatgcaacagcagcacatcatttgattcaacaggaaacaagatttacagtcatatcccatccagactggaacaagaagccagagggtttgaggatcttggtctccagggaaaaaggaagattcggttcagaaaaaaatttcaaaataaaatgaaagccggccaggcacagtggctcacacctgtaatcccagcactttgggaggccgaggtgggtagatcacgaggtcaggagttcaagaccagcctgaccaacatggtgaaaccctgtctctactaaaaatacaaaaattagccaggcctggtgtcacacacttgtaatccgagctactcgggaggctgagacaggagaatcacttgaacccagggggcagaggttgcaggagctgagatcttgccattgcactctagcctgggcaacatagtgagagtccatctcaaaaataaataaataaataaataaaataaaataaaagcaaactggaaactctaggaaatactaaaggtgatgtttaaaaaataaaaaataaaaattttactggccaggtgctgtgtggctcacacctgtaattccagcactttggaaggccgaggtgggcagatcacgaggtcaggagttcaagaccagcctgaccaacatggtgaaatcccgtctctactaaaaatacaaaaaataactgggcatggtggcacgcacctgtaatcccagctactggggaggctgaggcaggagaatcgcttgaacccgggaggtggaggttacagtgagccaagatggcaccactgcactccagcctgggtgacagagcaagactccatctcaaaaaaaaaaaaaagaaaacaaaaaaagctagcaaattaaaacatggcatggtttgaaaccagtgatgggaagaaaagacaataaatgttaatattctcctttgattaccacaaggattatgatttgggaattacagggagggaaatatcattaaccatagctcatttcttggtattacactgtataatattcatatacacataataatatgaaagttatttactggctcttaacttctggaaccaacttaaaggtacagtatagaaatcttccttgtggccgggcatggtggctcacacctgtaatcccagcactctgggatgctaaagtgggtggatcacctgagatcaggagttcaagactagcctggctaacatggtgaaacctcatctctattaaaaaaaaaaaaatacaaaagttagctgggtgtggtggcgtgcacctctagtcccagctagtcaagaggctgaggcaggagaatcacttgaacccaggaggcggaggttgcagtgagccaagatcatgccactgcactccagcctgggacagagcaagactattttccaaaaaaaaaaaagaaagaaatcttaattgtgatcccaacggggcctccaaaaaaaaaaaaaaacttaactctagttaaattggagtgcaaacgttatcaacagctgatagaaatgaagggcagagagacgagagaagaggtagaagaaaggtgagatggcatactgtctataatcagtgatacaggaaaaggaaatagagctttaagtgtattaaagttacaatagcaatacacagaggaataaaaataacgacatgggaaaggggagaggtatgtagagcgtatgaatgaaaccctatctatatcaggaaatcaataggtaatgtctaaagttgaaaaatcaaaaataggccaggcgcagtggctgacgcctgtaatcccagcactttgggaggccaagatgggcagatcacctgaagtcaggagttcgagatcagcctggccaacatggtaaaaccctgtctctgctaaaactacaaaaattagccgggcgtggtggcagatgcctgtaatcccagctacttgggaggctgaggcaggagaattgcttgaacccaggaggtggagtttgcagtgagctgagatagaaaaagaaaaaaaataacacatataaatatactacttatttatttatttattgagatagagtctccccctgtcgcccaggctggagtacactggcgcaatcccagctcactgcaacctccgcctcccaggttcaagcggttctcctgcctcagcctcctgagtagctgggattacaggtgcacaccaccaccctggctaattttttatatctttagtagagacggggtttcaccatgttggccaggctgttctcaaactcctgaccttgtgatctgcctgccttggcctcccaaagtgctgggactacaggcatgagccgccatgcccagcataaatataccatttattaatatgcaaataatcgccaaaaaacaggaaaaggaaaaatggttcaaactgattgactctggagatcaggacaggggataagaagagatggggcaggggccagctgatttgtttaaaactgtgtagatgcattatttaagtgtgttaaaagattttcacagagtaaacatgtactctggaacctgaactttttggctcatgactgctaagaaattaacctttgacaagtactattggattcacttatttctatcagaatacgttcgtcccagggctatccagaccccagccagcagtacacaagtcctcagcagtacccagatgacatgccacagggcatgatgtgaaggatggaggaagtataaatggcgggttagcggtcatctcagggaatttcaactctaggtcattacaaagaggaagatctcccctgggctcactgccggaataaccctgggtctcaccagacttccatggtcctgctggacagaataagtaaaatgtctgatattttccttttgaaagcactaggaacagctcaaggatttgcacagcagaatgaaagaggagctgtcactgagttccttaggactcacagcttgaaaggaaggaggaggcccacagggggcctgaggaccaagcccagcaggggacgctgagcacttccacagcccagggggtgggaccagagctcttaaagccacagatctcctctgcaggcacagagaccctcacagcagggatccattcacaccagtcacccttggagactgctatttatgctaaagaaatttatcccactgcattgtatgcttcttgtccagagttctcttggatcccttgtttacggccttagtcttatattgtgagcagtggaatggacaggccatttaagagggcagggatggctaatgatgggtctgttagccctgcagtcagtctttcctttgtgaaccaaacccaatttgggtgcatttgctaaaaaaaaaaaaaaaaaaaaaaaaaagaggcaaaaccctcatttgaagttgaagaaatgttagttgtattccattccttttatgaggaaaaaaaaaaacacaaacacacacactggaagaaaccaaaaactttataatatttatgatccattctttcggtggtcaaaatacatatccgattttttcaggtgtaggtacaaacactgtagttccttaagattgagaagatcttaaaaaatagggggtcttttcatcactagagagatgctaatttttatcttgcaaaaagtaaagagaagccccttcagaaaatgttttcttttgaggcagaacttaaacagatgccaatgctttcatgaattttgtgagctaaatccttataaatcctttgagttgacagatcaattattccttctaacagctaatgaactaataacccttggaaatttctccttccttgggtttaaaatagaaaaaaagaaaaccttagggggaaaaaatcaattaaagactacatagcaataagaatcaattaaactcattataactttttaaagagagctatattttcttcaagagctatgatttttaaattaaaaacacgtcaaataactctgtattttataaaccacaaatattcttaaaacatgtctttaattcacattgtgtccaggcaaaggaaagtgagaaaggctagaaaaacagaaaaggagacagagatggaccttgcagaaggcaatcagaagaacggtgggatcacggtgggatcaccgaatgcctctctgtacaaggcaccgtggtagactctcagggcaccagaaagagaaaaagacatacgcacacagcactggagaaaaaatgaagagaagagagaaaggaagggagattgcgttactccagaatgctctagacaacactgtgaagagaggaggcctgtcctgagcgtcttgctgatagaagtggagattagcaggagttggcagagtccatatgctgggcattcaaggagttaggcccaaacgggacaatgaggaccagagcaggtggcagaaagggaacgagaagaatgggaatgcacgcaggtgctggaggtgagccctgatcccaagaatgaggtggtacctgctgggggaatgggacacaggcgcagtggggcggagaggcatcggtcctatttgtggatctgacatcatggccaaagattttaacagatgagaaaactgaagcaatgggaatttcagtaaaagacttgctcaaggtctcagggcatccctctctctctctctctctctctgtctctctctctctctctcacacacacacacacacacacacacacacaaacacaaacacacactccagttgtacgtgtatgtacaagaaagtctgtgctttgtttttaattaaggaactagagcatgatggtcatccaggtaccagcccacaaacgctgctcttccttcctgcagtgcagttcttggaagtgaaaagcaaagtctcatttgaaattgagtgagtggtcttttttccaaattaacaactctggagggtgatacctagagaacatggcgcacattccaggggatgctgacagttctccaccctgtgagctcctggtgcgcagtgtgatggggtgtaaagaaagggaaacctaagagtcagaagaggccaggtgcggtggctcctgcctgtaatccctgcactttggggggctgaggtaggaggatcacctgaggtcaggagttcgagaccagcctgggcaacatggtgaaaccctgtctctactaaaaatacaaaaaaattagctgggcgtggtggcaggcacctgtaatcccagctactcgggaggctgaggcaggagaactgcttgaacccgggaagtgaaggttgcagtgagccatgattgtaccactgcactccaacatgggtgacaagagcaaaactccatctcaaaaaaaaaaaaaaaaaaaaaagagaagagctgggtcagcatcacagctccactcttatttggcctcagttgctctgactataacagggatacgaatggtccctgaccatggttccacttacaaatttttgacttcgagatgatgcaaaggcaatatgcattcagtagaaactgaattttgaattttgttattttcctgggctagtgatatgtggtatagtactctcttgtgatgccaggtggcagcagcaagtacagctcccagccagccacatgatcatgggagtaaacaaccagtattgtactctgtgatgtactgtgttgccagatgatcttgcacaactgtgggctaatgtaagtgttctgagcaccttgaagataggctaggccgagctatgatgttcaatagattaagggtattaaaagcgttttcaacttaacgatattttcaacttaagatgggtttattagaacataaccccctcataagtcaaagagcatctgtaattatagttatacctcaagttgtgaataggaataaaccaaccatagtttattcctatggtgataaaccaaactattcataagggcttataaggtatgtatagtgtatgaatgaaaccctatctatatcaggaaatccccaagacccatctatggacttgtggccctgttaaggtaaagctagggccagctttatgggtgtgtgaccctcagagatgacacagggttcccatgttaaagggggcccatgcttgattcaacactctgctgttgccatcttgacattcttgataatttccgaacaaggggccctgcattttcattttgcgatgggctgcgcgaattacatagttggtcctgggtaaagtcacttggttcagtgggaagagctcaggaaggtttccatctttggcaaatacttcccagtagactggaagtttgcagtgaacatgtgtttgctttccagctgaacccatttcttacatttgaggaacgcttcaccatacgggtcttggcaagaggcagggccacatgggccagatactggcattcctcagccttcctaccagctagagcgtggccagccaggtgcaataactctggagtgtgcaatgcttaaagtatgaaaggagagtggaaaattcactttggtgatggcagcagtggcatcaattatctagggacataaatggcagcccccagctatggtctctggtgtccagcgctagccatgctagctagtgggaaaaggttgggggtcgggaggcatccagcagtgtgtcaatgagatcctccactagatgggtctgtgatgaggttgcagtcttggttttagccacctttggttcttccctgtttcctttttttttttttctttttgagacagggtctcactctgtcatccaggctagagtgcagtggcacgatcatggctcattgcagccttgacctcctgggctcaggtgattctcccacctcagcctgccgagtagctaggactacaggtgcctgtcaccatacctggataatttttgtagagacagggtttcaccgtgttgcccaggctggtctcaaactcctgggctcaagtgatctgcttgcctcagcctcccaaagcgccaggatgacaggtgtgagccactgtgcccagcttccttccctgttttctagcctgttcatctagtcttcttggtgatttgcttttcaaattactcagtgttctttcgataaattccttttgcacttatgtggtcagagatggtttctgttgctcatagctacgagctttttctgatataaagttggactctggtggagttacgaccctgatcatcctttggctgagaggcagaaaatgggtcctgtgtcctgaggcagaacttgtcggccacatgtccctggtgataagacactagtgcttatgcattccaacacagaagggacatgggagactgcatgggtggaaaggcacaatatctttcctcacccattagcagggtcatggctgacattcctataacaaggatgggttaagaagacagaggcataacagatttatttaatcagtgttttacttgacacaggagccttcaaaaatgaagatctaatggctgggcatggtggctcacgcctgtaatcccagcagtttgggaggctgaggcgggcagatcacctgatgtcgggagttcaagaccagcctgaccaacagagaaacctcatctctactaaaaatacaaaattagccgggcgtgatggtgcatgcctgtaatcccagctattcgggaggctgaggcaggagaatcgcttgaacctgggaggcggaggttgcagtgagccgagatcacgccattgcactccagcctgggcaacaagagctaaactctgtctcaaaaaaaaaaaaagaagaagaagaaggaagaagaaggaagaaggaagaaggaggaagaaggaggaagaaggaggaaggaggacagaggaggaaggaggaaggaggaggaggaaggaggaagaaggaagaaagaagaagaagaaagaaagaagaagaaggaagaaggagaagagaaggagaaggaggaggaggagaaggagagggagagggagaaggaggagaaggagggggagagggagaaggagaagaagaagaaaaagaagatccaaagactcagggaaaactgtctatttctatgcttaggttggatgtgaatggacagctatgtagaaatgtgactggacaacaaggggtatgatctaatgttgatggacagagaggggaagcacagtaaggcccgtctgtttggattcttcctggtctctctgtgtggcattccttccacctgggtacagggcaggacctctctggaaacaggggtcttatgtcctacttttagacaaggtagggcagagaatttttttctttctgtttctgagatgaagtctcactctgtcgcccaagctgcagtgcagtggtgcaatcacggctcactgcagcctccacctcctgggcctgagtgatccccctgcctcagcctcctgaatactgggactacaggtgtgcaccaccacacccagctaatttttctccttccttcctcccttcctctcttttttccttccttcccttcttccctccctccctccctttccttcctttcttccttctgtccttccttccttcctccctctccttccttctttccttctccctccttccttccttcttttgtctctctctttccttctctctcattctttctctttcctcctttctctctctcctctccccccaccccctctctctttctttcttttcttttctttctttctttcagagctagatctcactatgttgcccaggctggtcttgaactcttggcctcaactgatcctccacctccagagaatttatttataaccagctcttacacagaaaggtggtgataggttagagttatatacctaggtttttgtggctggtattggagaagttgggttctagtttctatggcctgccttgaagagggattctactttctgtggcctgtcttggggaaaagggaaggaagaaaaagaagagcaggagagggtcagaaagagacagcctttgaggcccttccaaagtccttcagttcaaagtactcagcatgccaaagtgctacactttgggtcatcgttttccgagccccaacaaggtcatctggtccacactccttctgaacgtgggaatcctttatgaataattcaggatctgaatagcattcaacaaaagatgctactgaaaaccacagtgtgtgctaagcagaaagacttgatcacgggtgacaaacgctgaggttggccagctcccagttgtactgttcagggtcaatggccctcttagggctgtaaggatatccctaactgtcatcaaattgtcaaggctaaagttcagggaaatccacctcactcatggccaaatataaaatgtcattccttcagacatgtaattaagatggtggctgaggccggatgcggtggctcacgcctgtaatcccagcactttgggaggctgagacgggtggatcacctgaggacaggagttcaagaccagcctggccaacatggtgcaactccatctctactaaaagtacaaaaattagccggctgtggtgacaggcacctgtagtcccagctagtcaggagtctgaggcagaagaatcacttgaacccaggaggtggaggttgcagtgagctgagatcgcgccactgcacttgagcatgggcgacaagagcgagattccatctcaaaaaaaaaaaaaaaaaaaaaaaaaaaaaaaaagatggtgtctgagtccctaatgaattcccagagcataatgggactaaggtgctctgggattctgaaatctacagactacctagaaaagttcccacagaaacattatggccatagcgaaaacaaaacacgaaaaccaaaaacaaccaaagtgccaaacatctgcattgaggatgctacaggaaattactttcacctccttttataggcatgttcaatcaatggcaacaatattctacattttgctaagggctgaaggaagagaaaagagagtcaggaccagctcattttccaacacttgaaatgaactcctggctgaaactaaatcactcgctctctggcatcacggctatttctacagtgccacttggctggctgggtgattttccagtcactgggtgagggacactggatccaggacagggccatgagcgtgttaagagcagaaagacccaattatgaagaatcccctggaaagcccacaatgtagcccacccacctgggtctgaatggcaggcatgtgagcagaggcagaaaagcttcggtgccaaatgggggaggatgcagagccacttcgagtcccatcggaccactcaggccgttgcagctggagctgcctgcctgaggcaaagtaatgccaaagtgagcggtaggagcccgtcacagccaagcaaatggcaactggacagagttggccaagggctgccagacatgatagagcagggaaagaggcagagatgagggaataaggcagctgtcatttatttgggagggaagaggttggatcctgtaagggcaatagggtggaggggagggagagggctcagagggcctagggtcagattggaagcagcagaccccgaagcgtgctgatcctgaggcagagggtgcagctggtcatagctaagaggaaggtgaaggtgtgcaggccccttgctcagaggggagcagagggcagaggtgcgataccctgggaggtcccgcggcttcaaagggaaagggagaggatgggcagggagagagaaacaggaggcagagtccctccgtaagctttcccaagtgagtaaagtactcatacccagggctttatttgaatttatcacctcttattagtgtcttttgaaatgcgaattagctgattaaccactgctcacagccttccaactgttctttattctccagcattcagcaactttgttctaaatagggtaggccacagtagcccaccagggggaaattattctcaaggttacaagaacagcgaccaaggcaaaattaggccctggcctggatggaatcaagttgggagtgaggttgtgcctggagccaggctctaaccactcccaccccccaacccggtctacacacaaagcctccgaggatgctggttaccctggtgttagtccatccttgcgatgtatgaacagggctctggggaacaagatacacactcttctgccccctaccacttttttgttgatgatcaccattttctaaaaggtttattagttctaggtccctcaggaatgcccgtgcactggcttcggctttctgtttgggacgtgggttcacgtttacgaacaacaagggatggcccctggcagagcctcgttcgcactcgctcctgcctccagtttggcaacacaacacaaaggcggtatggcttgtatacactttccaggctgagcccctattcagagggggctgcagcttgcgcgtaatgggccccctacagacaaagccagcaagtttcttaattaagtctaagtgaaagacagatcccgcttacatcttcagagaaccttccttcagaacttcaaaaacagcctagactgcctatcaaatccaggcacgaataactagctagcaattttttctctttttaaatatagaaagccaggcctccggcgccaactcttcaaccccctctcactttccctgcaattttagacatgcctctggtttataaaacaggaaacaaagggacttcttgtgtgtcggagaagccctcagagggcctgcatttcattccggccttccccaaagcactgtgctgtctaaagagctctttaactggtttagtctcattaccatttccatgaggtatcaaaggatacgctacgaaaccagcatatgtacatatatcacataaggacacatcctgttacgcaacgatattaaaaaattaattattagctaattgccttttcagaaatgtgatttttcacatccctccctcccctccccctccaccctagccccagaaaccctctctcagacagacctttctgttttctgggctttgctgtgataatgttccttgcaaacagaaaccaattattctgcagcagtaagtcaccaggagtatgaattgctttaatttttcccccttttagcagctgcccagggtgggttgcgaggtggctgcagtaatgaagctgggatgaatactaaagcaggaccgaggccgggtgtcctgcagggaaaatgatgttcaaaaataaaagtgcgtttttgttgggagaagctaatcaatgaattggacgtttccaaaaaatgtgctttccgctctcaatttgcatcgccaatgctgctttccccaatgagtcctgtgcacctgactagcttgtaaaaatgtcaccttactgttaaagtgctaaacacgccctgtttttcctccgcctgttctctctctccctcccccctctctgcctttttccttctgcaattctttgctttctcattagaaatgcccagcaacgtctggcagacaaagacactgcaaacaaagtgtatggaaaggaaaaaaaaaattaaaagggaaaaaagtgcagaggaattcttcattcacggatctgtagaatacattaatatctgaaactgttggcacagcctaaaatacttgggcggctaacaatgcgggcaatgattccgagtctgggatcttcaaataaaccccagcgctgtcatggccaccaggaaggagaataatggcgatattagctgaccttcattttgttgtttcttcagtcctgactgctggacctctgtttgcttgttactaggatttcttagctgaaaaattttagcatttcccaggcaatacaagagccagtttattaggtaaataaaccaggccttaagcagtcttttctgctccataatgggaaatgggcaaattggaacgagggttgagttggagtcagggagaatgactcagaggcagagatctcatcatttccccctcatccaaaacaccaatgaacaatgcggacggagttaacaaatcatcagatcgacgtgctgcctttggttaacttaaccaacatcatccaccaagtaaggaagacaagattcacaaaaggaagggacaaaaatagcggctttcttcttctagagacctagatctgtaatgacatttcacttctcccaaggttccaaggaactggagactattttataattcatccaaatggagctaatggtgctatgtttcagtcatctgtcataaatgcttaaacattcttatgttattcaaaccattgtctagtgacaatcttaacgatgttaataaaatcagtaatgcagaactggatcctttttcagagtctctacatccagagggccttctggctgtctagactgtaacacaattggtaattattacatttatgtgtgcctgcttactgtttactatctcgattccctcccccaactgcaatataagctccctgagggcagggaccaccattgtatcctacctcacccaacacagtgcctagcacccaagacgtatttgcctagggaggtaatgatatttttggctacctttggggaaatgcatcccatctttaaaagctttcagctgccacgcccaagggcttcaagatgagaacgagacacaatacttcttaaagcagagtattcccctaccgagaatgaagatatgcgtccaagtttcctgtcgcttccagctttcaattcttttttaactgtgctttcttttgggattaaaaaataataatctcaatttttagattcaggaggtacatatacagatttgtcacatgggtatattgtgtgacactgaggtttaaggtacgaatgatcccctcagcgaggtagtgagcacagtatccaataggtggtttttcagcctttgctcccctccctctctcccccacaatagtccccaatgtcttttgttcccatctttatgtccatgtgtattcaatgtgtatctcccacttataagtgagaacacatggtatttggttttctgttcctctagctttcaaattaaaataacttattttattttttttgaaacagagtcttgctctgtcacccaggctggagtgcagtggcatgatctcggctcactgcaagctccgcctcccgggttcacgccattctcctgcctcagcctcccgagtagctgggactataggcgcccgccaccacgcccagctaatattttgtatttttttagtagagatggggtttcactgtgttagccaggatggtctggatctcctgaccttgtgatccgcccgccttggcctcccaaagtgctcggattacaggcgtgagccacggcgcctggcctaaaataacttataataaacacttgcttcaagcaggaggtcatgtaaatagatataacacacacatgttttttaaaagttacacagtcattttgttggaaaacatggaagacatagaaatttttcagactgcctaactgctcaatgggttcaccttacccaatttgtaactgcccagtgggttcaccttacctgctgcctagacagagccgatttctctagacaggggaatggcaatagagaaacagtaattatcacagaaccggctgagcaggagactggagttttattattactcaagccagtctccctgaacatttggggatcaaggttttaaaaaacaatttggtgggaggggaggggcagtgagctggggagtgctgattggttgggtcgaaggtgaaatcatgggtcgtccctgtcttcttgcactgagtcagttcctgggtgcgggggggtgtgggggtggggggcagtcacaagatcagatgggctggtttctcaatctgggtggtgccggttgatccatcaagggtagagtctggaaaccatctcaagtcctgactgtaggagcagtttagggagggccagaatcttgtagtctccagctacatgactcctaaagcataacttataatcttgtggttaatgttagtagtctagtccccaggcaagaaggaaattttttctggaaaagagctactatcatctttgttttaaacttttaaaactataaactaagtttctcccaacgttagttcagcctaaacccaggaatgaacaaggacagcttggaggttagaggcaagatggagtcgtttaaattggacctctttcactgtctcagtcataattttgcaaaggcggtttcggcttgggaagtgagaaaagtaagtctcgaagtatgcaggatatgatcccaaaatggttgaaaggaataaaaaagacaatacatgtttgcttagttttgttgctgctataacagaatatcacagactaggcatctatcaatggaagaatttatttggctcatggttctgaaggctgggaagtacaagaacatggcactctgatgagggtcaaaccaggtggaagggtggaaggcataaatgagcacataagacagacaggaaaagggggctgaattcccttgataagtgttaaatacagtgagttctaaatttcccgtcaaagaatcagtatgtcagtatgttcagttctttgttctccattttaaagtttaactttctcattctccttgcccctagtttcagtaaacaaccttttccaccatttctaatcagtagttcacatctatttcctggtcaccgcttcgatctgagtcacccctggtcacctgctctgacctgagtcacctgttcctaactgttcttcccatcaaactattcaccccaccactctgactcatacccctgctctctttaaaatagccaatcggaattagcttagactgtgtgatccaaccctagccaataggggaacaacacagcagcaggggttacctgcgtcaggaataaaaaccccttcccctctcttgttcagctgtgctctcaccattgctccatctgcaagtcacactcttctacagaagtaaaattgccttgctgagaaaattaaatttatgtttgagtgctatttcttttgcggcactgaaaatttatttctaacataagtaacccacttggtgataacagcactaatccactgatgagggcacggccctcatgatctaatcacctcttaaaggtctcacctcttaagaccatcataatggcaatcaaatgtcaatgtgagttttggcagagacattcaaaccacagcacatgtagacacgctatatgcattcatagaaaaaaaactggaaagatacacccaaactgttagtagtcatgatttgtaggaagtgaatttttattttgtttattgttctttatggtaccatttttctacagtaaattgattattttttaaaatcagaaataaccttcaataagtttttttaaaaaagataatatatgagctagatctttacctcaagaatttcgaaaaataaattatagttacactaatacaaccatggcattcaaggtgggctctctctctctcacacacacacacacgtagacacacacacacacactcacactcacgtaaatatactcacatgaacataaatacctaaagctatacataaagctctataggaacatttctggggggttatatggctatgtgtttattgatttcttgagacaaaactgctctgggcatctcagggaagttttctctttcttagcttgaagcaaccaggtatcacatttctgggttttaaaagagattatattcaaggatgctctattactttgaataggcgaaacattccaggctgatgggaattcatacctgtcaacagctgtgaattagcatttcaaaccccttctaatgtgacttatgaactttatcggtatgaggattcaacaccttgtagaaaagcaagtgctgaatgcaaaccagggtgaaaatgctttctgctagggagtagaagcctaaaggaatgatcaagatccatctgccaagaacaacttcacaggtggataggtgcaaaacgaccatgccaggaatgaggaaaatagacaatactttagatttctttcctttctttcctttccttcctttctttctccccttccccttcctcccttccttccccttccttccttccccttccttccttctttctttcttgagatggagtctcactctgtgtcccaggctggagtgcagtggcacgatctcagctcactgcaacctccgcttcccaggttaaagcaattctcctgcctcagcctcccgagttgctgggactgcaggcgcccgccaacacgtccagctaatttttgtgtttttagtagagatggagtttcaccatattggccaggctggtgtcgaactcctgatcttgtgatccacccacctcggcctcccaaagtgctgggataacaggtgtaagccaccgtgcccagcctactttcaatttctaactgggtatttagaggggtagtaaatatagctagaaaaaaaaagcttcagggtgaaatggtatgtttgatatttactcaccaaggtcttccccttttattatcactttttgttagtttccattcttattcctacaaggccacagccagaagtgggtgcaggagaaatgaagttctgaacatttgaatgaatgcctatttcaattccaatcattccctggaaaatgttaagtttaaagtaaaatggaatgaggtagtcctaacagctcaggaaacaataaaagggaactgagagctttacacgtcagaaaaactctcagacaatgcctaagaggattggaaagaaatttctaaaacatgtcgtccctacaaacacacatgaaaaactatcttgagaattccacaggaaaatatacatccatttaaaaaagaaactttgaagcacaaaaattaaagagaaaaggctttttcccagaatacaaaacactgcttgagttgtggaagaaaaagagctcattagtatttcaaaggaggttgataacttatttcaatgtccatactgggatagaggatgagccaagtagtatactcctcaaaatcctagggaccacttactctcctctgccatctcttattttatttctttttttgagatcgagtctcattctgttgcccaggctacagtgtagtggtgtaatctcagctcactgcaacctccacctcctgggttcaagcgattatcttgcctcagctgggattacaggcacacgccaccatgccccgctaatttttgtatttttagtagagacggggtttcaccatgttgggcaggctgatctcgaatttctgacctcaggtgatctgcccgccttggcctcccaaagtgctgggattacaggcgtaagccactgtgcccggccagaacctgcgtattaacaagatccccagatactgcgtctgtgctgttctggaggacataccatcccaaatcaaccctgaaggactgaaaagttagtgaagggaaatgcgggatagaaaagagggcaggtattctgggtagaggcgggaatgtgtacaaggccaccaaaataaaggaaagccagggatgccaactgttcagggtggctggatcctagtccatggaagagaaaaagaaagtgtgtattgagaaagggtgcagtgtggccaacggggaaggaagtgaaggaagattcggcctgagactagatcctgctaggctacggaaaccagtgctgaggagtttggactttattctgagggctttggggcacctctgaaggattttttttttttttttttttttgagatggagtctcactcttgtcgcccaggctggagtgcaatggtgtgatcttggctcattgcaacctccgcctcccgggttcaaattattctcttgcctcagcctccagagtagctgggattacaggtgcccgccaccacgcccggctaacttgtgtatttttagtagagatgggttttcaccatgttagccaggctggtctcaaactcctgacctcaggtgatccgcctacatcagcctcccaaagtgctgggattacaggcgtgagccacagcgtccaggtattctgaagggtttttaaactgaggagtgacttgatcagatcccctgaagacacatggtgcttcagctcattccactcctgagtaattccttactcatttcaaactaccaagagtccacccattttgtctgtgctaactcaagtctcttccagtcatggtggctggaactgatctgtttctcaaccctcaactcctgcagcactgtggatggaccactcacatggtctttgtcatggccactccatttctgcagtgagatttttgtctactctcttctactgatacagcatagcttttcaaagaacagtttccaaggaccacctatttcaggatcatctgagggtatttaataaaatcaatttccaaggcccaagaccccctgaatcggtatctctgtgtgtggggcccagatgtttgcattttaaaaaacattccagtcagatgacgtggcttacgcctgtaatcccagcactttgggaggctgaggcgggtggatcacaaggtcaggagatcgagaccatcctggctaacacagtgaaaccctgtctctactaaaaatacaaaaaattagctggttgtggtggcgggtgcctgtaatcccagctactccagaggctgaggcaggagaatggcgtgaacccgggaagcggagcttgcagtgaacagagatcatgccactgcactccagcctggttgacaaagcgagactccgtctcaaaaaaaaaaaaaaaaaaaaattccaggtgaagctcttaaatatgaaagccagagaatcacagtataagactacagcatcctgagacccagagccatcccagaaaccctagaatcagacaccgcacctctgtctacaaccttggcatgcggctgctcagggagacaagtaaacgaagtgttttaaattcctctctctactcattcttgattacataactaatcaaaatgcttccaaaaaccaaccaaccaatcaagaaaacttctaggaacttaattaactccagtataaaaggactcctcaggccgggtgcagtggctcacgcctgtaatcccagcactttgggaggccgaggcaggtggatcacgaggtcaggagatcgagaacgtcctggctaatacggtgaaaccctgtctctgctaaaaatacaaaaaattagccaggcgtcatggcaggtgcctgtaatcccagctacttgggaggctgaggcaggggaattccttgaacccaggaggtggaggttgcagtgagccgagatcgcgccactgcgccactgtactccagcctgggcgacagagtgagacaccatctaaaaaaaaaaggactcctcattcctgctgtgtactctgtctattggcctatgctcagaaagggctttttctttatgagacaggaatgtgcccggcttctgtcatcacatatataagacagacaagactggaatcaaactttcccacagaattggcgtaaggaccgaaagagacattatgtatctttgaaagcgccatggatactgcttactctgactattattatgaatgctttaagttggtcatttaggagctaagaaacactgatgagattctgtcttgtatgagcatgattgtggtgtttctttctctctcctgctggactttaagcaacttgaaggtaggactctaaggctgacgcaaccgcgggatcctcccatagcacagcattgctgaagggattcaataaaaatgtgatgaatgggtgaaagatgaccatgtcacagaagcccacgtgtaataaatagttcatttggaatgtgcacctgcgtgggaattctccaaacacctgccgaggccagtaactcctgttttctcagcctatcaaagagggcagctgctcctttccctcaggtgaccttctctcatttatcaaagctggaaagggctgtgattttccccaacatgcagactctctgagcaattaatagccctctcaaacagacttgtcctctaatgtcgatctgggaaaatgccatttaaaaatttgtttcactgaacattttcacaaaatgaaaattagaagatattaaaggcatctggctatgttaagtaacgggaatttatagtacttaaatttatctgcaaaaggaaaacatgataaacactagcatggttttctatcatttaaatcctaaattcacaggatggaacattcaactcctgattttccagaaaatctactcttatgaatcctaaagttatcttgaaaggcaggctttgtatttttccagtgaatatattgctgtttcttatcaatgttgcacttgatttttttttttttttttttttttttgagatggagttttgctcttgttgcccaggctggagtgcaatggcgtaatctgggctgaccgcaacctctgcctcccgggttcaagcgattctcctgcctcagcgtcctgagtagctgggatgacaggcatgtgcgactatgcctggctaattttgtatttttagtagagacggggtttctccatgttggttaggctggtctcaaactcccgacctcaggtgatctgcctgcctcggcctctcaaagtgctgggattacaggcgtgggccaccgcacccagctgaaatgatttttaaattgtaaaatttaaattataaattataaattatatatataaatatatattatatatataaattataaattgtaaaatttaaaattgtaaattataagggactcttttctctagtagataccacctttaaagtatcatgtggaaagtcgaaattaagcaatttcacatggaaatggaggttttggcttgccttgaaaaatcagaagagactgcgatattgggcccacattgctacctggcaacaatcacctggggctgacctcttgagagggatgctctctggttttgcttctctactgcagcctcactcctttctatgcccgcctggcctccacaatgaataaagagaaggaggcatggcttctcttccaaagatacatatattcatggatctctaataaacgaaagagtgaaaatacgtaattggcatagagggaaagtagagtagtcgccacaagacatgacttttttgtttgtttgttttttgagacagagtcttgctctgttgccaggctagagtgcaatggcgtgatctcggctcactgcaacctctgtctcctgggttcaagcgattctcctgcctcagcctcccgagtagctgggattacaggcatgtgccaccaggcctggctaatttttgtatttttagtagagacggggtttcaccatgtaggccaggctggtctcgaactcctgacctcaggtaatctgccggcttcggcctcctaaagtgctgggattacaggcatgagccaccgcgcccggccaagacatgactcaagtgcagctgaagcaagatttgaagttgaacagcaactgaggggagcccactgtgtgagcaaatgctgagaagcagaaatggacaagctaggtttgggggagaagaaataactggtttggctatagtgggaggtttccataggggtagaggaacaaggtggcagacgagaccatgtagagagaccgtggagagcctcagatccagagccaaggactgtgggctgtgcactctagggcagccatccccaacctttttggcaccagggaccaggttcacagaagacaatttttccacggcctggaggggaagggggagatggttttcgggatgaaactgtttcatctcagatcatcgggcattagagtctcataagaagcacacaacctacatccctcggatgtgcagttcacaatagggtttgcgctcctatatctaatgctgccactgatctgacaggaggcggagctcaggtggtaatgctcgctcaaccaccgctcacctgctgctgtgcggcccagttcctaaaaggccacagaccggtaccagtcctggcccaggggttggggacccctgctccagagccaggttggagctctccaaggtttacactaacaagggcctggcaagataagagtagtgtttcaggatgatccagtggggggcccttcagagaatggtgacagagaaaatgcaaagggagagccctaagcgtgcaagacatgctatggcctgaggggcagtaggcactggaggaggagaaagagctccacataggaaaggaattgtccagccagagctacgggaagaacagtggtgccaaacacaaataccggtgtgggctggcttcttgtctgggtttcaagtgtgtgtggcgcgtgtgtttatgatagtggggtgaggggttgcaaatgatgaatttggtttaaactttttgagtgccaggaaatgacagggagatcaagagacagatgtgcagataaaagtgcaaatggccgggcgcggtggctcacgcctgtaatcccagcactttgggacactgaggtgggcagagcatgaggtcaggagttcaagactagcctgaccaatatggtgaaaccccgtctgtactaaaaatacaaaaattagccaggtgtggtggtacgtgcctgtagtcccagctacttgggaggctgaggcaggagaatcgcctgaacccgggaggcggaggttgcagtgagccaagattgtgccattgcactccagcctggtgacaagagtgaaactgtctcaaaaaaaaaaaaaaaaaaaaaaaaagctgcaaatgtgaggatgcactgagtggtaaggacagctggagccaggagatggagaaggtttctaagaaaaacatgccccaagaggatctggaccacaaaacccagaaatgcttctgctccagttcaagaagcagtggagatgtgattcttcgatacgtagccttagaaaccaaaccacactgttgccccgggtactctcaaccactccaagtttttatagagcctttggaatgatggatggggctcagtttacccagagacagtaaaatcagatgaaaggggttaattagaactgttctctctactgctaggtgcaaaacagccacattggagccatgatgaagctacgtctatttaaacagccaaactgatcattgtaactgttttctctcttaaaataaaccccatgcttttagccatattcctgcttcttaaagcctctcatgtgaaagatgccaaaataatcctggaccttaaagaggtcttgatttatcatttcacagctggttcccatgcacctccctttccactttttcagagcctcactatataaatcctgccatcagatcagggaggcaggcatggtggtgatggatgtcaaacctgcgatggggaaagtgaagagcagttccctactgggaacagataagccagcagacttctcacagactgctcctgttaccaactcagccaaccccaccccctcctcctgctcccttggccctccccatctgccggatagggcctcccttctgctgcgaagcttccactcctgtagtgttctggtttgcgttctttgatgagaaatattaattccaggttaatactgatgttaaaaaataaaagcccgacctaattaaaaattcaagttaattttcacccaggttcccttaacttttaaaaaatgttctttttgtaaaaaagagtaaataggttacatgaggaggcccaagtaccaggaattgattagtggcacaatgaaaaaagttacaaaatataacaacaaccacttaaagcaaagttaatctagtttgctcaacagcccaggacttttgctgcctaagtacaggatgcttccttgcatatacttgcaaatttcaccttttaggctaaggagatgtttttcaattgatttgggaaggaggaaggggtcaagaccacggaggctccaggtaaaatgctgtaggtgggcagtctgcctctgatactaaacttttttttttttttttttttgagatagagtctcgctctgttgcccaggctgtcatgcaatgtcgtgatcttgtctcactgcaacctctgcttcctgggttcaagcaattcgcctgcctcagcctcccgagtagttgggattacaggcgtccgccaccacacccagctaatttttgtatttttagtagagacggggtttcgccatgttggtcaggctggtctcaaactcctgacctcaggtgatctgctcacctcagcctcccaaagtgctgggattacaggcatgagccaccaaacctcttcctttctttgctctcttcccatcacccagccctcctctgttcagtgcccaggcacactgagaccccacactgctgtctctggcctgcaaagatgcacaatgccacctcatgtaggcctgcttgcctgccccacccacacccccaactcaggtcataacatcactttcccatcaaagctccagtttccctactatggatgatttcctggtgatatttttaaaatcaaactaagcgactctaaaaggtgaataacaaactcattgacttcccactgtctcacacacaacacacccagcctttgcatctggtttagtgacttgttagcttacatccttggtcataacttggcagccagggagccaagtctgatttgcagttgtgttttaacctggtcagtgttttaaaaatcggcaaagtttacacaaaatcatcgctctctctctttctctctcaggagacaggtgatatggcatcctggggccacagttccacagggtagcagacgaggggctgaagagcaagttctctgtgggctctagttcacagggacacctgccactcctgactgtcatatacacacagctctcattttctttcttttttttttttagatggagttttgctcttgtcacccaggctggagtgccacggtgcaatctcagctcactgaaacctctgctccaggtttcaagtgattcttctgcctcagccttctcagtagctgggattacaagcatgcgccaccacacccggctaatttttgtatttttattagagacagggtttcaccacaatggccaggctggtctcaaactcctgaccccaggtgatccgcctgcctcggcctcccaaagtgctgggattacaggtgtgagccaccatgcctggccacatatctcattttctttacctggttgccatttgaatttgtgacttctggcttaaatgactctctaaatgagagcacaattaaataatttcacagaagtagggacaaagatatatttttaaaattttttatttttagatgacaaagaatatatatttatggggtacaaagtaatgttttagtatctacacacattgtggaatgattatatcaagttagttaacatatcccttatctcacatactttttttttttttttgtagtgacaacatttaaaatttgttctttcagctactttgaaatacagttgagtatcccttatccaaaatgcttgagaccagaaatgtttcgaactttggatattggaatatttgcattatacctccgggttatgcattccttttttttttttttttttttgagatggagtttcactcttgttgcccagactggagtgcagtggcacggtctcagctcactgctacctccgcgtcctgggttcaagtgattctcctgcctcagcctcctgagtagctggaattacaggcacacgccaccacacccggctcatttttgtatttttagtacagatggggtttcaccatgttggccaggctggtctcagacccctgacctcaagtgatctacctgcctcagcctcccaaagtgctgggattacaggcgtgagccaccacgcccggccggcccctgactattaagaccaggaagagtaatcatggtacaggaaagcagatcctatacagtaacacagagggcattttcaacaggagatatctgttgctttgcctttcagtatcactcttggctccttttcctcctctctcaacttttatatttcctctctttcatctctctgtctatccctccccatttctctttccttgactaaaccaaatattaccacgggagcacacatcttacagcactctgcctgtccatcccacttaacctcaatcctcagcactctggtgtgtcatggaaaattaagaatgtttgagaagtaccacggaaagaaaaagtttagcaagcaatgaccacaaaccactaaccctggtcacatctggtcactgttcttgacaaaactcaaaaactttatccaacactcaatggggggccccctctagcttatgcatgcaggtctgagggttgatttcacatgcatccaaataaagtattttaggaaaaagaaaacaaactcacaagccaggaggccaggaagcaaagagactccctagagcttctaacttgctgactggccacagtgacaccataggggtggctacactgaatctggtctgatgttcttaccagttttatggctgtaccagttttatgacagtgacatgaagagatatactcaaagaaatgcctctccttgctgggcacggtggctcccacctgtaatcccagcactctgggaggccgaggtgggcagatcacctgaggttgggagttcgagaccaacctgatcaacatggagaaaccccgtctctactaaaaatatacaactagctgggcgtggtagtgggtgcctctaatcccagttactcgggaggctgaggcaggagaatcgcttaaacccaggaggcagaggttgcagtgagctgagatcacaccattgtgctccacagcctgggcaacaagagagaaactccatctcaaaaaaataaaaaaataaaaaaaaaaaaagaaatgcctctccttttcagcaccttcagaagttagatgtatccccaacatctcctagttcactttaataacccattgccactctacataaaactgttttgaatcttttacaccaggaagccctcagccttcccaaattgcctgggctgctcaataccataaagctcctagagaaatgactctttatgaaaagtagtacttgtttctaatggagcagctatatatggaagcttttttcctttttaaaaataaattgtaaaatacataacaaaaatgaccattttaacaaaagtataaattcattggcaaaatacactcccaatgttgtgcaactatcactactacttattccagaactttctttttcttttttttgagacagggtctcactctgttccccagactggagtgcagtggcacgacgtcagctcattgcaaaactctgcctcccaggttcaagcgattctcctgcctcagcctcccaagtagctgggattacaggcacctgccaccatgcccagctaatttttgtatttttagtagaaactgggtttcactatgttggccaggctgattctagaacttttcatcagcccaaaaggaaacctcatacccattaagcagtctctctccatttctcccaactccccagtccctggcaatcactgatcagctttctgtctctatagatttgcctactctggacatttatataaattaaatcatataatatatagctttttgtttctggcttctttcacttggcataatgtttcaaggttcatttatattttagcatggattactacttcattccttttttgtggttgagtaatattccattgtatggtgtgtgtgaaggcttttgtgaaataaataatggtggttggatagtatgtaactgcaagctactaaactgaaggaatttatcctgtgtgacaggtggtatttcttttacatatgaacattgtagaatatgggaacctgctgggcgcggtggctcacacctgtaatcccagcactttgggaagccgaggtgggcagatcacaaggtcaggagatcgagaccatcctgacgttgaaaccccatctctactaaaaatacaaaaaattagccaggcgtggtgcggacgcctgtaatcccagctactcagaaggctgaggcaggagaatggcatgaatctgggaggcagaacttgcaatgagccgagattgcgccactgcactccagcctgggcaacagagcaagactctgtctcaaaaaaaaaaaaaaaaaaaagaatatgggaaccaatgtatagcctatccaaaccattcataatctaataaactttctatccctattcaaatttcatctttccagactgagaagtcctttaaaaaaatttgaaggctcagaaaatcctcatccacattatttcagttgcctttcaatgaatccaattcaaaggcagtcatttgtgctagttgctgggaatcagaattgcaagacacagtccctgcactcaggaagctcaaggtctagtgagaagataaacatccgaacaatttcaccacactgtgataactttcaggatgtaaatctaaactgtaaggactcaagttcacgaagttttccagctgagggagcttatgcaagcttaatatgtgggtcagaaatgctttggtttggcttcctaccttcctgatggccaaggtcttcagagaaaagcttatacattaatcgtcccttatgcatggaggacgcgttccaagacccccaagggatgcctgaaaccagggacaggactgactctacaaatactatcttttttcctatacatacatacctacgataaagttaactttttgagatggagttttgctcttgttgcccaggctggagtgtaatggcacaatctcggctcactgcaacctctgccttccgggttcaagtgattctcctgcctcagcctcccgagtagctgggattataggcgtccacttccatacccagctaatttttatatttttagtagggacagcatttcaccatgttggccaggccggtctcaaactcctgaccttgggtgatctgcctacctcggcctgctaaagtgcttagattacagacataaggtaagccactgcacccggccgataaatttattttcttttctttttttttttttttttttttgaaacagagttttgctcttgttgtccaggctagagtgcagtggcgcaatctcgcctcactgtaacctccgcctcctgggttcaagtgattctcctgcctcagtctcctgagtagctggaattagaagtgcccaccactacgcctggctaattttttgtatttttagtagagatggagttttaccatgttggccaggctggtctcgaactcctcacttaaggcgatccacccgccttggcctcccaaagtgctgggattacaggcattagccaccacgccgggctgataaagttaatttctaagttaggcacagtaagagattaacaaccataactaataataaaatagaacaattataacaatataccgtaataaaagttatgtgaatgtggtctctctctctctctctctctcaacagatctgactgtactgtactcctcctccttcttgtgataatgtgagaggatgaaataaatgcctacgggatgagaggaagtgatcctcctgcctcagcctccctggtagctggaactactggcatgcaccaccacaccgggctagtttttaaatttttcttttgtagagatggggtctgactatgttgaccagactggccctcaaactcctggcctgaagcaatcctcacactttggcttcccaaagtgcggggattacaggcgtgattgtcccaaatgtcagcagtgtgacactgcgttaggctactattgacctcctggcaatatgtcagaagcaagatcatctggttcgagtaatcctgaatcactgagccctgatgatggccatagctggatgtgaggagcagatcatggtaatgactaatgaatgggccgcgtatacagcgtggatacgctggacaaggggatgattcatatccagggtgggatggggtgggatggcgtgagatttcatcacacttctcagaacagcatgcaatttaaaacttatgaattgtttacttctggaattttccatttaatattttaggattgactgtggttgaccacaggtaactgaaactgtggaaagcaagaccaagggggaactactgtaatgagagcagttggtgttgctttcctgagtagctgggctcttctgattgaccctagaagttagcatctatcatatttgcctaatgcgacatcttgctcacactaaagtgtttttttttttgtttttgtttttgttttctttttttgagacggagtctctgttgcccaggctggagtgcagtggcacgatctcggctcactgcaacctctgcctcccaggttcaagtgattctcctgcctcatcctcctgagtacctgggattacaggtgcccgccaccacacctggctaatttttgtatttttagtagagacagggcttcaccatgttggccaggctggtctcgaatgcctgacctcgggtgatccacccgccttggcctcccaaagtgctgggattacaggcgtgagccaccacacccagcctaaaatgtttttatcttttaaaatcttcctatctttcaggatgagatataaaagtgctgattagtagcagacctagaaagaaatttcatcaggcattccttcactccttagacatattaaaaatattaacatgggaactaaggcactaacccatgggcagcttcatcgtctatactttccatctttctctccaactgtttatgttgaaagatttcaacctgacagaaaagccgaaaagatagtataatgaacatctatataggccaatgttaaatggtgaataatgaatgtttttaatgtggttatatgtaataatgtcataataatgtagtgatttccttgtctttttttttttttttttttttttgagacggagtctcacactgtcacccaggctggattgcaatctctgcctcccaggttcaggtgtttctcctgcctcagcctcccaagtagctgggattacaggcgcgcaccaccacacctggctaattttttgtatttttagtagagacagggtttcactatgttggcctgactggtctccaactcctgacctcgtgatctgcccgcctcggcctcccaaagtgctgggattacaggtgtgagccacggcgcccggcctattcatttctaaaaacttaaacatgcatctcctaagaacaagaatattctccaacagaatcatatcattgttaatctgaagaattttaacactgatacaacattatctaatgcacagtccatattcaaatgtccctcatttactcaataatgtccttctagctgggtatgtttttaaaatctggaatccgatcaaaatcagaaactgtatttagttgtcatatttctttagtttcctttaatctacaattcttctatcctttttctatccttcatgaccctgatattttccttgtctcacagaacacccatcaatctgaactactcttatagtgtctgttgatgtcattcaagttaacatttttggcataaatacagtaggtgatgttgtgttaattataccgcatcaaatttggagcagtgtactgtgtcctgtaatcctagcgctttgggaggccgacttgggaggatcacttgagctcaggatttcaagaccagcctgggcaacatggtgagacccccatctctacaaaaaatacaaaaaattagctgggtacggtggtgtgcgcctatagtcccagctacttgggaggctgaggcaggaggattgtttgagcctggaagatggagggcttcggtgagctacgattgtgccactgcactccagcctgggtgacagagcaagatcctgcctaaaaaaaaaaaaaaagaaaaacaacaaaaaaaaacttggggcttcataatccaggttgtcatactcctggtgatgctaagtttgatcacttttttcaagtgtctttcctccttaataattaataaataatctgtgtggtgatactttcagactgtggttatcctgcttcccatatcttttcacccaatagttttggcattgatggtcaatcctgaaacaattactggtggttgcaaaagctgtttttctaattttatcttttttttttaatatatcttagctgggagaaagagcctctccccatccttactcccactttttttttttttttttttgagacggagtcttgctctgtggcccaggcgggagtgcagtggcgcaatctcggctcactgcaagctccgcctcccgggttcacgccattctcctgcctcagcctcccgggttcacgccattctcctgcctcagcctcccgagtagctgggactacaggcgcccgccatcacgcccggctaatttttttgtatttttttagtagagacggggtttcaccgtgttagccaggatggtctcgatctcctgacctcgtgatccacccgcctcggcctcccccttactcccacttttttttaagtatcactgtggatacgcaaactcatggactcatggatgcatttttcaagttcagtatctataatccattaacattgttattctttttattgctccaattgcctccattttttttttcagactcttttttcagggtcttactctgttgcccaggcaacagtgcagtggtgtgatcaaagctcactgcagcctttaactcctgggctcaagtgatcctcctgcctcagcctccctggtagctgggactactggcatgcaccaccacaccaggctagtttttaaatttttctttggtagagacggggtctgactatgttgaccgtcagactggccttaaactcctggcctgaagcaatcctcacactttggcttcccaaagtgctgggattacaggcatgactgccccaaatgtgacctgtgggagtccctataagtcagctcctgtgttcttttacatagccccatcattgtttgtgcgcttccttgatctcagacccaagatgttctaggcttgccttttatcttcctgtcccagatttagactcagttgctcctgcaaagagtcttagtttcttttgggagtgaatagtatttagaaaccaagaactgggtgtaaactgtgctcattactacaggagtatcactgcttctacatgctttcagtggttaaagtgggcaatgtatttatttacttaaagtagcagcccaccatgatacttccaattcaaaccaaacaccataaagatcattattacttttctcattcacattcactatttatctccctagttcccaataacatcaatatatttactcacttactctccccaactaatacacaaagcagatccagaattactctaatatcactctaaacaataaatctacttagtagaattcaagatttctgcaattcaatgtccttaaaaatatccaactaagggtgcgtaaagtatatttaagtcacttacattcttctttactgaatacattctctgtattttaaattaacagatttttctttcctatttgtaagtttatttctcaagatataacagaacctacaaatgtaaagagcttcaaaattttaacaactattttatcaaaatgattaatgtataagctaaaaagtcaagtaatcctaaaaaaaggttataataaaaaccagtgatttctacctgctccttctgactttcctcctcatcaaaagcactcacttttcacttattttggctgtttcttctgttacttatctccacacttttaaactatatgcccataccataatctttaaattccatcaattttaaatattacacagtcaccttctctttcattataggagtatttagctctcttgtactccacctcttcaatctcccatctaccctatagttgaatcatatattttgattaaatcaaacatctaacaattacgttatcatggctatgtttgtatttactcttaacatactataatcatgcttccatttctgtattactttttgttttcctggaattaataattgtctcactttttttttttttttttttttgagatggagtctcactctgtcacccaggctggagtgcggtggtgagatctcggctcactgcaaccttcaccttctgggttcaagtgattctcctgcctcggcttcccgagtggttgggattacaggcccgtgccaacatgcctggctaatttttgtatttttagtagagacggggtttcaccatgttggtcaggctggtcttgatctcctaatctcatgatccgcctgcctcggcctcccaaagtgctgggattacaggcaggagccaccgtgcccggcccatatttactcttaacatactataatcgtgcttccatttctgtattactttttgttttcctgggattaataattgcctctctttttcaattgcttgaaatccctcctactaaatctcataaccttcagcaatcactcagtgtaatttttcacgcaggaaaacataccatctattttccctcttagctctagctctctattctagaacagctgttctcttggtctgttgtgcagccttccactgctgtcatcctgggagttgtctttacttctctcccttgtttctgtcctcccagatcttctttctagggttaatatttgtcagtagcttcctgcaatactaccacccctgtttttgctgagatattggatgccattctaagttcagatcctttgaaagtaatctgttgtcccctacctcccacccctagggaggcagaaacttctctttaactgggtgctctgaaatttcattatgttgtgatttgacatgggtctttttttatttcatttcttaagctggatattgataatggactctttcaataaatatggttactcctgtctgtcagttcttgggaaatttctggcattatttcctttggtaatttgttgactgttgttttctcattgtggcattcctactctttcgatcttggatggatcctctaattttgatatcttcctgtgtcttttggttctactttgtggaacttttttttttttttttttttgagacatggtctcaccctgtcacccaggctggaatgcagtggcacaatcacagctcactgcagccttgacctcctgggctcaagcaatctcctctcgcctgtctcctgaatagctgggactacaggcatgcaccaccacacctagcaattttttttttttttttttttgagacggagtctcattctgtcgcccaggctggagtgcaatggcgcaatctcggctcactgcaacctccgcctcccgagttcaagcgattctcctgcctcagcctctcgcctcccgagtagctgggattacaggcgcgctccaccactcctggctaatttttgtatttttagtagagatgggatttcaccatgttggtcaggctggtctcgaacttctgacctcgtgatctgcccgcctcagcctcccaaagtgctgggattacaggcgtgagccactgcacccggccacctagctaatttttaaaaacttttgtagagacagggtctcgctattttgactaggctggtcttgaactcctggggtctagcaatccgctcacttcagccctccaaagtgctgggattacaggcaaaagccaccaggcccagcccatctcttcaactttgaaactgccaggagtgaccactgatccttcccattcattgctttttttcacagaccacctctcagttccttcttttacagagagaaagaaaggaagtagctgagggatgtaagccaacttaactagaagacattaagttcagttgttctacatttgttcacatctaaaattacttaatatgtaggtggtaggtccatttgtcaagcagtagaaatagcatcgttccttccagtagctcagtgtgacaatactgtttcttctattaaaacaatgtctgcattttggggtttgcagaaattcactgtttggcatgactttaagaatagctctaaccaaatggtccatgagaatacataaaaacctttttcagttcaacaggtccacgaagaacccaataattctgaaagaaacatcgaaggctggaaaaacatgtcagatgattgtcaggagaatatatgttgcacatctcagtggtgcccatgtaagctgcctatatgccaggtatgacctggtgtctgccagctccacacctgcccttctctgctcagtcatgctggggcttggagtctgtgaactacccttcccaggctcccctgccagctggcttcctgttatgttctgccaaaataaggcactgtcaggagttcagaaagcaagaagaggggtgaggctgttcctcttcctctctttccccatctgcttctggcagcatctctgcaagtgtctgtattctaacagtgttccccatggcagtggcagcctctctttggcagtcccagaacgagcaaggcaggcctgcttctgctgcagcccaggggccaggtcctaggcatctctagcactggctgagcggcaatcccaggagtactgtggtgtgcagcagcgcatttgcatctttgctctcctaggcttaagggtggcagctgcttcacacaaggactaatttctggattactgcaccttccccttttcattctctccatccttttaacagttttttttttttttttttttttttttaggcaaagtcttgctctgtcaccccggctgaagtgcagtggcatgatctcaactcactgcaacctccgcctcccaggttcaagcaattctcctgcctcagcctcctgagtagctgggattacaggcatgtgccaccatgcctggctaatttttgtatttttagagacggggtttcgccatgttggccaggctggcggtctcaaactcctgatctcaggtgatctgcctgccttggcctccccaaatgttgggattataggcgtgagccactgcgcccggcccttctaacagtattctaacaagttgtttgcattctgtctcctctgagtgaaatacctagtatggttattctttttcctgattggctcccaactgacggaacctctctgagggatttaaaaaataagaagaaaaaaagactggccaggcacggtggctcacgcctgtaatcccagcactttgggaggccaaggcaaggtggatcacctgagctcaggagtttgagaacagcctagcctgtggttttgtagaaaactccatctctacaaaaaatacaaaaagtagctgagtatggtggtgtgcacctgtagtcccagctacttagggggctgaagccagaggatctcttgtgcccaggaggttgaggctgcagggagctgtgatcatgtcatttcattccagctggacaacagagtgagactctgtctcaaaaaaataaaataaaataaaatataaaaaattaaaatttttaaatactccagaagtcttaattttcagaaagagtgaagggcgcaatgcctcatctatggttatgattgcaaaagtacaaactgatttcaattgttttattgacaaagtcatacatctctagaagatgacagtttctctaatgtgaagtcccaaattcaagaggatttccattagtttccagaataagtagctaagtgcacaacagccctctctgtaaagtttgactgctacaaaaataagaaaactggtttgcatgctgctaagatgaccgaacacaaaaacatcttttaataaggagctgaaaccaagttgggagaaggctgcttcagtcttcaatttttaggtgcagtggctcacacctgtaaatcccagcacttcaggaggccaaggtagatcgtttgaaaccaggagttcaagacaagcctaggtaagaaagcgagacttcatctctaccaaaaaaacaaacaaaaaaattagctgggcatggtggtgcacacctgtagtttcagctacaggggacgaactccagggctcaagtgatcctcctgatagcttagcacagaggtatgaccatgccactgcactccagcctgggcaactgagcgagaccctgtctctaaacagaagggaaaaaaaggtcttcaattttgcaaaagggcagccatggtacaccactcagttgttcattcacggtcttcaacccactttaaaaggcataatggaaatgacaagaaaacagatacaaaaggtatttttaagaggatgcggcagaatgtatcataaagttattacacagtaacagtttttaaatgcacttcttgggactattcctgtgctccgttatcttctaaacacacttccagatggccccatgttcggtgacacattgaggagagaaagcggctggtgaggccacacaaaagaaaccggaggatggcagggtgctaggaatgctggctgaagggtgggatgcagcttgggcatgaggcctttaaaaggcatattcttgaccaagatgataaatagagaggacagtaattaagggaggaagactggaactgagagaaaacaggaaaggagagagtagggggaaaagattacaaagagagaagtgaggatgagtacaggaaactccgggagcacccaataccccagggcaggagatgtgatttaaggatgggaacattatggctgtatttgattggcttacatgtaatagtccccagccccttgggggtcaccagtgctacagggaaacctgggtgggattatatccagcatcctctcagtggaactaaggcttttttttttctttttttttttgagatggagttttgctcttgttgcccaggctggagtgcaatggcgcaatcttggctcactgcaacctccatctcccgggttcaagagatccttctgcctcagcctcccaaatagctgggattacaggcgcctgccaccacgcctggctaatttttgtaattttagtagagatggggtttcaacatgttggccaggctggtattgaactcctgacctcaggtggaactaaggctcttgagcctgactttgggcgttaatacgcaggaaaagaggtattactctctgtggaagttatcaccttcaagataaacacactggccctgggaagaaaggttgaatagagagcctgaaatccccaaagagaaatcccttgaagggctcctctgaactcccatcacccacaaacttaagagttttcctggtattccacaatgctgagacatattttttttttttttttttttttgggacagagtcttgctctgtcgcccaggctggagtgcagtggtgcaatctcggctcactgcaagctccgcctcccacgttcatgccattctcccgcctcagcctcccaaatagctgggactacaagcgccgaccaccatgcccggctaatatttttgtatttttagtagagacagggtttcaccgtgttagccaggatggtctcgatctcctgagctcgtgatccgcccgccttggcctcccgaagtgctgggattacaggtgtgagccaccgtgcctggactgtgataggagttttaattttctctggttaatgaaatttcagggaagggatcaaaggtgattttatttctctttggtgggtcctgtttccaggcagataagggagcttcagagaagagcctcattctgtgctttgggagggacagaggattgagggacaggagtggggagaaggttaaagagcccctgaggtgtctttagttccgcgtgtcaaagggccattttttgaggtattgtttcctgagcctgacatacggaacaggatggcacaatattttgaagatgccaaggaattttgaaattacactattttaaccttgccataatttaatggaaagggggaacaccaagtatttcttcattttttaaattaaaaactttctattgtgggcaaaatacatataatgtaaaattaaccgtcttttttttttttttttttttttttgagtcagagtctcactcttgtagcccaggctggagtgcagtggtgccatcgcagctcactgcaacctctgcctcccgggttcaagcgattctcctgcctcagcctcccgagtagctgggattacagtcgtgcaccaccacgcccagctcatttttgttatttttagtagagatgaggtttcaccatgttggccaggctggtctcgaactcctgacctcaggtgatctgcctgcctcggcctcccaaagtgctgggattacagtgttgagctaccatctctactatatttactcactttcaaaagaacccttttctgttttccttccagataagttataccagccaaaatatcaacaaaatggtgaaaaatcttaattccctgtctgcaagaaaaaaaatatttattagtgttaaaaaaaaaaaaaaaaagactgtagaaatccaaaagtcattttgaaagcaacgaccgttttaagggccaaaagagaaatacgggctgtttcgagcgtgaatcaaagtgtcaaagaacatttggaggctgctcggtagacatgcactctctcaaggacaactgagatgcatgcctgactgagtcacggctgagcacccagcgctcagcagtcagctccagagctgcagaaagtaacccagtgagacccgcggtgccggctacaggtccctgacagctgatacccaacttcaatacaaagatcaatttgctgctagtccagagaaattgaccttcgtgttcagactcatgggcagaaaaagtcaacagtgatttaaaaatgaaccccaaatcaattattctaaggaatttaacgctggttcaatgactgaaaattgtcattgcctggctctgaaatagaaaggaaaggtgagccaaaaaataaataccgagtcattggtaaggttctgttggagtcaattaatggatccctagagctgattaaagaaaaaaaaattattaatgcaacatctggagttaagttatttaaaagctaataccagggcttatgccactgaatttccaagggacttggcaaaggagaattatctatttattttctaaataccacagattcctttaaattacccaacctctcttgcttcattcaaacatgtgcagcttcaagtgggcgtctactgcattagattagataagtcacaagggcagagtctctggactgcaggcgttgctttgcagttgagctgctctcttcacatgggtaccaccataatgtatgctccagggtgaagagcagcaggagtagggatttactcacggacagaacaatcaatgtggccaacagagatgctttgtacagaattactaattagtgcagcaaggtattaattattataatttctaaaaatattacaattccatctttaattttgtttagttccattcaacttttaacagtgattgtttcttgtaagcaacgttagatgtcacaactaacatgaaagcaaaactgtgtctcattctctgagcacgcaccaataactggcaggagctggatgcctcttaaacagagtggcaagcaccagaaagtcaggaaggtaatctgatatttgaatttccatttagacaatatccaaagaagataatccatgtgtgattaactgtgactttaataaccctacaaaccacgcacgcctccatttgattcattttatagttacagttttaaagaaaggaaaggcatcaaatctgtacccaaaacatcaattttagggaacttattcaaaaaatttaaagtgtctaccagctcacttttaaacatgtaactaggctggacgcagtggctcatgcctgtaatcccagcaccttgggaggctgaagtgggcagatcacttgaggtcaggagttcaagatcagcctggccaccatggtgaaaccccgtctctactaaaaatacaaaaattagccggggtgttggcccatgcctgtaatcccagcttctcaggaggctgaagcataagaatcgcttgaaccagggaggcggaggttgcagtgagatcgtaccactgtactcgggcctgcatgacagtgtgagactctgtctcaacaaacaaacaaacatgtaattaaaaacagccctagagctataatgccaacttgggagaaaaacataaggaatctctatctaccaattacttttgaacacagaacccagaagtaaagattctctgtaattctattcctttattttcctgccctaatacatactaaaacctgccaaatcttctccttatcttccattaaaaattctctctctggctgggcgcggtggctcacacctataatcccagtactttgggaggccgaggtgggcgtatcacgaggacaggagtctaagaccagactggctaacatggtgaaaccccgtctctactaaacaaaacacaaaaaagttagccaggcgtggtggcgggcgcctgtagtcccagctactagggaggttgaggcaggagaatggcgtgaactcaggaggcggagcttgcagtgagctgagattgtgccactgcactccagcctggagcctgggcgacagagtgagactccgtctcaaaaaaaaaaaaaaataaataaataaataaataaataatctctttcttgttttgttccaatgagaaaaactatatatgtttgaaaaaaaaattcaaataataaaaacacactgaaggtaaaagtctctattcaggtatgatttaactctgcatgtatttaacttgatgcggccaccctgtatgataggagaggatcagcaaaggtcttgcctattcccctagctcataactgatttagtgtgagtgcacgtgtgtatacagtgtggtggttaattctcttcaaaggagtatggaaagaggatgacagagttggatggaacctcaaagaccatccagtggcaaaatacatataatgtaaaattaaccatctgaggccagggatcattgattttacatgtgaaaagacataaagtgattttgcctcttctctcccgacccaggcttagccagctttggtaaattcagtcccaactagaatccaattcttcatttcatttcaatttacggatataaaagaaaaatctatatataaatagtgagcacttgagtgtaatgagaactgatgagttaggctgggttcacaaaatatattcagcaggtattgggattctatttctcccataagtaggtagacaaatagtgtcgggaaagcatactttgagtatgcaaaactaagtctgtcccaggacaactgactgtacttctaaacccagccctcatttgctggtcccagcaggtgggtgaaaacagatgaattaattggtaagcaaacactaccagaaaacgcgtacaaacatgtacacgtacatcagtcatatcatcaatcaaggcccacacggtgtaattattactcaataagaacagaaaccactcttagaaatcataccttatctttccaaaccacaccaagcaaaaacaataatcaaaaaaagattctactctgtgatcatttctgaccccttgatgattgcaaaaatcactgccttctaacagattacaaagagtgtggaggtctctgaggtggtcacggtgatagctctgagcctgtcagtccctatcaaccaccttctattataaataaaggttttccaattttgcacttctctcaaaggcttcaatttgcctggattaagctgaagcgtcaacgtttgaacttactgctcctattcccactccccaaataaatgctgttagcagaaaaacaggcttttccacagtaggaactcaaaatcaaagcagacaacattgatgtggtcacatataaacgatattctgaccacaaacacttaacacgcgcattatccaaaccccatgagcaatcgcagggtacaggatagagtgaatctttcagggcaccaagagaaagaaaggtcagcgagtcatacattttagctcctgaaatgaatatccagcaatgccaatatattcatcaaagtgccacagtattctcttagattacagaagcaggtctcctaagagctttatactataccatttcactacttagtatatattatcttcatgatggagaagtcatttattgaaaatactccaggtatgtctggggaggggaacagtttaaactgattgaagaagacatgtttaaaaataataataagaacaacttaagaagagggacctgccttatttatctttgtaataatgatagctaggtagatatttgctatgttattattattgttgtttatatttttttttgagacagttttttgctcttgttgcccaggctggagggcagcggcgcgatcttggctcactgcaacctctgcctcctgggttcaagcgattctcctgcctcagcctcctgagtagctgggattacaggtgcccaccaccacgctcagctaattttttttgtatttttagtagagatggggttccaccatggtggccaggctggtctcaaactcttgacctcaggtgatccacccgcctcggcctcccaaagagctgagattacaggcatgagctaccgcgcctggccggtatttgatatattattatactataaccctctgggggttgcagtttatataaatatggtcaaagttacagtcttttacatttttctgtactaataaatagatttcattattattttaaatgactacctaattgggacaaagagccagaaataggatgaggagaagagaaagtgatgaggagaagagaaagtgatgaggagaagagaaagtaatgaagagaaaagagagttcagagttagaacaaacaggcctggcgtctgcctagatagatatgagaaagagagatcccaaagtagtatattgtgacatgttttatttggcccacatggtattttttttatgtgaatttattgtcaacattaaaatattgggacatttcacttagagatccagatttcaggcttctcttaaacaaataaacagatgatgtaggaattctcagcttgcattcccacttagtaaaaatctgccgttgacggctctagtttgccactggagataatcccagctgcccacttaatgcaggaaggtttccctgtctggcccttgaaggcatttgaagagatgaaggaagtttggggcctgaaaaaataggaagcatggaagaggaagcttattttgggacaaagaacatgtagacatggaaaaggtgttgcaggcaatcaagagaaactagctagctggtagctaatgaagacacagacttgggattcaagtgaggtttgggtctgagatgtggaactgtgagttacccatgaagttaaattaaaaaagcagatgaagtggtttaaagaaaagttatcaaggaaaagagagcagaggactgagccttaagtattgtcctcaaaagacaggggggccacgtgaggtggctcacgcctgtaatcccagcacttcgggaggccgaggtgggcggaacatgaggttaggagttcgagaccagcctgaccaacagggtgaaaccctgtctctattaaaaatacaaaaaagtagccaggcatggtggtgtgcacctgtaaccccagctactcaggaggctgaggcaggagaatcgtttgaacccaggagatggaggttgcagtgagctgagatcacactattgatctccagcctgggcaacagagcgagactctgtcttggaaaaaaacaaaaacaaaaagagagagagacagaggaagagggaaaaaatgagaggccatggagaacaaaacaatcaccataggttccatgatctggtcccagcctgcctagcttcattttccacgcctctcagcaagcagccttgatcccagccagacaggctatgtcttagagaaacctggtgctgtcaatgccttcttcgaatctatttcccactgcctggaatgctattttctcctctctgcctgtgttacatttttgtttgtttgttttttgaaacagagtctcactttgttccccaggcaggagtgcagtggcatgatctaggctcactgcaacctccgcctcccgggttcaagtgattctcctgcctcagcctcctgggtagctgggactacaggcatgtaccgccatgcctggctaatttgtgtatttttagtagagatggggtttcacaatgttggccaggctggtcttgaactcctgacctcgtgatctgcccaccttggccttccaaagtgctgggattacaagtgtgagccatcgcacccggcctgcgttacatttctattcacctttctcgaatgagctcgggcccacgcttcaccactatgctatatacgtatgtaagaagtctgcacttgcagtctgtaactatatacaaacaaaaatcttttaaaaagccaaaaaataagcccaagagttgccccaaatgcccaagagatgcctgtcacagtgtcccctgcaccactatcacattgctctgagtctgctgccttcccatttgattgagccctccatgaggtcagggaccaggactccttcattttatcctcagtggtgttcaataaatgataacagaaaaaaggaagggaaggaatgagcaactgatgtggcgggataaatcttgacataatgctgggtcacagaagtcaaggaagaagagctatttctgccagagagaaccatctcaaatatgagaagttattccaggagaatgagggctgatgagaagcactggatttcagcaagaatctgccactaataaggttggggtgggggatggtttctgatactttactggaaaataacttggaaatatatatcaaaaggcttaacactgtttgcaccctgaggctgaacaaatctacttgggaaacacatctgtaatggacaatgtgggtttttgttttttttgtttttttttttttggttttgctttttttccctgtccagatccaagttttgtttctgttttgaaggtgctcctgttacatgacctcttggtagggggcggcttctcacttcccattgaggatgtcaaagccaccagattcttcctcagactcccttaagagaggcagaggcacccacgtgttcagcaactctggcctcaccatccagatcacaaccttcttgccaaggacagctgctctgtcctctggccctgcagctgtcacttatctgggcctcaaataaccctccagtcagggccccatggttataaggcagccagagtctgcctctgattctggttcctgggagtatcctaatggaaatcctacctgagagaaaaagatcctaaatatcgaaaaaagtgctatgcatttcatgtagcatgatttacacagcaaaatgtgggaataaactaaggcccccaaaccaggaacacagaagtaaatgatggtattgctacttgataaaatggtactcaccattagaagtaaaatatagcataatgttaaaaaacagaaggtttgttgttgttgttgttgagacacagtcttgctctgtcgcccaggctggagtgcagtggtaggatctcggctcactgcaacctccaccttctgggttcaagcaattctcctgcctcagcctccctaatagctgggattacaggcacctgccattaggcctggctaatttttgtatttttagtacagacggggtttttgccatgttggtcaggctggtctcgaactcctgacttcaggtgatccacctgcctcagcttcccaaagagttgggattataggtgtgagccaccatgcccagccaaaagaaggatttaaaaatacagtattatcataatcttgtaaaaaattacttgcagaaaagatgactgggagtaataaaacattaggcaaataagtatttttccctaaaaattctacttaacttttaaattacaaaagtaatacaggcttactgtaatatattctgaagacatagaaagaaaacattgatgggccaggcatggtggctcacgcctgtaatcccagcactttgggaggccgaggagggccaatcacgaggtcaggagatcgagaccatcctggctaacacagtgaaactccgtctctactaaaaatacaaaacattagccaggcctggtggggggtgcctgcagtcccagctactcggaaggttgaggcaggagaatggcatgaacccaggaagcatagcttgcactgagccactctactccagcctgggtgacagagcgagactccatctcaaaaacaaacaaacaaacaaaagaaaacattgatgatcccaacacccagccccctgccttacccatgtcctgccattcccacatcaccaatggtgaccacgtgcccctccacacctctcttcagactctaaccaacactgcacatgcaggtctctctcctccttttctttccgtcctccctccctccttttccttaagtgggaccatagtatatatactccctgcttattttggtttggcttttcacttaccaaactcagaagcagcttgtcttactaattcttcagacctctgctcctgtgttgcagcctcttggaaacctctgagcccttggctgactcagacccgtctgtactacctgcagtcattagtgatttacagcatgtgtcccctctctcctatactcttaagtcctatctaccttttaccctttttttttttttttaaagaaacaggatctcatcactgcccaggctgaagtgcagtggcacaatcatagctcaccgcaacgttgaactcctaggttcaagggatcctcccatcccagcctcccaagtagctgggactataggcgtgagccactgtgcccagtcctatctacatttttagctccagttcctagcccagtacctggcacacagatgatatccactatctgtgctggcatggatgaagaagagaacagatgaatgggaaaacttgaggacaagatggttttgaaggcagataggcactgatgaaggacaaggcatttctccattgatactgaattaaggatgacacagcgggtacagagacagacacacaagaatgtaaagaaaaaggggccaagagatttaactagcttacctcaatgaaccatgataagggaaagaagaagtaaaaacaatagccagatagaaatattcttgataaacagcatgataaataaaggaactggcatagttccttctttgttccagattaattgcttattcttgtggtaaaagattaaaaataattctctgagagacaaaagtagctctaaagtctgttaaataaacaagactacttagaactcagtttcttacctatgttttataaggttcaaaagagctaatatgataaaaagcatgttggtcaggcacagtgtcatacatctgtaatcccagcactttgggaggctgaggcaggcagatcgcttgagtccaggagtttgagaccagcctgggcaacatggtgaaatcctgtctataaaaaataaaataaaaattagccaggcatgacggcgagtgcctgtagtcccaggtactcagcaggctcaggtgggaggctcacttaagcctgggaggtggaggttgcagtgagtgccactgcactccagccaggatgacagaccagacagaccctgtaccaaaaaaaaaaaaaaaaaaaaaaaagaaagaaaaaagaaaaaaagcaagccaggtgcggtggctcacacctgtaatcccaacactttgggaggctgaggcaggcaatcacttgaggctggggggttgaggccagcctaagcaacatggtgaaaccccgtctctactaaaaaatactaaaattagccaggcatggtgatacacacctgtaatcccagctaattgggaggctgaggcaggagaatcacttgaactcaggaggcggaggttgcagtgagccgagatcacaccattgcactccagcctgggcgaaagagcaagactccatctcaaaaaacaaaaatgaattaaaccccacatcttatcatagctggcatttataaaggactcactagtactagtcattgtgccacctaactgttctcacttagtctacagaacaatcacatgtactactaattgctatcctccttttagagtgaagggaactgagacttagagagggcaagcagctctctaagtcacccaggctgtaagtggcagatcccaaattgtgccccaggactgtcggacgccacacctgtgctgcatgctactactcttaaccagggtcctgccccacctccctaagaagatcacattcagatgagctgaaggcagatccaatggtcgtcgattgagacagcattaatgcaatgtcagctgggttgatttctaaccacatcactgaaacactactaaaatcacaataaacgtgcttagacaacattacgtaatagtcaatatgctgagaagcaagactgtacatccacccgagtcattcagaattcttagtctggtctttcacaattggcgccctctgtcagactcagacaaggctctattttgaattctaatgaggaccaagcacactgaatatttaaactgcaattacaaagatcctacttttatgtaaatgtccttaatggaagtaacagatctgaaaatacatagaggtaccagtggaaaaatatcagtctaatttgcatttagaagctagaaaaaaaaaaaaacagtattgttttctacttgatgctatcattggggtggggttgagggaggaaaagggaggaaaatccacacaaaaatctcggtaaaaattttaaagcctgtgctcctgagtgaaaggttcacaaagaggtacttgaatcccttgttaagaactgaacaaacaaattcatcatcgggcctctctcctgtgtggccccttgcagttcagtctgtattcataactagaaattctctcactgctcaagcatctatgactgatacatcggcccatcaaggaagatatgccaagggtagcgaaacaaaaggccatttcatgattcacaacctatttttacactcctttgtgtaaaatgatgatgtggcggctgctatccacactgcacccaagtcctcttaaacagtgatagaattgccctgtgaatggtaattgagttacactccactgggctgcttaattcccaccccctatagttaaagtacaccttgcttgcagtttgattatgcatttgtatgtgttcatatataaaacagccaatgtggctttgcacttgagaagagcaggtggttaactcttcgctgtatctcgaagctcttgcaccaaccctctgcccctcaaacgcctttcttattaagatcataatttaactgcctagcatttgggcattctcttcaagatgctaacatttatcaaatggattatgctttttttttttttctttcttctggtttgtcctctggttgattctttcttctgctgataccaaatatgttcactggattttttaatttcagttacctgttatttctagaagttctatctggtcccttttcaaaatttctgtgttacttattatagttttcgggtttcttaagatgctttcaagcttgtcatttttaaaatatattttaaaaagtggaattgagtttataatcaacgtctgataattctactactgcaattctgttcagattcatgtccatggtctattgctggtcctcactcatgctgtgctgtttccgggtatgctagaatatatttgactatgtgctggtcattgcccttagaaatttatttttagttggctcctagcatcctagaatatgctttcctccagaggcatttcatttgtttttgccaggcacctcgagctataacaggtgagtctgcctcaaaccaaattcatggtatgatgtttcccggtctaccctgagtatgtatgtccagggggcaaattcacatgtgggcctttctgtgaccacaagttgtcaatactgtattttccctcccgtctttttcttctcctattctgctcagtgccaacgctgccctttccacaaccccccatggtaagtttagttctggttcacttttactctgagggtgtagctctttggggtcccagtttcttgtgggaagggtctcccatgacatttcctaattagagtgggtgcccagggactaaatttccaccccatttgcctgcccctctcaggctacagaagtgtctggctttatcagattaaaaaaattatttttatttttatttattaattttttttctgagatggagtcatgcttttttgcccaggctggagtgcagtggcatgatctcggctaactgcaatctctgcctcccgggttcaagcgattctcctgcctcagcctcccaactagctgggattacaggcacgcaccaccacgcctggctaatttttgtattcttagtagagacagggtttcaacatgttggccaggctggtcttgaactcttgaccttgtgatccacccgcctcggcctcccaaagtgctgggattacaggcatgagccaccacgcccagccctcattttttttttttttttttttttaaggaaaatactgaaaagtgggccaggcgcggtggctcacgcctgtaatcccaaaactttggtaggctgaggtgggcagatcacctgaggtcaggagatcgagaccagcctgaccaacatggagaaactctgtctttaacaaaaatacaaaaattagcccagcgtggtggtgcatgcctgtaatcccagctactcaggaggctgaggcaggagaatagcttgaacctgggagacggaggttgcagtgagctgaggtcatgccattgcactccagcctgggaaacaagagcaagaagactccatctcaaaaaaaaaaaaagaaaagaaaagaaaaagaaaaagaaaaagaaaatactggaaagtacctaagagtttagaggctgaaagcaaaaccaagccaggctaatatgaaggttcctcaaacatttaaaaactgaattaccattttatccaacaactccacttctgtatatatacacaaaaaaggaaagacttgagcagctatttgtacagcaacatttatggtggcattattcacaatagccaaaaggtggaacaacctgtgtccactgacaaatggataaacaaaatgtgatatatacataaaatggaattattattcagccttacaaagcaatgaaattctgatacacactacaacatggatgaatcttgaagacatcaccctaaataagccagatataaaagtatacatatgatcccgcttacaataggtacctagaataatcatatctacagagacagaaagtagaaaagtagttaccaagggctgaaagagggaggaatagggaattattgtcttggataaatttcagtttgggatgttaaaaaaagtggctgggcgcagtggctcacacctgtaatccaagcactttggaaggccgaggagggtggatcacccgaggctgggagtttgagaccagcctgattaacatggagaaactctgtctctactaaaaatacaaaattagccagatgtggtggcgcatgcctgtaatcccagccactcaggaggctgaggcaggagaatcgctcgaacccggaaggcagaggttgcagtgagctgagattgcaccattgcattccagtcagggcaacaagagcagaactctatctaaaaaaaaaaaaaaaaaagttctggacagcctcggccacgaagtgagactctatctctagaatttcttttttttaatgccactgaactgtacatttaaatgtagttaagatggtaaattttatgctatatatattttaccacaattaatttttttttttttttgatggagtctcactgtgtcacccaggctggagtgcagcggcacgatcgcggctcactgcaacctctgcctcccaggtttaagcgattctcctgcctcagcttcccaagcaactgggactacaggcgtgtaccaccacgcctggctaatttttgtatttgtagtagagatggggtttcaccatgttggccaggttggtcttgaactcttgacctcaggtgatccacatgcctcggccttccaaagtgctgggattacaggcgtgagccaccatgcccagccaaaagaaatttttttaaacaggtcaggttaattttgccaagagttgctagacctactcagtaagttccacaatatgctttgtgttcacaggcataatattgatcagttgaaggcttaaaaggaaattcctgagaggcttaaatacttgactgacccccgtacagctttagagaccacatgctgaccttcatcgacatgcaaaaactagcactgcatgtcaacaaatgcatatataaaatgcaaaaattgtcctgtaaaggtatcaggcataggaaataagtacagttacttggttgttgatccataatactgataaaattattaagtaaatattacaaaaagaattgaagaaataacagaaataatgatctctaaagtatttccattaaaagaataaagaggttgggcgcggtggctcacacccgtaatcccagcactttgggaggctaaggtgggcagatcacctgaggtcaggagtttgagaccagcctgggcaacatggtgaaactccatctctactaaaaatacaaaaattagctgggtgtggtggtgcacgccttaatcccagctactcaggaggctgaggcaggagaaatcacttgaacctgggaggcagaggttgcagtgagctgagattgtgccactgcactccagccagggtgacagagtgagactctgtctcaaaaaaaaaaaaaaaaaaaaaaagaagaattttcttttttcagtatctacttaacactgctatactgatgaacttctcccttttgaatcattacatataattctgtggcagataatatatacatatataattaaataaaatgaggcatgagataaatgtatagttattttaaaatatggacacaagttttccaaacgtattttagtacttctgggattccttaaattcttttctattttcaaaaaacaacacttaagagtccagctcagaagacattatgacacttctgggtaaaaatactacacaccagatattaacatcaaattaaaaactggcaacagtgtaagaaatattccacattcattatgacttcatgagtggcatgtgctgagttactatgttgcaaacacaaaaacttgccaacatgtctatgaatatattcattccaaactagcaacataattgctgagaacaacaaaaacaacatatataacattgtatgtcttcctgctctagacatatagtaacgagagctaataccagtacttgctcaccgcacacaatgtaccaaagatggttttaagtgatatatatatgttaggttggtgccaaagtcattgcagtaatggcaaaaaccacgtttacttttgcaccaaccatatacatatatacccacatacacatacatacatatatatattacatacacgcaatcatttatttctcataacaatcctttgaggtctatatctctattatccccatttcaaagatgggaaaatcgtggcaaaagggagtttaggctttcctgaggtcacgcagctagagagagttcgtgaagctcgggtgtgaggccaggctctagagctcactctcatgatatctatgctctggcacctctcacatacgtatggaaagctgggggaggtggccagcactggacactttacatagtccatacaactgaattttgataaccaaattctccgctttcttataattaggaaactgaggcccagattaagagagaggtggaagtgaactcatattgagaggtgaagccggctggacttctgggtcgggtggggacttggagaacttttctgtctcactaaaggattataaacacaccaatcagcgctctgtgtctcgctaaaggtttgaaaacgcaccaatcagcactctgtaaaaaatgccccaatcagcgctctgtgtctagacaaaggtttataaacacaccaaccagcatgctgtaaaacacaccaaccagcacgctgtaaaaatgcaccaatcagtgctctgtgtctagcttaaggtttgtaaacgcaccaatcagcactctgtaaaaatagaccaatcagcactctgtaaaatggaccaatcagcactctgtaaaatggaccaatcagcactctgtaaaatagaccaatcagcaggacatgggcggagccaaagagaggaataaaatcaggccacctgaggcagcaaccctgacccgctcgggtccccttacatgctgtggaagctttgttctttcactgttcacaataaatcttgctgctgctcactctttcggtccgcaccacctttgtgagcagtaacaccggctgcaacggtctgcagcttcactcctgaagtcagcgagaccacgaacccaccggaaggaagaaattccggacacatctgaacatcggaaggaacaaactccggacacaccatcttcaagaactgtaacattcactgcgagggtccacagcttcattcttgaagtcagcgagaccaagaacccacctgaaggaaccaattccggacacagtatctctcatctttaaagtttcaggatctatcatagataacaaagtccctgtggccagaagttatgggagaagattgataaagcaaaaactgaggaccagaagcacagggcaggatggtcgggcaggacagtggtgataaagggtctcaaggagaccccatggggctccactacctctgagcttgcagagtctctatgtgcctgaccctctctcaccccattgttctagccttctttcttactgagcaaacacagccagggaaggtgatgcttctgaagctgcacatctcagggacccttgcccagagcttccaaagtggacagatggagaggatccattacatttttcatattaaaaaggctgaaagtttggcaaagtatgttctcagatctctaggttttttttaaattgcttttgtaattcttttttttttttaaagacacaaggtttcactctgtcacccaagtggaagtacagtaagacaatcatggctcactgcagcctcagcctcctgggctcaagtgattctcctgtctcagcctcccaagcagctaggactacaggcacataccaccatgcctggctaatttttaaaattaattaattttgagacagggtctcactctgtcacccaggctggagtgcaatggcacaatctcagttcactgcaaccttcaagcaattctccctcttcagcctcccaagtagctgggactactacaggtgtgtaccacaatggctggctatttttttgtatctttagtagagacagggtctcgccatgttgcccaggctgctaatttttaaattttttatagagacagagaggtcttgctatgttgcccaggctggtctcaaactcctgagccactgcaggtggcctgtgattctagttttcataaatatgtcagctttataatcttggtgcacccttgtgagacgaagcacccaaaaacaattactgtgattactactgctattcccatcatttatcatcacgtacctttgggcaaggcactgtgcaccggcaatacacaatttaaacctcacaaaagtctgcatcagaatttctgcagaacaagcacctgcagcagaactgcttggtacacttgttaaataatgaacattcttgaactccaccctagatctactcaatcagaatccccaggggagggcctcaggatcagtattttaagcaagccctccaagcgattcttatcttggcatatgaatccccattttacatacaaggtatcaagaggtaaggtgacttgacaaagataccatcactaaacataggatttgaactcaattaagcttgtggttattttaagacggcacaaaagcaagtgagatcccctttaaaacccgccaaccagtataatgttatacaatttcccaaaccattaatctctgtaaacacacagaaaggacttttaaattaaaaacaaaaacaacaacaaaaaaacaatgaatgatatgccctttgaactccatttcattttgaccagatttaaccattgtttagcaatttcagtgcttcatcaaatggaactgcctgtatcagaagagcaaccaaatccccacagtaattagacaaacaggaaactcagagcagagtaaatccacaagctatgacagaaacagagccataacgtagctatctcttaccacaagaggctgactttctgtccaccatgtttacccgcctggtttcattgcgaagtttttcatctgtgttctccactaggttggcaaggtcgtcaattatctctagaaaggaaacatacatgattactattcctgaaataccccggttcacatcacagtatcacagctgtggttgttcatcctagcaataatgatctcgagtgcagtaactgaaaaggtacagaactcatgtcgattctttgaaaactgcaattctgattgtaaaaggaaaaaaaaaagcagtagtaaagaagaaaactgatttaacacaattccagcagacaggagaaatgccacattcagaggaaagaaagcatgacctgccgaatttatgcctagccaagctgtcattcaagtataaaggaacagacaggccaggcacggtggctcacgcctataatcccagcactttggaaggctgaggagggaggattgcctgaggtcaggagttcgagaccggcctggccaacatagtgaaaccttttctctactaaaaatacaaaaattagccgggtgtggtggtgtgcacctgtaatcccagctactcgggaggctgaggtaggagaatcgcttgaacccgggaggcagaggttgcactgagccaagatcacgctgctgcattccagcctgggtgacagaacaagactccatctcaaaaaaaaaaaaaaaaaaaggaacagacggcacagtagacttcagggactacctgggcccttcttgagaaaactacatgatgaagaaatctagccaatcaaaagataaataaagagatgatggagagaaccaaatccatttaaatactggactaagagtaaacaaatacgtggattagataacagaaaggtacagaaaggtcacaacagtacaatgtaattccaactgaaaaattagtcagtggttgcgagtggggaaggaaggtgaaaagaaattgaaagtgctaatttcttcatctctcgcaacgaggcatatcgagcagttgaaaagttaatcatacagaaacttgtagccttttaaaatcaccaaaactttaatgttttttgttaagcttgagggatcttttagtaattactatctcttgtaaagaatccttgatgtgggctgggcacggtggctcacacctataatcccagcactttgggaggccgaggcaggaggatcacctgaggttgggagttcgagaccagcctgaccaacatggtgaaaccccgtctctaccaaaaatacaaaattaatcggtcatggtggcgcatgcctgtaatcctacctactcgggaggctgaggcaggagaatcgcttgaaccagggaggtggaggttgcagtgagccgagattgcaccactgcactccagtttgggcgacagagagagactctgtctcaaaaaaaaaaagaaaagaatccttgatgtgaaattcatttcttttttaattctaatctttttaagtgaaattgagcccttcacaacatttaaaatagcatatatagtatagtacgatcttaactatgtaaaattatttgtatccatctttttatatttacaaacctataggggtatatgtggataatattaatctaatgctactaatgattatttctagatggtgggatcctgtgtgactgctgccttcttccttgcatttttctgtgttgtttgaatttctgtgtgttttttttttttttttttttttgagagagagggtcttgctctgtcacccagactggatacagggtaccacaatagctcactgcagtcttcaaggctctagcaatcctcccatctcaacctcctgagtagctgagactgtaagcatgtgccaccactcccaggttattgtttaaattttttgtagagaccaggccctgctatgtcacccaggctggtctcaaactcctggcctcaagagatcctcttgtgtcagcctctcaaagtgttaggattacaaccatgagtcactgtgcctggcctgaatttcttacagtgagcctatatagtcatgtgccacatgacatttcagtcgatgaccgaccacatctacgacagtagtaccataagtggtacagtattataatgttataataccatatttttactgtaccttttctatgtttggatacagaaacttttttttttttttttttttttagagggagtctcactcttgtcgcccaggctggagtgcagtggtgtcatagcagctcaccacaacctctgcctctcaagttcaagcgattcttccgcatcagccttccaagtaagtgggattacgggtgcgcaccacccgtaatttttgtatttttgtatttttagtagagatggggtttcaccatgttggccaggctggtctcgaactcctgacctcaaatgatccacccacctcgacctcccaaagggctggaattacaggcgtcagccactgcacccgaccatatttaccatcttgttacaactgcttacatgcaataatatgctgtacaggttttcagcctaggggcaataggccataccatacatatagcctaggcatgcagcaggctttaccatctagttttgtgtgagtacactccatgatgttcgcacaatgagaaaactacctaacaacacatttctcagaacatatctctgtcaagggatttatgactattatatttttcattttgttttttttttttcctccctccttctccctccttcctgtttttatagtgactgctttggagatgtgctgttcaataccagtcaccatttttcttaaagcattaagtaaagcaaacaaggaaatcaaataaagtttccagaatgatgtgtgagctaaattctgaaggcgacatgggtgaaaaagcaggaaaaaggcaacccatgcaaaaagaatagtatctgaaaggcacaaaggagttgggtgctcctgcttcttgcctcctgcagcacttcctacaaacctcttatttatagaccgtatagttatattctatcgatttgtttacatgtctttaacaggaagattatgatacaaactaatttttattcatccttatacctcccacccctaggagaatgccttgtatacagcaagataaaataaatatgaaaagataaagacaatgaatgggctggtggctcacgcctgtaatcccagcactttgggaggccgaggcgggcggatcacaaggtcaggagtttgagaccagcctggccaacatggtggaaccccttctctgctaaaaataccaaaattagctgggcatggtggcgtgcgcctgtaattccagatacttgggaggctgaggcaggagaattgcttgaacccaggaggtggaggttgcagtgaggtgagatcgcatcactgtactccagcctgggtgacagagcaagactctgtcttgggggaaaaaacaaacaaacaaacaaacaatgtcctaacttatccttgtttctagtcctgattcattttaattcattttctatacaatactcagaacatattttaattctctcatatttcaatgaattaaaatataaatagctacatgtatcgaacaactcagctctaaagcaataacttaaaaaagaaaccaagaaaacactcacacacacacacacacacacacacatatgccctgccaagaggtatagttttaaaataaaaattaacagaagaaataaaattacatactaaaaatgtatgattcaggaaaggggtaaagaggaacaaaagatagatgggatgaaaggaacagaaatacaatatctatctggcatgcttaaattcaactatatcaatagtcacattaatgtaaacagactaaacttttcaattaaaagacaaagggtatcacgcaagattttttttcttttttaaattatactttaagttctaggtacatgtgcacaacgtgcaggtttgttacataggtatacatgtgccatgttggtttgctgcacccatcaactcgtcatttacattaggtatttctcctaatgctatccctcccccagcaagatttttaaaaaaagatgacacaactatatactttgctatgaaactcactataaagcatagtgtttgtatgagaaaggtggcaaagctatattaatatcagaccagacagacttcttgaaaaggagtattattagacataaaaaggaacttttcatcatgatgaaaggacacatgtcaaaaatgggaaattctgtcatatttgaaaattaaggaaaacacttctgatttccccacagggcaaagatgaaaccacaagagaaagcagaaagcagaaagaaggacaactgctatagactggatgttggtgtgccttcaaaattatgttgaagcctcatcaccagtgtgatgacatttggatgtggggcctttgggaggtgaatggtgatgagagtaaagcccgtatgaatgaacgaatcctgttccatgcatgagatttatgaccttataaaagagttcctagagagcatcctcatttcttccaccatgtgaagttacaatgaagacagctgtctatgaaccaggaaacagatcctcaccagacaccagatctgtaggcaccttgatcttgactccccagcttccacaacggtgagaatttctattgtttataagccagccagttgatggcattttaatatagcagcttgaatagaacaagacaacaacctagcacaaaagtttttaggatgctactaaagcacgacttatggaagtttagtgctctaaatgcatatattagtaaagaagaaagatgtgaaatcaatgatcagactcaaggagctaatagtatgatcatctcaataaatgcagacaaagggtatgacgaaattcagtgtccatccatgatacaaattatcagcaaaatagaaacgaaagggaacttcttcagcctgaggaaggctatctatatttaaaactctcagagctaacatcatacttacaggtggaacatggaacattttttatctaagatcaggaacaaggctatgacgtctattctgacagcatctgttgaacattttattagaagtcccagattgttcaataaggcaggggggaagaaagcaaaaaggtatgaaagggagctgtaaaggtgcatttgcagatgacatgattgtacacccagaaaacgataaagtctatttaaaaactactagaactagtaagtaaatctaataaatttgcacatacagtcaatagtaaaaggcaatatatttctatataccagtgataaagaacggagaaaaaataaaagtaaaaaaatccattataacggcatcaaaagccatattacatactcagaaataaatctaactgaagatgtgtaagacctctataataaaaactataaaacattgctgggagaaatgaaagaaggcctaaaaaaaggagaactggcctgacccatatggtagttctatctgtggttttctgaggaacccccatgctgttctccatcatagctgtactagttcacattcccacctacagtataaaagagttcctttttttctccacatatcctcaccctcatttgttatttttttttttttcatatattggttgctcatttataagagagaacacggtattttaaagatactggttcatttttttttcaattgacagatatcgtacagaattttatacattgaatgcaatcttaatcaaaattctagcaggcttttaaaatgaaacctgcaagccaattctaaaatttacaaagaaaattatttagaataaccaaaataatcttaacaaagaaaaacaggctggatgcggtggctcacgcctgtaatcccagcactttgggaggcctaggcgggtggatcatgaggtcaggagattgagaccatcctggctaacatggtgaaaccccgtctctactaaaaatacaaaaaattagccaggcgtgatggtgggctcctgtagtcccagctactcgggaggctgaggcaggagaatggcatgaacccgggaggcggagcttgcagagagccaagaaaggcacccactgcactccagcctgagcaacagagcgagactccatctcaaacaaaacaaaacaaaacaaaacagaacaaaacaagttggaggtattatgttaccaaaattcacaatttattataaatatatactaatcaagagagtctgatattagaataaggacaaacacatcaatggaacaaaacagagtccagatagacttgtgtgtgtgtgtgtgtgtgtgtgtacatgcacacacgcacgtgctcaattctcaacaaaggaaagaaaattcttttcaacatatggtgctggaaaaactggatatatgtatgaggaagtaaaaaacccctcaacccttttctctccataccaaaaaaaaaaaaaaattgtgatggttcatagacttaactgtaaaacctagaactgtaaagcttctaaaagaaaaaaaaaaaagagagaaaatttttatagcctggagtaggtaggcaaaaatttcttggacaggacataaaaagactatccacaaaagaaaagagattggtcaatctgatttagcaaatcctcaaaggaagtgatttctagattttgtgacatcctgatgctctgggcatagtattcttcctaaaatgtaatgggaggacttggacacatggcttcagtctttgtctcatcagcattgaacacagttctgtttatatatagtagcatatgtaaaagtggacatttttatgatccacgcctcattctctatcaagagaaattttctgttcatccaaagatactattacaaaaattaataaataagccacagaatggtagaaaatatttgtagaacatatatctgacatagtatttgtatctagagtatataaagatctcctacatattaacaataaagaaaagctaactttaaaataggcaaaagatctgaacagatgttttacagaagaagatatacaaatggccaataaacacatgaaaaacagctcaaatattgttaagtcattagggaaatgcaaatttcaaccaaaataagatactgcttcacactcactacagtgtgcaaactaaagacttacaatactaattgttgggggaaaatatggcacaaagggcgctgtacaagtatttgtcaattctcatcaagttaaccatatatctaccatcttacccagaaactttactcctaggttttttgttttttgttttttgaggtggcatcttgctctattaccaccctggagctggagtgcagtggcacgatctccgctcactgcaacctccgcttccgagttcaagcaattctccagcctcgccctcctgagtagctgggatttacaggcacgcgccactgcgcctgtctaatttttgaatttttagtagagacggggtttcaccatgttggccaggctggtcttgaactcctaacctcaggtgatccacctgcctcggctgggattacaggcatgagccatcatgcctggctcactcctaggtatttaccaaacggaaataaaagcctatttctcaaaaaaaaaaaaaaaaaagcctgtacaaaaatatacatagcaaccttattcatgagggccccaaactagaaacaacccaaatatccatcattaggagaacagaaaagcaaattggggtatatctgttaatggaatactattcggcaatagaaagcatgagctactcatgcatgccacaactgtctaaatctcaaaaagttttgttggctaaaaataagaaaacaatcattatatgctttgtgattccatttataagaaatacaaggataaacctagcctacaaaatagacatcagaaagtggttgcctctggggtgcttgactagaaagggacatgaggaaactttctgggaggatggaaatgttcgaaaggtcatacaaattcacgcaaatgggtacagctgtcaaaacacacagaagggaggaagggaagtcaggagggagggaagcagggagggagggagctggcaggcgggcaggcaggcaggcaggcaagacaaaacaaatgccttagaataacaaaatttcagacctgcaagagtcatgcaatcaccttgtagttccttccccttttataacatccctggcagtgggatggttaatctttcaccaaacactcccagagactggtaacatggaaactcatgagaaaatcagttccatggctgagttagagggtgactttgataattataaagtcctttattctgagctaaaattctgcctgctctcaacttctaccttaggtatttctttttctttcttttttcctcttctttttttgagacagagtttcactcttgttgcccaggctggagtgcagtggcgcgatctcagctcactgcaacctccacctcccgggttcaaacaagtctcctgcctcagcctcccaagtagctgaaattacaggcaccccttaagtatttctagaccaacacaatatcagtgttctttccttcataattttcctcatatatctccttggtcttctcctctaggttaaagatacttagatccaaactttagcaaacgctcaaaggaagtgatttcgagatcttgtgacatcctgatgctctgggcatagtattcttcctaaaaacgtgatgggaggacttggacacatagcttcagtctttgtctcatcagcattgaacacagctgagtttatatatagtagcatatgtaaaagtgggcttttttttctttttgagagggagtcttgcgctctgtcactcaggctggagtgcagtggcacgatctcggctcactgcaagctccgcctcccgggttcacgccattctcctgcctcagcctcccgagtaatgggactacaggcgcccgccaccacacccggctaattttttgtatttttagtagacacgggtttcaccgtgttagccaagatggtctcgatctcctgacctcatgatccgcccgccttggccttccaaagtgctgggattacaggcgtgagccaccacgcctggccaaaaagtgggcatttttatgatctgtgcctcattctctatcaagacagtccacagtaacaatcatgctttgtacttggccttgtagttgactctgagcttggtacactgttctcacgcaaccgaatacaatcagtattgcgtgatgcatcaacgccacaatacataatacaaaattcagggctaatagcctctgttactataagaaaatcaagtgcaaaatattccttgtctgacaagaaatacagtatgtcggatgttatatgttaactgggtttctagatagatttctttgtaagtttataaatattcataatatgacttagaggtaaatcaataaatctgtagcagattagatcaatgaaaaccagtagtcaacacttgtagggattaatgttttaatctagaccgaaaacgaagtttttcattttggttggtaaacctctcctctttattagttgttgtttctaaacaactctattttttttttttttttttgagacattacttcgctcttgttgcccaggctggagtgcagtggtgtgatctcggctcactgcaacctccgcctcccaggttcaagtgattctcatgcctcagcctcctgagtagctgggattacagatgcctgccaccacaccagctaattttttatatttttagtagagacagggtttcataatgttggccaggctggtctcgaactcctgacctcaggtgatccactcacctctgtctcccaaagtgctgggattacaggcgtgagccaccatgcccggcctaaacaactctactttttaagttataaaaattattcaatagcagtttataaatgcgaggggaaaaagtaaacattatccaaataccccagtataacaacagtgtaattcccccatgtgttcactacaatttgacataaacatatacattttttcgggcgtggtggctcacgcctgtaatcccagcactttgggaggccgaggtgggcggatcacctgaggtcgggagttcaaaaccagcctgaccaacatggagaaatgccatctgtactaaaaatacaaaatcagccgggtgtggtggtgcatgcctgtaatcccacctacttaggaggctgaggcaggagaattgcttgaacccaggaggcgggggttacagtgagccaacacagtgccattgcactccagcctgggcaacaagagcaaaactctgtctcaaaaaaaagaaaaaaaaaaaaaaaaaccatacattttcatttaattgcaatatataagcctcccccatctaatgatatcatttgtattttttcatgtagctacaaagtcttcagttataatttctcatggttacaaaatattcattccataaaataaccattccttaaataatagcccattgttggatacttagaatgtttctatatttctaaataatgagtctataaattctttcctccattatcattggttctttttaatcatttccttaacaaagtgtgattatgactgcctcataaactttgaaacagattgccaaattactttttaatagacttatactgccactgttggtttgatgggattcattccacttgtcagttatgacctcagaagatttcctaggccagagagccttggggaattcccactctgcagaccaggcactaccaaggtgggaatttccctaaccacagtctattaagagcaaattaaatacaggtttcagagtataggttgtgaaacaaccagctgactagttcagattcctgactgtagagcctccaaagagaaactgataccctgcttcctggtcagtacttgcatttggtttcacgaaggagcttatatttcaatcacatgttaatctgagatatcgagtgacattccagcacagaatggacaaaatggaacaacgtaaagtataccacaaaatgacagcatcacaaggattaagaaatattatatgatgtcaaaatacccgactccaataatacttcatcatttttctactctcaattacagcctcaatacattctatatatagggagagagtttgctatatattttcagatacatttggtgcctttttatactcataacggactcataatggcagtagtaaagtcattatgttattatgctttttgcttatgttcttaataatatttgaagacaaatgttaaaaaaaatctatagtgaagatagagtttttcttgagggtattagtttaattccctccgttccctataattgatatcatactcaaatttatcaatggaaaccaaaaatggggggtggtggtgacctctgataataccgtacactaggaaaagatacattccagagaacagggacacaaggaaaaaccaatctgtgacttcttaaaggaaaggtaatgctttgcctatggcatcctatggcagggagctgcaaggaactcccgcagatcaaagtggagcctctgggaaccacccaggctttggggacacagggaaagctcctttgcctggcagaaattccccttggccacactcgctcacaccttatacacagccagatgggccaggttaggcaaaaaacacaggctcctttccgacttcctcttgaccataaaccatggtctctcatctaggcttaaaaatgtgtaacaggagtctggacgcagtggctcaggcctgtaatcccagcactttgggaggctgaggtgggcggatcacctgagatcaggagttgaagaccagcctgaccaatctgatgaaaccccgtctctactaaatatacaaaaattacctgggcgtggtggtggttgtctgtaatcccagctactcaggaggctgagacagaagaatcacttgaacctgggaggcagaggttgcagtgagctgagatcgcgccattgcactacggcctggacagcaagagcgaaactccgtctcaaaaaaaaaaaaagtgtaacacagggtcggtgcggtggctcatgcctgtaatcccagcactttgggaggctgtggcaggtggatcacgaggtcaggagtttgagaccagcctggccaacgtagtgaaaccctgtctctactaaaaatacaaaaaaaaaaaaaaaattagccaggcatggtggtgggcacctgtagtcccagctactcgggaggctgaggcaggagaatcacttgaacccgggaggtggaggttgcagtgagccgagatcgcgccattgcactccagcctgggcgacagagcgagactccgtctcaaaaaaaaaaaaaaaaaaagaagggggagatattttaaattaaaagacattaaagaggcaaaacagttaaacgcaatctgtaatctgattgctggagcaccccctcaaaaaaaagtgacaaaactttattggggcaatggcagcaatttaaatagaaactccatattagtcattattaccatatcaaagttaagtttcttggatatgctaatgacactgcagttatataggaaaacaacctacacagaagaatattaggagatagattaggaacagatgccaaagtatatagaagcattacgagacaccctcaccttacttcaaaccattcacaggctgggctcggtggttcacaacttgtaatctcagcactttgggtggtagaggctggtggatcacttgaggtcaggagttcgagaccagcccggccaacatggtgaaaccctgtctactaaaaacacaaaaattagccagacatggtggtgcatgcctgtagtcccagttacttgggaggctgaggcaggagaattgcttgaacctgggaagtggaggttgcagtgagcggagatcatgccattgcactccagcctggacatcacagcaagactccatctcaaaagaatttaaaaatattaaataataataattcgctctggggggaaaaggtacataaatacacacacacactcatgcagcaacaaaaaagcaaaacaaatgtggctaaacgttaacaactggtgaatctagtaaatgaagggtgaccagatatgcctgaagaatatactgttaacttttctgtagctttagaaaaacctttaaaataaaaagatgagggaaaaaaaaaagccacagacttagattgggttacagaaaaagagagagagaaaaaaaaaaaggaaaccatattgctatatagatgggaagcatatggcagagtagggtaactaaagtcctagatttcacactggagaaataaaaagggagcctcaggagccaaaatgcaccaggaagatcacagactgggaggagcttagaaaagcaaccccttaaagttgttcatgaagtcctggattctcctttgagaagtgcatacacggagctgaccccaaatagtatacgtagacattgagagctgaactacaggagagaaaaccacccaactcccagtctggtcactggctactgcacctgtgggacagacccaaacagtactggaaagactttgaaaacttcttcaatggtagttggaacctgtggcctcaactcaaccagggcaattgcctgctaaaataaaaaatatcaacatctctgtaggatttaaaccaacagccagagtctcataaaataataatcaaaatgtccaggatacaacgcaaaattttgcagcatatgaacatccggaaaatttcaagttgcataagaaacctgggaaaagacaacaagatgccattgctaagaagcatagttgttggagttatctgacaaagactttaaagcagctataataaaaatgctgggccaggcatttttgggagctgaatcgtgatgattgtttgagcccaggagttcaagatcagtctggacaacatagtgagaacctgtctctacaaaaaataaaaaattagctgggcatagtggcatgcatctgtagtttcagcttctcagcaggctaagaaaggagaatcacttgagcccaggaggttgaggctgcagtgagctgtgactgcaccactacacttcagcctggatgacagagtgagaccctgtttcaaaaatacaaagtaaataaaaataaaaatgctccaagaagtaatggtgaacactcttgaaatatagtctcagcaaagaaacaaaaaatatagagaagaaccaaatgcaacttttgaaactgaaaaacacaataaccaaatttgaaaactcactggatgggatcaatagcagaatggacatgatacaggaaagaggtggtgaactggaagatagttccaataaaaatgaatagagcctcaaggacctatgggataatgggaaaaagtcaaacattcatgccactggagtctcagaagagagaaaaaagagtgtgggccagaaaaaatacgtgaacaaataatggttgaaagttttctaaatttggcaaagaacatacacctacatatttgagaagctcagcaaaccccaaacaagataaacacaaagaagtccaggccacaacacatcatatccaaattgctgaacactaaagacaaagaaaaaaataattgaacacaaccaaagaaaaacaacacattgctttataggggaacaaaaatttcaaagactggatttctcatcaaaaatcagaggccagaaggaagtatagcaccagttttaaagtgctgaaagaaaagagctatcaacacaaaattctataaccagcaaaactatccttcagcaccgaggtgaaataaagatactctagacgaagaagtactaagaaaatatgttgtcaacagatctactctaagagaacagctaaaggaagttcttcagacagaagaaaaacgataccagtaggaaacctgaaacgaaggatgaacagcagaaatggtaaacatttggataaatattctccagctgacttctctgtttggtggatgaaaaccaaactcatactgtctgatcttcaatgcacgtaagtataatacataagacaattatataccatagagcagggtaggcaaatgggcctatagggtgtaaggttgatacactccatgtgaaaagattagatactgattctaagtagactgtaaatttttaagtatgtatattgtcatccctagttaccactaaaacaatctatacaaaaagctacagtaaataacaaaatagaaaaataaaaaagcggtactaagaagttcatatatatgatacaatttatatgacattatcccaaagacaaaagtttagtgacagaggacaggtcagtcagtggttgtcaggagttaggaatgggtgagagtatggtcggtttacaaaagaaacacaaggaagtttctggagcaatggaatggttctgggtcccatttgtgtagtggctaaacaaacctacacatgtgtaaaaattcacagaacaacaaacacagtcaattttgttttgtgttaatttaagaattaaaatttaaaaatatacaagagagatacaggtaaaggtagaatctaagagaacacagtatgtaaagaacaagaggaggaaaaacaatagaagcaaagcaagtggcaaaaacaaaaacaaaaacaaaacaaagaaaaaacccacactgttgtcacagagggcagcgccgcaaggaagggagtgtggaatttgccatgtctactggatgggctactgggcagtcagtgtcaaccatgctaagcgcggctttggatgtgggagggatggggagagagagcaaagtgtctgaattgcaggaatgtatacatgtcaaagtgtgggaatgggaaaacagccaagtctggactagtgtattaccaaaagctcatattatttatttatttatttaaattcatttttttttttgagactaagtctcactctattgcccaggctggagtgcagtgacaccatcttggctcactgcaacctctgcctcccgggttcaagtgattctcccgagtagctgggattacaggcgcccgccaccatgcccagctaacttttgacagtttagtagagatggggtttcactatgttggccatactcgtcttgaactcctgacctcaagtgatcagcctgcctcagcctcccaaagtgctgggattacaggcgtgagccaccgcgcctggccgaaaagctcatattatttaaaaccataacaacaactgccaatatttagtaaaaattgccagatgctaagccattgtttctcaatctagaggcacaaacagttataaagtttaaaaaagtttggccaggcacagtggctcatgcctgtaatcccagcactttgggaggccgaggcaggtgaatcacgaggtcaggagtttgagaccagcctggcctggcctggccgacatgatgaaaccccatctctactaaaaatacaaaaaaatagctgggcgtagtggcgggcgccgtaatcccaactactcggcaggctgaggtaggagaatcacttgaacccgggaggcagaggttgcagtgagcagagattgcgccactgcactccagcccaggtgaaagagcaagaccccgtctcaaaaaaaaaaaaagtttaaacaaattcttccacacccctcagtattgatgttactgtatttatttaattaaatataaatgtaagtatatattcattatgtttatagctctttatagtgctaaaacaaatattcatataaaaatgaaaactacaaaacccaaattctatttaaccacaataatttaatgttgaagacaatgcgtgttttgggaatcctaaattgtgcttaaaacatgaatatggcagctggacgcagtggctcatgcctctaatcccagcactttgggaagctgaggcgggcacatcaatcacttgaggtaaggagttccagaccagactggccaccatggtaaaaataaaaaaaatcagccaggcacctgtaatcccatctacttgggagcctgaggcaagagaatcgcttgaacctgggaggcagaggttgcagtgagcccagatcgcaccactgcactccagcctgggagacggagcaagactgtctcaaacaaaacaaaacaaaacaaaaaaatgcacaaatatggtacaggctaaggtataggtcctttgggtttgtcctgctgttctttatgtcaactgtgaaggcatcctttatacggtgcctagtgacaggctttggccttctcttggaagcaaatacttcattacatattaagtataccttcttttctcaacagccaaaaatgactaagatccaagacaattatacccagaagttcaaatgtgggctggaattgtatagccagacacaattagtcctcccagatgacccagaatattcttttaattttaaaatattatcatcagcataaaaacaaaacatgtagaacagctctaatttgaggacacagtgcaaaaagccttacattacttaggcgttaaacaaccctacaatagctgcaataaataaagacctcatcagttttcctagcccctcaatgaaaagtttactttaaaaaaatgtaagccacatcaaaacctttgcttactaaggtaacaacaataagaaaagaaagaaaagaaaagtaacattttccattattttagaagactggaatcctgatgataatgtgctcagctctgaatgaaataatttacagattatcaacatgtgtttcttagcaacctgtgtgcataaaaaggtacaatatattgtatgattccaattatatgacattctggaaaggcaaaactatagaaagggtaaaataatcagtggttgccaggagtttgggagaaaggggggagtgataaataggaggaagcataggaatttgggggggcggggtggcagtaaaaatactctatatgggccgggcgcagtggctcacgcctgtaatcccgcactttgggaggctgaggtgggcgggtcatctgaggtcagctgaggtgggcgggtcatctgaggtcaggagttcaagaccagcctggccaacatggtgagaccccgtctctattaaaaatacaaaattagccgggcatggtggcgagtgcctgtaatcccagctactcgggaggctgaggcaggagattcgcttgaacccaggaggcggaggttgcagtgagtcgagatcgagccattgcactccatccagcctgggcaacaagagtgaaacaccatctgaaaaaaaaaaaaaacaactctatatgatactgtaaagatagacaggtgacattatgcatgtatcaaaatccgaactgtacagcacaaggagtgaaccttaatgaatgtacattaaaaaaacaatcatttagaagactggagattccagcaataaatgcagactgtgataagggcatcaaactgcattacaaatgtatgcaacaacatcactgaatgaggtaggaagagaaggtgctgacctaagtagctttggaaatgagtggcatctataagactaaaagcgaagggacttgcacataagccctgaattctagttggtaaagttgtttcccacaggggtacaggttaacaattctgacaccgctatacatgtacattggcactaaacaattaaggacatgggctgggcgcggtggcccacgcctgtaatcccagcactttgggaggccgaggcaggcagatcacgacgtcaggagttcgagaccagcctggccaacatggtgaaaacccgtctctactaaaaatacaaaaattagctgggcgtggtggcgggtgcctgtaatctcagctactcaggaggctgaggcaggagaattgcttgaacccgggagggagaggttgcagtaagccgagatcgtgccactgcactccagcctgggtgacaagagcaagactccgtgttgaaaaataacaacaacaacaaaaccaattaaggacatgaatagcagatagtgggagccaaactctcactgttggaatgatagtctacagataagcaagaggatgaggctacaacaatccatgtggtgatggatttgagaacaaacccacattgtatgtcagaggagtacagaagccaactggaagagttctcgataaccaaaggtggaagattctgaacaacaaaattgttttgaattataacccaaagtataaaataaatatccatgagtccatattgataaaaatacatgattgaggccgggcacggtagctcacacctgtaattccagcaccttgggaggtcaagaggggtgatcacttgaggtcagttcaagaccagcctggtcaacatggtgaaaccccgtttctactaaaggtacaaaaagtacaaagaaaaaaaattagccaggcttggtggcagttgcctgtaatatcaggtactcaggaagctgaggcaggagaatcgcttgaacccgggaggcagaggttgccgtgagccgagatcacgccattgcactccagcctgggggacagagtgagattctgtctccaaaaaaaaaaaagaaagaaagaacaaacaaaataacatgattgaataatacgtgaaggcgaagagacaaatctccagctagtttatgtaaatactccactgtcaaggaagaaagagtgtaactctctctttcttaggtgtaggctgcatgtagtgactcctttcaaagaacagtgtggaaatggggaaggagtaacttcgaggtggagaagcctaacgaacaccaccttagccaggtgatcgaggtcaacattagttacaaatcacattcacagtatgtgacatatcttgatatgatatgatgaaaatacactttatctgtgatcttccacccaacaactcataaccccagtgttatcataagaaaaacatcaggcaaattctagctgtgtagtatcctacgaaatacctgagcattacccccacaaaactgtcaacatcaaaaacaagggaagtctgagacaccgccacagctcagaggaaactaaggagatggagcaactaaatataatgccgtatcctagaacaggaaaaggacattgggtcaaaattaagaaaatattaataaacttactttaatgataatatatcaatatcggcccattaattgcacaaatatatcatgctaatgtaagacattaactacaggggaaaatggatgtggagtatacaggaaccctctgtactatctattcaatttctctgtaaatctaaaactgttctaaaaaataaagtcatactatctgatttcaagacttcctataaaactacagtcatctggctgggtgcagtgctcacttaaggaacctccagtaatttgggaggccgaggctggtggatcacttagggtcaggagtttgagaccagcctggcctacattgtgaaatcctgtctctactaaaagtacaaatattagttggtcatgctggtgtgcacctgtaatcccagctactcgggaggtggaggcatgagaatcgcttgaacctgggaagtggaggttgcagtgagccaagatggtacccctgcactccagcctgggtgacagagtgagactccagctcaaaaaaaaaaaaaaaaagctacagtaatcaagacagtacagtattcacatacggacagagaaaatgataaatggaacaggaaagggtgcagcaatagattcaggcatgtcgccaactgatttttccactatatatatatccacatgaacctcaggttccaaaaaatctcagcaggcccatttcttccattctcacagcatccctatttacatggaagagtgagaacatactaagggatcataacaattcccgagtggctcctatgagcaaggtactgtttccattcatccttaggctggcatgtgaggcaagtgttactaaaggtgaagctcaacaaggttaagtggtttgcgcaaagtgacagagctgaggagtggcaaagctgggtctgtagtgcaacctgtctgattctggcagctttctcacaacattcagaaagaaatgtcgaagaaagaaaaagtgggcgtcagctcaaacatcccaagcctgccctgtttgtcctgttttgttttgctttgttcgaaagatgagatccggccgggtgcggtggctcacacctgtagtcccagtactttgggaggccgaggcaggcagatcacctgaggtcaagagttcgagaccagcctgactaacatggcaaaaccccatctctactaaaaatacaaaaattagctgggtgtggcggtgcgtgcctgtaatcccagctactcgggaggctgaggcaggagaatcacttgaacccgggaggcagaggttgcagtgagccaagatcacgccattgcactccagtctgggcaacagggagagactctgtctcaaaaaaaaaaaaaaaagaaagaaagaaagaaagatgagatcattcaagtttactccataagtgtcttccaaaatattaagtaaatatttaatgaatagttactaaaatgaacatggtagcttattaggccaaatttatgatccagttgagtgtgcctgtatgttatatatacattttataataacttgggggcttctgcataggcagtggaattatttatttatttaatttgttgttattattttttttttttttgagacggagtctcactctgtcgcccaggctggagtgcagtggcgcgatcttggctaactgcaagctccgcctcccgggttcatgccattctcctgcctcagcctgccgagtagctgagactacaggcgcccgccaccacgctcagctaattttttgtatttttaatagagacgggattcaccgtgttagccaggatggtctcgatctcctgaccttgtgatccgcctgcctcagcctccaaagtgctggggttacaggtgtgagccaccgcaccaggcttatttatttatttttttttttttgagatggagtctcgcgctgtcacgcaggctggagtgcaatggtgcaatctcggctcactgcaacctccacctcccaggttcaagcgattctcctgcctcagcctcccgagtagctggtattacaggcacacaccaccacgcctggctaatttttgtatttttagtagagacagggtttcaccatgttggtcaggctggtctcaaacttccaacttcaggtgatccgcctgccttggcctcccaaagtgctgggattacaggcgtgagccacccgcgcccggccgagtcagtggaattatttaaatgctattaaagtaaaactatgttatttcaattgttataaaaatgtacagtggttacttttgctctgttgtatcttgttggttacaatcatggattatctaacttcaagtcttggatcagaatacaacctccaactgtgagccaaggtcatttgctaacgtttcccccctcacaattatagaaaatgctgtacagtttttatatctctattttatcattccagcttctagagaatctctcatgaaatatctagacccgaactagtagaactctgctctctttgaaaaatagcctacatttcaaatccagatcttaggatatgtcagcctgagaaacttcctttccttctggactcagaaatgctaacaggatcacagccttacattgccatatctgcccctgctattgaatatttagagcaaattctaatttcaaattcttatagttagaacaaagtatttaaatctaaaaataattagagattgagaaagtctagaatgctatttctgggttcttcctcttgtatctcaacaaaacagactagctttttatgaaattcataaacttatgttatttctaagttaggtcttatactctgttttcagtcgatttcatataaatgaatagttttaaaagtagttatgatgatggtaatacaattttgaagcactctaaccattttacaaattgtttattgtctcatctgatactcctgtcaatccggaaaaatatacagggagctgttagaatattttatagatgtcaaaacaggcccacatggattacgtaacttgtccaagttacctcactaataagtgctagggcaggagaagacgggtctctggatttcagtctgaatgctttactcagaagctcatgcctctcctgtctcaaatttcaggtctaactccagactaaatatagtctgcattcttctcattccataggaacatcaccttggtttctccatatttctctttcttataggagatctctgacgaagcccagatagttgggtaagactgagatgctgacagattgagttccatgacatctgtcagttagaaagccaaagttaaccatgtactcttgttttaaaaaaacaagtaacttgaagaggttttctctactttacaagagagcattcctcctttgtggaaaagttatctaccattttccacctagtcttcacacttcagacatatttttttaggtgcgtttcacccttctaaaggggggatgtgaagggaagagctctgtaccagcaatttccagaggcagggatttacaggcaggtctcttagagccacagttggcccatgtatctttgattttctgattatatgtacgttttcaatagcccttgtattttgtttatttatttatttatttatttattattatttgtttttagacagcgttttgctcttgttccccaggctggagtgcaatggcacgatctcggctcactgcaacctccgcctcctgagttcaagcgattctcctgcctcagcctcctgagtagctggaattacaggcatgcaccaccatgtctggcaaattttttgtatttttagtagagacggggtttctccatgttggtcaggctgatctcgaactcctgatctcaggtgatctgcccgcctcggcctcccaaagtgctgggattacaggcgtgagtcaccgcacccagcctttttaatatatttttaaatcatttactaatatatctcattttattccaacactgctgcttgcatttctttccaagcatagagaagaaatccaaatacaaagtactacacataatacagtgcaacaaaaatgaggtaggggcgtcccactcattaaacaattgctgacttgaaaatgtcccaattttataaaatgtatcaagagaccgacactttgcattgtattttattcctctatgtcagttaacaattaattacctctcagctccaaattcacccttcaatacctactctgcactaactggctgaactctaagaattcctcctttgcagtgagcatgatgctaaacttaactttcgcagcagagggcgatagagggaaaatgcaagaggaaagggttgctccagaatcctgggtgcttgtgtgtttttcttcttcctgctaatgccaggctgtatcagtgactatggatacggagaatatccaagggtgctccatcccaactgtgagctcatagcagacaacgagcagagcttcacgaattcatagcttcggtctggtgactgcctcgccacagccctcctgacatgaacatcacaaacccatcatatagaggactgacatccaaaagagacaaagggcattgtagggataaggggatttggtggtacagggacactccataagagtctgtccagactggaccaaggagataaaggaatcaggggagggaggagtctccaatcaaaagacgaaactgacaggctacctacaaacaccatatcaatctagagaggaatttcacaattctatcacaggtatgggggactggtggtgaaagtatcgataaagacaactatgcaaagttttaaacagaagcaattactttagagaaaagggcataaagaaataaaatctaattgcagtacacaccatggctcagttgtgaatgacatttacataatcatagaacaataaacactgattcaacactgaaaacactgacatgtgtgtgcgatggcataagtaggaaatgtgtgtgtgtgtagacttacttcaagttagattaacatcttccttaggaggaagtcaacagatgtcgaagactgaaaacatttaagaaatagcagcatattatttagaaatagacattcaactacatttgacccttaaacaacttggaggttatggtgccgacacccagcaaagttgaacatcacttttttttttttattttttcccctgagatggagtctcgctctgtcgcccaggctggagtccagtggcacgatctcggctcactgcaacctctgcctcccgggttcaagcaattctcctgcctcagcctcccgactagctgggagtacaggagtctgcaaccacgcctggctaattctttgtatttttagtagagacggggtttcaccatgttggccaggctggtctcgaactcctgacctcatgatctgcccgcctcggcctcccaaagtgctgggattacgggagtgagccaccacatccggcccacatacaactcttttgactcccccaaaacttaactaaccgtctactgttaactgaaagccttactgataacataaacagtcaattaacatattttgtatatgttatatgtattatacattatattcttacaataaagtaagctagagaaaaggaaatattcagaaaatcataaggaagagaaaatatattaccaatttattaagtggatcataataaaagtcttcatcctcgttatcttcacattgagtaggctgaggaggaggaagaaaaggggttggtcttgctgtctcaggtggcagaggtggaggaagtgaagaaggtagaaggggaggcaggaaagggaggcacacttggtgtaattttatggaaatacactgtaatttgcctgacttctttgctttttcatttctctaaaaatgtttctatatgataccaatccttcttccactgtttgctttagtttcagtgcacattatcacagaagggtccatgtcataaaagaagtcaaaagtagtctttttttttttggatggagtctcgctctgtcaccacgctggagtgcagtggcgtgatctcagctcactgcaacctctgactcccaggttcaagtgattctcctgcctcagcctcccgagtggctgggattacaggcacacaccaccacacccagctaatttttgtattttcagcagagatggggtttcaccatgttggccaggatggtttcgatctcctgacctcgtgatctgcctgccttggcctcccaaagtgctgggattacaggcgtgagccactgcgcctggcctgtcaaaagccatcttgaatccctggaacccttctgccagatcgtttagccagtttgttttctggcactgctgcttttatgtcttcttcctcgttgtctggcactggtttggaagcagacatctccatcaggtcaacttatgttaattcctctggtgtggtgtctgttagctcttgattttctccaagatccctatcttgaaacccttcaacctccacccacatccccaatttttttttttggcctctccacagtctctctcatgatttttttgtttggctctgttgtaaatcttgtgaagtcatgtactacatctggacacagttttctccagcaggaaattattgttttgggcttgatggcttccatagctttttctgtcataacaatagcatcttcaatggtgtcattattctagactttcaagatgttctatcggggttctcttccatagcattggcaatcctttctgtagagtaccacgtgtaatgagacttaaaggtccttgtgaccccctgatctagagtctgaattagagaccttgggtttggaagcaagtagaacacattgatgccttcagtgttgaacctttggggttctgaatggccatgggcattgtccagtatcaaaagaactttaaaaggcagtcccctactggtaaggtactccctgacttcagggacaaagcatcaatgaaatcgatctggaaaaggggctcttgttttctaggccttcttgtacaacgaaaagatgagcaactttttgcttcaaggcttggaggttagcagctttagatataagggcagtcctgatcataagcccaaatgcatttgcacaaaactgtagagttagcttaacccttcctgccttaaattctgatgcttgattcttttccttactagtaaatgtcatgtttggcttttccccccaccagaattggtcactcacttgcaatgaaaatctgtcaggcagatatactttctccttgataattttcttaatgacatcttggaacttgtctgctgcctcttggttgatggaagttgcttcacctactatcttgacatgattcaaacaaaacctctttctgaaattatcaaaccatccgttactggcattaaattctccagctttagatcagatccttcactttccttttgctttaagttgtcatagaatgacactgctttttctcagatcacattagcgtgtatagatatgcctttcttatagcaatcctgcactacagaatagctgcattttcaatatgagattaaaaggtataagtgcaaggattttgcacctgctggcatagctgcagtgacggcttcatgtatttccttttcttataattatccttatgatggatttatttatcttgaaattgtgggcaattgtagctgcagaccttagtctgcagtacatggcaagcaattcaacttttccttgtaatgtcataactttacttcttgggagcatttccagggtgaatcactagtatcacattgtatgggtcccatggtgttgttcagtgtttatattattgcactaaacacaaaaaataagagagaagttcaaggggccactttttttgtactgtggtatacaatttactggagcgataactgctcaggcagagatgattaacatcatagagcagcattttaagtggatactcacagcatctgagcttgcctcaatagcaacaggaggtgactatgaaattactacattatcacagtatgctctacagttcattttgtgcagcatgatttaatactgcatctttccatttgtttacatttctgtccactgtgaaggatgccatacatgatctgtgtttgtgtgcatctgttttgataaattttaactttgcaagtagatctgtgtatattttatagtagcaaatgataaaatagatgagcatctgcatatatttttagcatttttacgtagctaactttttcttaaaaattttcagtgtttctagactatacaattcatctgagagttttttcaaattgtcacaaatctccaaaaaatttttccaatatgtttattgaaaaagatccatgtataagtggagctgcatagctcccgggtcaagtgtatattggactatagacactttaccataaaccactaaaagaatcataagcactggttctgaggggtaagacttggaggcaaggagggctgatgaagagagctgcttctcctaagctgcctaattctgattgttcatactattcagaggtattattctgataaaagtgaaaattaaattttaaaaaattaagtccaaagaagaatgttaactgaataataaacaggtcaatatgaaagaaatcacgaaggcctcagaagcactgcttcggcaatgaagaagcactggaaagtttttgcaagcaaatgccatgatcagaactatatttttaatatatgtgacttttaaaatagagacggggtcttgctatgttgcccaagctggtgtcgaactcctaatctcaagtgatcccccctgccttggcctcccaaagtgctgggattaaaggcatgagccaccccacctggccccagcaccgtattttacaaagaataggagggagatagaaaaaacaaaccatagacaaaaagaaggagagcttgaattaaaaacaacaacaaaaaccacaaccaaacaatagaaatgtgttgacaaaaggagtcaaactctgtaaaatatttgaagggatttattctgagccaaatatgagtgaccatggccgtgtcacagccctcaggagatcctgggaacatgtgcccaaggtggttggggtgcagcttggttttatacattttagagaggcataaaacatcaatcaaacacatttaagaaatacattggtttggtccagaaaggcgggacaactcaaagcagggggtggggttggagggggcgggacagcttccaggctatgggtgaatttaaactttttctggttgacaattggttgagtttgtctaaagacctgggattgatagacagcaaatattcaggttaagataaagactgtggagaccaaagttcttctgaagtcttacagtagctgcccttagagacaagagatgacaaatgtttcctattcagatcttagttaatctctttaggattgggagggtctggaaaaagaaggtctagctatgttaatggagatttttacagatgcaaatgttccccccacaaggaacagctttgcagggccatttcaaaatatggcaaagaaacatgttttggggtaaaatattttgattttcttccttgtcttgtaatgttacgccagaggcaggttggaaagttaagtcacgatatatataaaaataaaacccgtctgatgagaatttatgatttatggggcatgactccccagaccccttatataggaatttgggcaagataaaaaaatcagagtttagttctcaaatgtctggcgaacaccatactgaatggaggaaacagcgctttggactccatttgtggcgggaagatcagaagggtgtaagcgttggtcactataaggatgtctcaatctttatccatctagtaattctccaactataaattagttatccccaggaaagggatagccagtgagggagtcatgaacatcatagtctttcttgtagaataccatctcatatatggataaaaaccaccctgggttatgaatcagtctttcaagagctttcacctagtgtggatttttagccatgtctcaatcagaccacccttgagtaaactgaccatcaaagttctggacctaagagctgagaagccaaaccttggaagtaatgatgcttggataaaaaccacaaagccatgcttactcatacatcctttcactcaccagggctctggcctacgtgtttagtaacatagactaaggaatgacaggttaacttttttctttataacacagctacaaaaagatggaacagagaaaatggggtagacaatgtatctggatttcaggaagacatgtaacaaaaacggaagccattacacctgtgattaatgaatcagaaacatcctcttccagaaaagtctacgtgagggtcctaagtctacgtgagggtcctatgcaggtccaggagaactggggattctgagaaattaggacagacgtgcactaggaacagaagaaagaatcgtacctactggaatgcactcaggccaagccacaaactggaaatcagagttaagcccaggttctccctaccccccctactgctcagaacctctctattccaagtatggtactcagccagcagcagccactgcccaaccccctgcccccgcccccaccagagctggttagacatgcagaatctcaggctccacacctcaaatctaacaaatcaaatcttcattttaacaagatatcacctatgcccattaagtttgggaagcaccaacttaggagagaaaggagtctttccggtttctgccttcccccgtggtgcctgcaggcgtagaaactaggcaaacacctggtgtttaaagctgtctagatagtaacagaatcatttgtatactatgaaagtgctaaggagaatctggcaactatgtatcttctggaaaaggcactgattccaggacactcaattatgtcttaggagcttgattttggagttaaatgagaagaatacagcatgaatcacggatttccctttatagccgcctattttatttaaacaaaaaatgctaaacattaattttagttgtacttaattgaataatttctcaggggaatcgttcagggagagtttaaaactgcctgtttccaaaagccattacaaattggcatatactattatgtcactgtgccaaccaaaacagcacactttaatgtccctgaggccgccttcgctccagatgtgttcagaactcctagtaatgtaatgcaggcaaaaaccatatttacatgaagtcgtgttttgaatatccttttccaattatctggaatgagataatagatccctaattggaagcactggggggaaaaaaagccaggtcagtggttcctcccttgtgaatgcttttattagtgaaaactaaaacagtctgtacaaaagtaagagaaatctcctttgccacagttaatcatcggaacatctataaacttagaaactgccctatggtcacctctaattagccagctgatttttaaaagattgatcttgtcttttcctatgaatcgtaagtacgaaaggattgggggtgggggagggagaaatggaatgcaagggcaagaaatccaaaaactgctttggcaagagaacagacaaatgcgatggctgtacagctgttgctccctccaccttcatcccacccaaatatcttccactctgtttcatgcttgcatgaatggcatggattctgaatttctcttttattcctgactaatgatggtcataacatcactaccagataagtcatcattgcttatgattgagttaatttctatttcaaattatatctgctgataaagaatcatctgtttattctcaaagcatgtataagtaaaaattaaatagcaaattttacactttttgctaaaattgtacgtttccttccttaacattcattatctaatagagcttaaatttaagtcaaataagtgtttttgtacaaatcggcatttctcttccattacagtggagactggctcccacacgtcataaaacgcggtaacgtgccatgcaatcaggcacgctcagttactggagttgtctatcttcacagatgtcacagagaagccatctgaaaagctacgcatagtgcagctgttcttggctgttagcaagataaacttggaaaccttgatctttcaaatgttcaaaatcggaatgggttttccaaatataaattaattaccaaattccatgtgttgacaagcaaacactctaatgtttacgtttcaacttgacaaaagaaatgtaagcatattatccataaacttctaaaagaaacaaactccatgtattaacttcattacatttttttcctaaaatgtttaaaaacattatcatgaaatgtaacatacgaagagaaaagcaaaacttatgtgtacagtttaacaaatgattacaaagcaaaaccacgtagtctcaaaaaatctcaactcatttactcaatgggcaatcaacaaacatttacaatacaccaggcactgtgttaggtgctaatttgaacacttaggaagtattacttgttagcattatttgctcaaataacaaccactgcaaagtccataattcttacctacctgtgtttcaaggcaaacaaatatatactttatcatgtggacaaggagcattttcctccaataaatctaccctagaggtttgtactcttgggatacttaacaatatatcacttctgaaaggaccacaagaaagtgcttggtggtcagtaacacccagatgtgaacttttctctctgacctatactagcagtgaatgatgttctcaatgtctctctgattaacccttgaattcaggcctcttcctccagaacaaaggcttccccacttgggagctgcttagaactttcccaagcaccttgcaaagtgtcttatttttcatactgtgcttagatctgaaaaaagcctttgttgtagcatgaagactctaaaatccctggctataaaacgaatgttctcaacaccaggaaaaacacagtccatagctttgctttaagagaaattgttttgcctaattaatcacaaagttttcaagtaaacttggtttgtaaaattctcaaaagcagttcagctgtttccaaattgcacatcggaaaattcctatgttacatagtccgggataatcaatgttaaaacaatatacataacaggatcgtttcctcactaggttccatttctgtcaggaagggagggagaattttaagccaaaatcgtaattcaagccaataatctgcaaacttgggtgtacaagatgattcactggaatgtggaaagaaaatactaaaatttccattaatatgctgcatttacttcttaatctctcagcctttttagaagcaacctaatatatagaacagtagtatatataatttttcagatacaattataaaaatattcgagagggttgctcataattcctactaatgggatgcatgatctaaaaatgttggaagtcactgtactaaaagtggtatagacaagctataaaagaatacaagtacatggaactcaaaagtctcaaaagttaaatatctttgtcattattcaattaaatattaaagtcctagtagtaaaaagtgagtattcagtcaacttgagttgacggaggattaaaaaatacacaaatacatagtccaaggaacacagtggtaagatgttaatattagggaaactagggtgagggaaataagaaagctctttgcattatttttgcaacttttctataaatctaaaattggttcaaaatcaacacttaaagtgacttgtaactaatcacagcagcaatttttttttttttttgagacggagttttgctcttgttgcccaggctggagtgcaatggcacaatctcagctcactgcaacctctgtctcccaggttcaggtgattctcctgcctcagcctcccgagtagctgggattacaggcatgcaccaccacacccagctaattttgtatttttagtagagacaggttttctccatgttggtcaggctggtctcaaactcccgacctcaggtgatccgcccatctcggcctcccaaagtgcagggattacacgcgtgagccaccacacccggcctcacaggagcaaattttgaaaattattttaaataaagcagagtggaagttaccctaaaatggaagttactcatgtgcattcccccacacccaggctctccatcctatgccatagatcaccataactgatgtgccctcgacattatctcagagccctcattcccttcagcatttaagagtttctgtcaaaatacatatttgttcacagagtgctctctgcatgtaaatataattcgtctttagagttctgatagaagatgataaaaataggttgagaactgctgaactatagattgaggggtgtagaggaagtagagaaaggacgtaatcaaagaaaaaaatcatgagaatttccgaacatgattagatgtttgctttaggaagaaaagttgcaataggacaaagggtgcctatttaatagtaactggacactatgtgttaggcattgggctaagtcctagatgtataagaatgactgactgatggagatacaaccctgaccctcaagaagcttactagagaaaaaaataccagaaaggaggctgtgcaatagcactgagatgtaacagggagctgaactaggccagtggtggaagaccggccaggagcaacaccagggagcagaactcacccaatctgttatgagtaggaaattctttgctcacaggcagactgaccagggctaagtgggtcttttcactggagacagagagaatggcagttcaacacccctactctgttattgcacatcaactggcaagcactgcccaaaggtaaaatgtggacagagaggccaacaacctaggctggtagctgggggacatggagctgtgattcttgggaattcttaggaacacagctgtgaacgtaaaggagacctgtttctcaagacttgtaggttatttacatttgtgcacccagaaaagggcttcctgagcatcagattgtaattgcacagataggagctaagggttttcaatggtagcctttatctctccattgtttttccccctagtcatatctacctcagatctaaagaaacaagcttcaatccttgagaaactactgccaagcttccagtgtttccactaccccaacactatgtatatccacagaataaataggtgaatacaaagaagccagagaacaagggcttctgagtgaaagtggggccaagtgtaactgtgagaagctgactgccaacacagatggagggctgtgctcgtgtatacctcaacggaaaaaaacttgcagggacagccacaaatatatgtacgtatgtaagtatgtatgcatctatcgatccatccatcgatccatccatccatccgtccatctaaccgtccatccacccatccgcccacccacctatccactcaaccatccacctatctatccaacaaatcatccatccacccacctacccatctgtccatccatccatccatccatccaaccatctatctgcccgtccgtctgtccatccatccatccacccatctgtccatccatccatccatccatccatccatccatccatccatccatccaaccatccatccatccatccatccatccatgaaagcaaatgccagcatccaagaggtggcgaaaatccagcacagactcctgagtgaaggtaagtggtagctacagaatttccctaagaaaggcacagagcatcagtcaaattggagggaaagggctggaacactgcttctcaaactctctgtggtgcagaactttttttttttcattttcaatgtgtcacagacaaaagcttttgcaaaatacaacaaaaatgatttactaggaaaattaaatttttaagcccattaacagtataactggatgtcatggcaacaccaaatgttataaaagtctgaattcttattctcaatgtcatacttacctcattgcaaactggtaacaaacagctcaaggacaggcacttgtctcataaccatgctttgggctaggggacttgtgtgaagtcgagttgacagagtaaactgtctgaggtactcagtgagaactaaagctgacacccaggtgtcacagggtgagaccgctctacccagggtcaaccacaagaaccagtcaggcacaaatctgtttgtgtctgttttgggtcttctttctcacccagtcacaaaacacagcttttgatacttgctttgtttggaaactgatacctgagttctgcttttttttttttttttttttttttgagttggagtttctctcttgtcatccaggccggagtgcagtggcaccatcttggctcactgcaacctctacctcctgggttcaagcgattctcctgcctcagcctcccgagtagctgggattacaggcacccgccaccatgcccagctaatttttgtatttttagtagagatggggtttcaccatgttggccaggctggtcttgaactcctgacctcaggtggcccacccgcctcggcctcccaaagtgctgggattataggtgtgagccaccacgcccggtctgcctgagttctgcattccaccccatcccacagcctgaggaaggacaataggcctcaacacacagttgtaacaaggttggtggacaacagcctctttttctagcatcttcaaacctcttttcctttctccaggcacctttccttctgcctttaaacacatcagcctggggtcctctccttgtgtcataaactaattataaaatgaaacctcaagatccttcacttgatgttgacgccctccctagttttctcctgtgttagtttgcacctttctttcattaacaagttcctggtatctgtagcctcaaataaggtcctagaacctggcttctactctacatactctagtgaacccatcaatgaccctgggacatgactgttacaaaagcaatggcttttcggcgggtgcggtggctcactcctgtaatcccagcactttgggaggccgaggcgggaggatcacaaggtcaggagattgagcatcctggttaacacagtgaaaccccatctctactaaaaatacaaaaaattagccgggcgtggtggcaggcgcctgtagtcccagctactcaggaggctgaggcaagagaatggcgtgaacccggtaggtggagcttgcagtgagccaagattgcgccactgcactccagcctgactgacagggcaagactccgtctcaacaacaacaacaaaaagcaatggcttttcttctgtatcatcttatccagcttcttcatggcttttgaaataggctgttcacccagcctttgaaactctcatctacaaatcccaaaataacatactaacccatttccagcttctatgctggcatcccttcttcttttggagttttctcacgtctttgccctggctgctcttgcttgtaacagtaatgagttctcctggatttatttacaactttataatgaaccccacttgggccactccaggcagtcatttcccttgagttctcattccctatctccaagtgtctccagagctgtgctgacgtgaaggtttcctgttaccttacacctgcttctcagccctggttgcacattaaaagcatgtgggttattttaagtcataccttacctaggcttcattctcagagatcccaacttaattggactagggtgaaactgccttgcaaagatgatgacatcgagagaaatgtagcatggctgactccatcctgcttctagcctctcaggctggctgtcctttgctcagtcctggacacaggccaaattaactatgggaggaatttagtttgtagtttaatttttttttttttaagatggagtctcgctctgttgcccaggctggagtacagtagcacgatctcagttcactgaaacgtccacctcccaggttcaagcaattctctgcctcggcctcccgagtagctgggattacaggcacatgccaccacgcccggctaatttttgtatttttagtagagacgggatttcgccatcttggccaggctggccttgaactcctgacctcgtgatctgcccaccttggcctcccaaagtgctgggattacagatgtgagccaccacgcccggcctgcagtttaatttttaagccaggataatagttattccctaaaacaaaccccctccttgctcagggactgaaaccacctttgaaaaaaaactaatgaaatcccatgagattaggattatgcaaggggcttgaattctgctaaaatgtacacagttagaggataaccagccagtgttttggaggtcacaagatttctaactaccccaattgttcctatagataacatcattattgtagaagtcaagattgatcttttgagatgttttttcagatttttccattctggcaaccaactgccttgacccagacctgtgactcatgactcagcgggtcctgtggccccctacccagaggctgactcagtgcacacagactgttttccacacccctatgggttcctctccagccaatcagcagcacccattacttaggcccctgcccaccaaactatccttgaaaaaccaagctttctgggaagctgatttgagtaatcaacttctgtccttctgcttggttagctctgcattaaactctttctctactgcaataacgctgtctcagtgaattggttttgtctgtgtagtgggcaaaaagaacacgttagatgattacagagttagggccaaagctttagtatatttttttcctttaatgctaagcctataaaaccattgccaaggaacgatttttctcaaagttagatgcaccctggaatcacctagaggagctttaaaattacagatgcccgtttcctactcccagaaattctgatttagttagttggggtataataaaaaatctatttgtctttgtccccagttcctggcacaaagctcctaaaactcttgtgatttccttactaataggagtgtcttttgttattcataaaaaaccccttgttaagcccctagcataaacatatctgagtttatgctaatgaggtgaccctcagtggggccctagatagcttcaggatggggactggtctccagaaggaaccaaccatgtgattacagagttggaactcttagcccccaaacccaacctctgaggtggtgagacaaactggagactgatgtcaatcacaaatggccaacgatgtaatcaatcatgcctatgtaatggaacctccacgaacacccctaaatgatgggactcagagagcttctgagtaggcaaatgcatccctgtgccagaagggggttgcatgctcactccacggggacaggagctcctgtgctggggacacttctggaccttgccctaagtgcctcttcatcaggctgttccttgcatccctggtaacaaaatagtacagcattttcctgagctcagtgagttgttctagcaaatcatcaaacttggtagaagattgtgggaacctccagtttgtagccacgttggacagaagtgtgggtaaactggagacccagtgcttgcagctggtatctgaagtaagggcagccttgtgagacggagcccttcaaactgtggagtctgatgctaattagagccagaattgaaccagactgtagcacagccaagtggtggcaaggaatcagagacgtggtattggaaaagtccccatatatttgttgtcaggagggaaaaacctctgattggtatagggtgcagcccagacatcaggcatcaggattttaaaactctcaaggtgattctaataggcagtgaaagtcgaaaactaacagtaagtgtgggatacatccccattaggagatggttctaacaacatgccagcagagacaatctaagaggatttattcaagaaattaaaggcaaaggactttctcctcagagaatgcccttttaccatgttctttccgtttttctaaaaaaaaaaaaaaacaaaaaaaaaaacaaggctgggtgcagtggctcacgcctgtaatcccagcactttaggaggctgaggcaggcggatcatgagatcaggagatcgagaccatcctggctaacacgtgaaaccccgtctctactaaaaatacaaaaaattagccgggcgtggtggcgggcgcctgtagtctcagctacttgggaggctgaggcaggagaatggcatgaacgtgggaggtggagcttgcagtgagctgagatcacgccactgcactctagcctgggcgacagagcaagactccgtctcaaaaaaaaaaaaaggggggggggaagggggagggagaggaacatttgagaatgaatgctttcattttttgcccacacccccccctctttttttttcttttttttttttttttaaagagatgggctctctccctgtcacccaggctggagtgcagtggcaccatcacagttcactacagcctcaacctcctgggctcaagcaatcctcccacttcagcctccttagtagctgggactacagacctgtgccatcatccctaatttttttcaaaaattgttttgtagaaataggggtctcactatgttgttcaggctggtccagaactcttggccccgagtgagcctcctgcctcagcctcccaaagtcctgggagtagaggtgtgtatcaccatgcccagttcgttattttatttaaaaaatttttcttagacacagggtctcactatgttgagatcgcccaaggtgatctcaaactcctggcctcaagtgatcctcccacctcagcctcccaagtaagctgggactgtataggcataagccaccattaattgctttgatttagaattaatggtttttaatttaccttataagaggccaattaaaatcaatcacctttttaacaaggtgtgttttggggagtggactacagatcccagaaaatacatggaaccagttggatcattcacaagagaagggtggaagttgaatttcaacagcaaaaaggacaacaaatgggaggtagatattaagtatcgagaatgctctatctgggaattccaacagcttcttacattgcatggtgaaaacctttctgttagcagagttggtcactgggtccatgaacggtcacggcctcaggatgaggccccaaacttaacctccactgagaagactgtgtttcctgagcccatagagctctattttgctcttatggacctgaattttacttaaaacaaacaaaacaggtggtgagaagagtgagcagaaatacatatccagtctaactgcagaatcccataagattcacggaaacttcagaggaaataggaaattatctgtgtagaaaccttttcttttggcataggctaacttttcagtaattgtgtaaaagttaccctcattgttcatttgactaaactactgtggtttattgtgcagtggcgttaaactatcaagaatcaatctgctgaacccacttaaacccattctgtaatattagtgttgggctgtttagatgaattagtcacacatctcacagtctctcttacaacattcttggtgaaaaattagaaaagcatgagctcaatgtgtattcttagatgggtaaccccatggcacagggaccgcactcaggaaatattcgttgactgaaggagtcctgagaactcatcaatcatattcaacatcggccgccagggactcagaaatccttgcccacagcagcggccctgaacctctgcagttctcttaagcccgtggctccacagccacctccctttttctcagcaggtgttctcatcaattatttcctaaagggcacgactccgccaagttagctctcttccttcgaccagtaaccttacctataggtgcctatcagttccattctaaatgtcccctctccttctccagggaggaccctcgcctatctgctgccaccgtggcccgcccacagcactttcccgcatcttcaccttctcggttctggcctgtttctcagtccatagacatgctccaacccctcccttctattaaaccagccttcatgctcatgcttactaagcttccttcttcctttcaacaccaaccttcttgagaggttaagtctacaattctgcccccacaacttgaatcctcatacactcacaacccactacaactgagcttgaggcgcgattattacggggacagtgttcctgccgaggtcatcagtgacttactggaaaattccaatggcttattttcagtcttccgtctattgatgagagtttgcactctcgttttatccaaccagaagagagtctctcaacttagaattgtggacggtcattttcataggcaacatttacgtgcatgtgcctttaagtacattagggggtggaaatggagatgagtcccattgttccaccagtttctcagcgggctctctgacctcccttgaaatgaagaaacgcaactggactattgcaataacctccaaattcgtttccccaacttgagtccttggatctcaatcctatacctatccctaatctaacctttgcattactatagaattttttttggctgggcactgtggctcacacctgtaatcccagcactttgggaggccgaggcgggcggatcacctgaggtcgggtgtttgagaccagcctgaccaacatggagaaactccgtctctactaaatatacgaaattagccgggcatggtggcgcatgcctgtaatcccagctactcgggaggctgaggcaggagaatcgcttgaacccgcgaggcagaggttgcagtgaggcgggatggagccactgcactccagcctgggcaataagagcaaaactccatctcaaaaaaaaaaaaaaaaaaaatttttttttttttttttgcagattatataggccagagcaggcatgccttctcttgctgtaaataaggtttataatacaatgtagcagaatacagccatgcttatgcctttacatggtgaccctggctgctttatcctttcccctgctcctgggagtgaactaggtgttcttttattgaggtgaaattcagataacataaaattggccaatttaaactgaacaagtcagtggcatttagtacatctgcaacactgaacaatcaccacccctatctagtttcaaactcttctttcctcactccaaaaggaaacccataccacttaagcagctgctccccatggccgcatgacatggtttggctctgtgtcctcacccaaatctcatgtcgaattgtaatccccacatgttgaaggaggggcctgttgggaggtgactgaatcatgggggtgaacttcccccatgctgttccaatcgagttctcacaagatctggtggtctgaaagcggagcacctccccctttgttctctcttcctcctgctccggccatgtaggacgtgccagctttccctttgtcttctgccacgattctaagcttcctgaggcctcgccgagccatgcttcctgtagagcctgtggaaccatgacccaatcaaaccccttttctttataatttacccagtctcgggtagtagttttttttttttttttgagacagagtttcactcttgttgcccaggctggagtgcaatggcgcgatcttggctcactgcaacctctgcctcctgggttcaagcaattctcctgcctcagcctccccagtaactgggattacaggcgtgtgccaccacacctgactaatttttgtatttttttagtagagacagggtttcactgttttggccaggctggtcttgaacttctgacctcaggtgatttgcccacctcggcctcccaaagtgctgggattacaggtgtgagccaccatgcctggccaaggccgtctcaggtagttctttacagcatgtgagaacggactaatacacccctctccctagttcctggcatcaccaatctgaattacggctccatggattcgtctgttctagatatttcataaaaatggaatcatacaatatgtggccttttgtgtccggcttctttcacttggcaggatgttttcaaggttcatccgtgttgttccatgtgtcagtattcattcctatttatggctgaataacattccattgtatggatatgccacattctgtttctgcagcaatggctgcttttgcactgtaactgcaatggtgaatagctgcaacacagatcacacggcctggcccacaaagcttactatctggccctttggtgacaaggttcgctgacccctagtttataccatctaccttcagaagtggcgattttccaaatcagcttgtattaatgatcactgaagcgctgtttagggaagaaaaatgctggacataaatgtctgtcattagaggactggttaaattacagcaaacacatactacgtaataccatgcagctcctcagaagaatcaggtaaatctgtacgtggtgataaagaagcatctctgggattaattaggctaaaaaagcaaaagcatgcaatgcatgtagtatatattcctttccccttaaaaaataacccataaataagtgcatatatacatatctgggtaacactttccccagaatcaaaagaaacgttcacttttcattttgtacctttctgcactatctgtaattcctaaccttaaatatgcatttccttattagcactgtcaataagtgttagctaaatgaggaaactatggtctgttttcttcttaataagtctgtttttagaagtaataatgaggaagcaatctaataaacgttattttttgttgtcgttgttttttgagacggagtctctctctctgtcacccaggctggaatgcagtggcacgatctcagctcactgcaacctctgcctcccgggttcaagcaatcctcctgcctcagcctcctgagtaactgggattacaggcatgcgccaccatgcccagctaatttttgtatttttagtagagatggcgtttcaccatgttgttaaggctggtctcaacctcctgaccttgtcatccgcccgcttcagcctcccaaagtgctgggattacaggtgagaaccaccgtgcccggccaaatgttatgtttttaaggaagaaaattcaaagcaaaatgctatgttgaaaactgacatgagttatgtctttttatgagctttcaattactttattttcttacccttgcaggtcagtgatcctccaaagataaaagaaaaacactgtgccacaggttagaattttttctgccagaaagctagacactgcaccagaccatctttaaagacgccgtccatatcagtcacgggctgagttgcaatcctagttttccgctgattattactgagaagcataccacatctgtcagccacaggacactgcaaatcttctactgccacagagttcagtatggcagtgacttaggcttcggcacacaagtcagccatgacaggttggtttgtagggtttatctacgcattctgatggtccctacacattttccagatgtgttgacctcataaaactgccacctaccccaggctgtgaaagaactgctccaaccatatttttcccacccctcaactctagcaacaccttgggttccctggctgggcgaccccctaagatatgaagctgggttggctgtcagtcctgagccctgacaagagaataacagcagggtggccgggcagccaggcatttttgcatccgcccagtgctgggaactgacgcattcctcgttccctggggcctaaggttctgcttggttttgggtccctgcaagattggggccctgcctactttctcaaccagtttatccttcaaccctctccctcaggccccaaaagttgctgctgaaggtccctgtcaacaggcaaacagtcaacccactacagacactcactcaccctgcctccaggccctctctctgcctggggcctcgtgttacacctgcctaaagtgcagcgcctggccttcctccccctgcctctggttaggatctccattctccctcgatcccctcttcttccactgtgacactctggtttccagatccttattcctcttccctccaggtcatgccctggcccattcttgatcaacttcgagttacagaatcagctctctcatacaagcattctgaacaggtcactggggtatggtagatacttgtagtatattttcttcaaaaagttacaaacagatttaactgaggaatcaatccaaaatcgagaatatcatctttcttggtgctgcctaggtacaaagcactttgtatatcttccgaggatgcaaagatatgacagtccccttcccttaaggagtttgaaatttagtagagaaaaaacaaattcagaaataactataaatcatccaaagcaaagaataccatgtaacacaagagaggttaaaagtgccagagtgtagaggatgaagagatcatctccaattggggaaactcaggaaaagattcatgaatgaggcagcacctgtggctgatactgatgaatgaccaggatttttatggggtaggacagaggccacagtttctgactaagaaaaagtatatttttcaaatcttctatattaaataatgagcaaatctggcctcttgtcaatatgttctttctaatcagctggctttttgtctgaaacactacattatatcacccaacactgtacagagaaagaatgccttctaggtagtcatcgttcaacaaaatctcagtaacgtcacaaaaatctcaatacttcagatttacaaaaatctcaataacttatcacacatgctcctgtccaggttcattcattttaatcatataatacatgatgatttatttgtatttataaattatgtatactgttaatatctgaatggtaaatgacatgattcttttgattgtcattaaaataaagaggtacacctgaagcaaggtgggggcactccacttaataattgcacttaatgataatcgctaccagctattgagctactgagcacgacacggactttaaatattatcactcaaaaggttttcatggtgaaaagcaaaccatgtaaaaaatgttcattacaatccatcatgatcaaaatttcaatgtgttaagatgttatcttcagtaatagttgcaaaataattgcggtacagcatttagttctttcttccagttaagtgacaggcaaactgtacagcttcacaggttctactaagcacggacgacaatctgaaatagtccactaatgtccctccaagctcagatccctagcacatattggagttagggacttcagcccaggccagagaaaagctcagtacacacatctaaaggcttggacgtctacagatgagccagtctcaatctctctcttgcacgcacgtatgcacgcgcacacacacacagctgaaacatggctccaaagtcccatccttcatcctataataactgtctctctcttctcaagtaggatcagccaaccactaaaaagcaccctgttaattagaacctagacaatctgtctttaatctgatacaatgcctaagtagcccaaaaatgctgaatttcaacgttttgaaggatttattctatgctaataaagaactgggggccaagtgtgggggctcacacctgtaatcttagcacttggggaagctgaggcaggaggactgcttaagtgtaagagctcaagacctgcccaaggccaggcacgatggctcacgcctgtaatcccaacacttcgggaggccaaggtgggtggatcacctgaggtcaggagtttgagaccagcctggccaacatggcgaaaccctgtctctactaaaaatacaaaaattagctgggcgtggtggtcggcacctgtggtcctagctacctgggaggctgaggcaggagaattgcttgaacctaggaggcagaggttgcagtgagccaagatcgtgccactgcactccagcctgggtcacaaagcaaaactccatcttgaaaacaataaataaataaaactaaaaactaaagacctgcctgggcaacacagtgagaccttgtctctagtaaaaatttaaaaaattagccaggcatggtggcacatgcctgtggtcttagctactcaggaggctgaggtgggaggatcgcttgagcctgggaggtagaggctgcagtgaccttatggttgaaccactgcactccagcctgggtgacagtgcgagactgtctcaaaaaataaagtaaaataaagaatgatggtggtaaaatttatcctctgaagattttcagaggttttacactgagcaaacaaaataattcaatataagttatatcttgtaagagacacacctagtattaccagtctatctcttactagatataacttatattacctagtattaccagtgtatctcttactagttaagagatagaaagatagtctgaaattcccattttaccactaattacctttgaatttctgtgatttttataactactttcagcttcccaaagttcacatttcctatttgctcggttggaagtaagagagttgctatctagaggcttctgggtattccccaatttgcaaagagaatgaattccaaaagtgtattcgtggcttagttgttcagaactcaaggatgcccaaatacatgttcccatagaaataacgttgtatatgtggcagacccgttcccaggtggcccatgagatctatcacaccatgtcacaggagtagcagtcttgatccagccacacctgatcactatgcacaacagtctgaacccgagtctgctgtgtgatgccaggaacacgcctccccagtgtggcaggcagtcacctgggcatcctgagacttgtgtgttgaaggagcaggacaaaaatccatgtcggtatttctgctataatgtgatatatacattcctgaaaaatctcacatcctacaaaatcacacttgaaaaataacgggatgaaaaaggctgttggggtagaccactaaatccctctgtaactctgtaaccagagcactaaccaaaagaataattaatacctagggagatgacttggacagcctaggcaagcagcttggctgtggctgcggctgcctcgagggatattaaacacacaaatgacagagtggcaactgttggctcacagacagagtggagttctgagccaggagctatgttaaggtggacacagagggaagatgcctgctgggagcccagagtcctagaaggctagcgggtgcctgtcctggagagaaagcgctgggtgcaggcactcatttttaattttcttaaaatagagttgaaaagcgtgtctgctgcctgtgaggttctttcctttcttgctgaaggctgtaactctactccggcaattcctgctcctctggccaaagaaaaactgcttctggatcaatctaacctccaggatatactgacatcattcctctgcttttcagttgagctgactcgtgctatggacccaagggctgtagcacacagaactgcactcctaggaccagtggctgctgactcctcagagttctcacctggttagagaaggccctttccaagtctcccatttctaaaaactctgaatcagagaacagggggtagtcatcctgtgagaggtaaattctcttgacatccatgacaattcaggcaagtcttttgtattctacttagtcaccagaaatgacttttgttttgttttgttttgttttgagatggagtctcactctgtctccagcctggtgggcagtggcgcgatctcggctcactgcaagctccgcctcccgggttcatgccattctcctgcctcagcctcccgagtagctgggactacaggtacccgccaccacgcccggctaattttttgtatttttagtagagacggggtttcaccgtgttagccaggatggtcttgatctcctgaccttgtgatccacccgccttggcctcccaaagtgctgggattacaggcgtaagccaccccgtccggcaaagaaatgattcttaatctctcttgaggtgtgttcaccctgagtggatcagtctgatttctggacaagccctgtctgatagaaatgtaatgtgaaccatgtctgtaattatgaaaaagtaaaaaggaacaatggcatattttatttaacccaatatagccaaatattaccatttcagtatgtaatcaatatagaaattattggcaagatattttgaatctttttttctggcaccatatcttccaagttcagtgttaccttgtacttacagtacatcttaattcagactagccacattataagagctcaatagctacaagtggcctgtggctactatagtggacaacaccggtctattcagaggctctgttgatagcaaagtgtcatatttctagagacacataattgaaagaaaatgcaaccaatgaggcacaaaacatgtttttcaagttcatagccccatatttcatgaaagggtacctttgacttggtcagtttcagtgcaaacatattaatccttaattacccagaagattcagttaaccagaacatcccaatcccttactatatactcagtggggtttttaaaacagttttattgagacataattcacctgccacaaatttacccatttaaactgtataattacatagtttttggaatgttatactattaattttttaaaattgttttgagatatatatatctaaaatggcaaaatggcacattttgttttatatattatatataaaatatataaatacattatttatatatttttattatatattttatatacatatatttatatataatatataataaatatttatatataacatatatttatatattataaatatataaatatatgtaaataggccaggcacggtggctcacacacctgtaatcccagcactttgggaggcctaggcaggcggatcatgaggtcaggagatcaagaccatcctggctaacacggtgaaaccccatctctactaaaggtacaaaaaattagccgggcgtggtggcgggcacctgtagtcccagctactcgggaggctgaggcaggagaatggcgtgaacccaggaggcggagcttgcagtgagctgagatcgcgtcactgcactccagcctgggcgacagtgcaagactccatctcaaaaaaatatatattatatattttatattatattatatattatatatattatattttatatattatatataacatatatattttatatattatatataacatatatattttatatattatatattatatatattatatataatatataatatatattatatatattatatattatatagaatatattatatataatatattatatattatatataatatatataatatatattatatagaatatattatatataatatatatattatatattatatagaatatattatatataatatatatattatatattatatattatatataatatattctatagaatatatatattctatataatatatatattctatataatatatatattctatataatatatatattttatatataaataaatataaatataaaatatatataatttatatataaaatataaaatatatataatttatatataaataaaatataaattatatataatttatatataaataaaatatatattatatataaaacaatttgccattttaaagtatataattctgtggcattaattacactaacagtgtggtataaccaccaccacttatctatttccaaaactttaaaattatctcaaacagcaactctaaccattatgtaataattccccatttccccctgcccctagcctcggtaacctctaatctactttctttctctgtgaatttgcctatcctagatattccatataagtgaaatcatacaatatttgtctttttgtatctggcttatttcactgaatgtcttccaggttcatatatgtaatcgcatatatcaaaacttcattctttttatggctgaataatagaccattttaagtacatactacaacttgtttacacattcatctgttgacggacagttgggctcagtggttttggcttttttttttttttttttgagacagagtctcgctctgttgcccaggatggagtgcagtggcgtgatcttggctcactgcaacctctgcctcccaggctcaagtgattctcctgcctcaacctcccaagtagctgggactacaggcgaccgccaccatgcctggctaattttttgtatttttagtagagacgggatttcaccatgttagccaggatggtctcaatctcctgacctcgtgatccacccgcctcggcctcccaaagtgctgggattacaggcgtgagccactgcccccggcctttggcttgttttttaataaatcatgagttgctgagcatctcattgggtagcaggggtttttttgttgttgttgttttggtttttttttagtagagatggggtttcaccatgttggccaggatggtctccatctcctgacctcgtgatccacctgccttggtctcccaaagtgctgggattacaggtgtaagccactgcgcccagcctttggcttgttttttaataaaccatgagttgctgagcatctcattgggtagtagcatttttgttgttgttgttttatttttctgtttttttttttagtagagatggggtatcaccatgttggccaggatggtctcgatctcctgacctcgtgatccacctgcctcggcctcccaaagtgctgggattacaggtgtgagccactgcgcctggcctttggctcattttttaataaattatgagttgctgagcatctcattgggtagcagggtttttgttgttgttgttgttgttgttttgttttttttgtttttttgttttttagtagagatggggtttcaccatgttggccaggatggtctcgatctcttgaccttgtgatccacctgcctcggcctctgaaagtgctgggattacaggcgtgagccaccgcggctggccaagggcagcaggtttaaaggaagagagaacacagtcatgacactggtgctgtggctgaattctagaaggtagtcctcttcccaattttactaactgagaaaagtaacaaggtaaggctcacttgtttaagaacagcaggttagcaacaacatagtgccaaacgttctgacattaacatcatggtgttaagaccacgagtgctgtactgtctccaaatacaggtcaaggctatgcttgcagagctttcccagaaacctcccttccttttcctttctgaagtcagagtgttcctaggacaacattttggttcataaaacattttgtaatgctgtgactatctcagcatacaggatacccctctcacttcaatctccttgttttctaataaaatcaaacatttcaaaaatggcattaatgtaatggatgaaagagttacacttcaccatcattttaagttaaaaagaagtatttgaaaaaataaattctgattctaatgctcgttcttgaaagtttgcttcaagcaggaaaacaactgcttttcagattctctttttcacctggcttttttttttaagttcttaagtaaaaataaaaaagttccaattgattttgtaagttttgtgatggtaaaacaagatgtggagcaaacatttcagaataccaaacagagttaattaattccagtataagctcctcacatacggccagagcttgcaagcagatgtgctggctaaatatctcaggtcaatcttagcacattattgaaagtaacctcccattcctcagaaaagtctggcctgcagcttacaaactagagcaaacaacttagacacatggaaaagtagaatttaacatctcccgatttccactctccatttatttccaaaccttccatctaaatcggaagaaaaaaaaaatgccctctagtcacacataggccacactaaagtattagccactaaaataaaagatgaggaagcaattttaaatgcagtcaccacaaatgtgttttgggaactttcaccttgtctctcataaactagaaagtgtacttcatgttccttttggtttcgaatgagcaaggcatttcaactattaacatttcatttccaccacgtgtctgtttcagagctagcagctggcctatttattttgctagctggtgatagaattaaatacagagtctttgaaaacatttacaagctttccctctaaccttctgtgtactttccaaattaggctactttgattgttattagctaaaggtttacgtactggaatactaacactgttaccttcagagtaaattgtttatagctcaggtgcagtttagaacattttcctccatggaatactcttgagattgaggagaagaaagttgaactggttcactctggatcaacaagtttcctttgtgagtcaaacaatattaaggccacacagatatggatgcagtcagggaaaccagttgtgaaaatagttctagtcctctacaaaaccacaggcttcctttgtgagctcccaaatgctttataatctcaaaatcaccatcgtcataatgcactcctaagatttattctttgacactagcgttttgatgtggaagacaaggcatacgcctggaccccaggccagtgtgggttcaaatcacgtctccttcacttatgatgagctagacggtcttaaccaaataacccaagtctttagtttcaaaatcagcaaaacggaaatagtaatttccacttcatagctttgtcgtgagcacttgcattgcacagatgctcaattagtggtttgggatgaaatcaaagatccttcatcactataagcttttctcaatctcttcggcccacaatatcactcatgaaaagcatccattcattctttcattcagtcaaaaactacctattggccctactggagataagaagttcctcctccatagattgtgatgatggtttcatggatgtacacctatctccaaactcatcatgttgtaggcattaaatattaccattttttgtatgtgggggaaaaaagaatgggaaaaaatgtggccccttctcttaaggaatacacagagtacttcagggggtcacagatattaaaacgggggaagggagggtgggaatccaaaagagtgaaaactctagctgctccacagagtattgtgaggacccagagaaatgggccaactcttcctaggaaagtgaggaagagtttaatggggaagatgatatttgaactacggttgtgtgtgtcttttaggtaagaaagatgctcttcttgagcatcataagcaaggagaacagcacagaagaaggtaaggagtggtgagatggattgctgtagtcagtgcagctacagaagagatgatgctgcctagggggtaaaacgggctttagtatgtcaggatcttttttttttgagacggaggctcactctatcgcctaggctggagtgcactggcgcaatctcggctcactgcaacctccgcctcccaggttcaagcaattctcctgcctcagcctcctgagtagctgggattacagacaggtgctaccatgcccggctaattttttgtatttttagtacagacagggtttcaccatattagccaggagggtctcgatctctggacctcgtgatccgccggcctcagcctcccaaagtgctgggattacaggcgtgagccactgcgcccagccagtatgtcaggatcttaaagttgctatttcatcctcaatgtgacaagaagccactagaggattttagcatgaaaacaacacaatcagatttgtttttaagaaactaattgcgttagcagaggggaagacagagtggaacactaaaggacttgtggcaggaaacccagctaggtatagccatagttccaaggcagagaagacagggtctgggatcaaagcaaattaaggcagcagaggtgggaagaaaaatgtgagagacagtttcagaggtgaaatcaactgaattcagtgactggctgcagatgtctaactgatatagggcaggcaggcttagcctgggagggttcttggcttcacccaggaaagaattcaagggtgagccagaggtgagcggcagtgtgcagcagaggtactgttccttgtagagcagggctaactcataggcagtgtgtccagagcagcagcatatgggctgttggctagctgtatttatatctacttttagttgcatgcaaatgaagaggtgggttatttagaccttttagaaaaggggtggggcatttctagatgcatagaagataactttcaggtcattcccatggcatgttgccacggcatttgtaaactgccatggcactgctgggagtgcctttatgttaatgagcagtgagggcaactggaggtcactttcatcaccatttgctggtttcagctggcttcttcactgcacgccctgttttgaccacatctttctccaatcagtgggttgtgactggtgctcagaaaacaagtcctgctgatctcctacctcataaccttgaaaataagttggagggtgacactaataaccaagataaagaacaaaaggaatggaacaggtttgtggggaaagatactgagccgtgttttagacatgttgcatttgaaggaccgttcaggtgaagatgctgagtaaagttggaaatatggatctaggaatgtagaaaagtacagattgaaacgttaacatctaaaaaaggctagagcacaggagattaggataagcattagccattatgaacaggagaggaccccaataagagcatgcagagtgagagagacccaaagacagaaccctgaagagtccaggattcaagtgatgttcacccatatacgtcagtttctgcttaacgatatgcatgctgactttcatcgttacttatctggattgtgaaaacatgccctgtttccccagacaaattaaaaacataaggctttatacccactgcttaaagagcacctagaaccataataggtaaatagaagatatatgtggaattgaaatagaggaaacttacatggagtagaagaaaacgagcgttcgattaaagagggcctttagtaacagcctaaggaattttaacttcatcctttagataataagaaaacaaccagagttttttgagcatcaaatcgtgtcacaagaacagtattttcaaaggtttaagtatatgaggtaacatatatgttaactatctccatttattcattctacaatgtatatatatttcaaacaatatattttacctaataataatttttgtcaatttaaaaaattttaaaaacaaaagagtggtatatggagggatgagagaaaaacagactctgcagggaaggaatccgttacagtctgactgtgggaatcaagccactggttctcaggcaagctacagccaaaagggatataatccatctagctaaatgaatgaaacaacatacgtgggtcctgaaatgtttttcttaaaatgtaccccaccttggctgggcgccgtggctcacgaggtcaggtgatcgagaccatcctgactaacacggtgaaaccccgtctctactaaaaatacaaaaaaaaaaaaaatagctgggagtggtgacgggcgcctgtagtcccagctacttggggggctgaggcaggagaatggcatgaacccgggaggcggagcttgcagtgagttgagatcgtgccactgcgctccagcttgggcgcaacagagcaagcctccatcgcaaaaaaaaaaaaaaagtaccctacctttgacttgccaaaagagagataaccataataaacccaaagactccatgaaaggcaagtcagaagtgggcacgtagaatggggaaagtacactagggtctctgggcatctaaaatgattctgattttgaaaaatatcaatacacaaaaatactggtgagggtaagatggccaacacgcttcggacagatcacagacactttgacctacttgggttttaatcattcaggataacaattacgaccacgatcaacataacatggtggatgatgaagagctggctgaaaacatctgaaagagctggctgaaaacatctgaaagagctgaaagatgtttggcctgtatcaatgtggcccagctctgggatgtagggatctaggcagatttacaaaataaaaagcagcattgtttgtctgctgcctcccaccatctgttcttgccccaggttagtggaatgaaacaaactctctgggcaagatattgactcacatttttcaaacgctgactcctggtttggatacagagctgaggtcagaattcttaggtccttttccagccaagctgattttaggacaggcaagcaatcacaaaatactcttctgtgcaataaatatgaaaatacttaacctccttagggtattatgaagcataaatcatgcctttaaaagcctgtgacaagctgaaatgaaaagcgttcaaagtggagaaatacaatgaaaccacgactataagcactcactgaattttgagcagacagttgtactattaatttaatgaggtttatggttttaaaagtattcatcaatagcaaatatcgcgttgcttaaatattccattactcgatcatctgtctaaatgcgctctggtctccaacattgattggcttgctcaaaatggctagtttctttctctcttttctttccccaccaaaagtactgcttaaaggagccattaacaagaggattcactcgtcagggctacaatgacttgcagctggaagatccacctacaaatatacatccattcataaggctgatacaacagctttcagggaggggatgtgcatgaaatggacacaagcgaagagtaacaatggcagggattatcttttaactggctcatgagtgaaaaaatgaaattgcagacgtctgacaactgtagctttttcagtcagtacaaattaaattataaacctacagctacacatttactctttatgagttgatttcatgttaggcctcaatagttacttattcctggtacaaacgtaaaccagcagttgtgccatttaagagattagttcaattaatactgtccctgctaggctaggccttatatctataagcaattcagtgtctggcttgctaattcatactctcactttgccttttctttgtcagtcaaagaaattaagctggagatctcaccaggccggccactttcccagtctcttagacgcctctgtttgcggccattgcagtgattccatgatgaatttcaatcattagaaagttcttcctaaggtaaaaagcagagctggaatcaactggtacttattctggcctttgaaataaggtataaaaagcccatttctcgctgggtgcggtgggctcatgcctgtaatcccagtactttgggaggccgaggtgggcagatcacgaggtcaggagtttgagaccagcctggccaacatggtgaaaccccaactctaaaaatacaaaaaattagccaggcatggtggcacacacctgttgtcccagctactcagaaggctgaggcagaagaattgcttgaacccgggaggcggaggttgcagtgagccgagattgtgccactgtactccagcctgggtgagagtgagactccatctcaaaaaaaaaaaaaaaaaaaggccatttctactgtaaaacatttgatcatctctcctctacaacacactacccccctcccccacccacctcttaaatatcgtataaatgcaagtgtgcgccaaggaccagcaactctggcatcgtctgagagctggtcagaagtgctgactctcaggtcccaccttggccctcctgaaccagtatctgtcttttaacaagatccccaggtaattcattggcacactaaggtttgggaaacacggctttagaccagtggttggtaaacattttctgcaatgggccaggtggtaaatattttaggttttgtaggccatacgtctctgttgcaactactcaaaactgctgttgcggtgcaaaagcaaccatacataacacacagtcaaacagccgggcgtggtggctcacgtctgtaatcccagcactttgggaggccgaggcaggtggatcacaaggtcaggagatcgagaccatcctggctaacacggtgaaacccccgtctctattaaaaatacaaaaaattagccgggcggtggtggtggcgcctgtagtcccagctactcaggaggctgaggcaggagaacagcatgaacccgggaggcggagcttgcagtgagctgagatcacgccactgcactccagcctaggtgacagagcgagactccatctcaaaaaaacaaaaaacaacaacaaaaaaaaccatagtcaaacaaacatggctggtttttgtttgttttgcttttacaaaaagttttatggacactaaggtttggatttcatataattttcatgtgtcacaaaatagcttttgattttttttcaaccatttaaaaatataaatgccattcttggctcatgacctgtacaaaaacgggataaaccatagcttgctgatcctagctctatactctggcacttcacatgatatcatttgctggtttcacctgggcctggtcccaattctagataaggtattccagttcattaatgcagcatgcataactgaatcaaacaaaacagatgaatttttaacagtactgagcagagcaagaccattatttctcatgatttgaacatagcatttgttttggtgaagaccaatgcctaacaaaacacttattttaatgtagcagcatacaatgtggctggacatttgtaaacaattaaaaaattgatatcagtttgcaaaatttacttatatcttcaatagtcatatcttctccacactataataactaattgttatgatcactactgtacttactgccatataattttttttttttttttgcggtggtgtgatcttggctcactgcaacctctgcctcccaggttcaagtgattctcctgcctcagcctcccgagcagctgggactacaggtgcgtgccaccatgcccagctaatttttgtctttttagtagagatggggtttcaccatgttggccaggatggtctcaatctgctgaccttgtgatctgcctgcctcggcctctcaaagtgctgggattacaggcgtgagtgagccactgcacctggccaaattttgcaattttttaatcaggaaagcaccatcaatactgcttcctggtggggtgaggaggaagtctggagctggaacacattcccacacattaccattttttccttttcaattctcaccccaaaagtacccccggcatatagggaaaataaaaagacgcatggcaaagggtattctgcaattaagttcctctccacatgggattgttcaaaccttggtcaggatggacaggggaaatttgcagcctaaatatagtggtggcataaagtaggtcatttccagaaccatggaaaataccactgggaaaagggcaaaaggaaggaagtcataaagaagagttgacaattatttctataatggtttccaatctggatactcccttacagcctatttaagaaacatggaatcggatgatttgaaacatatttcctaactctaaaatttggagatttgttattagtaccattacctacctagttatatgtgctcaaaggctgggaatcctctctgattcatcccttccacttggatttcccttcagatccatcccccaaacctgccgattcctcctttataatccctctcaaatgtgtcccctgcttttcattctcattgtcaccatcttagttaacacttcacccccaatttactgcagttatctccattggtcaatgacgtccatgatgtttcacattattgcccaatacaatcatagtgaatcaatgatttttttttttttttttgagacggagtctcgctctgtcacccagggtggagtgcagtggtgcgatctcggctcactgcaacctccgcctcctgggttcaagcgattctcccacctcagcctcctgagtagctgggattgcaggcgtggaccaccacgctcagctaatttttgtatttttagtagagacagggttttgccatgttggccaggctggtctcaaactcctgacctaaggtgatccacccgcctcggcctcccaaagtgctgggattacaggcgtgagccaccgcatccagcctgatttttttttaaaccacagttactgtcattttgaacagtcttcagtaatttcccaacacttgaaatgccggctccatatcctacaagcatttcagtttccccaaagctatcacccactcctccttcgcttcaccatggctggcctcctctccatctccagctcccaggggttgactccactcctgtgcctcatcctttctcacatgcttccttcatcacctccaaactggagttaacatttcaaactcaggccaaatgagaggcgtgaagatgtactcaaataattactaatcctgagtatgaaggggcaaatgctaagatgaatacaacataatgcaaaaagattaaaatgagacaggacctttagaaatttagtcaaatacggctgggcacggtggctcacacctgtaatcccagcactttgggaggccaaggcgggcggatcacgaggttgggagatcaaaaccatcctggccaacatgatgaaaccctgtctctactaaaaatacaaaaattagccgtgtgtggtggcatgcacctgtagtcccagctacttgggaggctgaggctggagaatcacttgaacccaggaggcagaggtggcagtgagccgatgttgcaccactgcactccaacctggcacagagcgagactccatctaaaaaaaaaaaaaaaagaaactgagtcaaatatccttatatcctttgaccttgttaatcacactcctgatcgtcctcattcttttctgactgctacttcacaacacccttcctgtaaataatggggctccccaaggcgctgccctaagacgctgagctcttctccatctatgctcagcaccatggcttttttttttttttttttttttgagacggagtctcgctctgtgccaaggctggagtgcagtggcgcgatctcagctcacggcaagctccgcctcccgggttcacaccattctcctgcctcagcctcccaagtagctgggactacaggcgcccaccaccacgcccggctaattttttgtatttttagtagagacggggtttcaccgtgttagccaggatggtctcaatctcctgacctcgtgatccgcccacctcggcctcccaaagtgctgggattacataccgcgcctggcaccatggctttgattaccatccacaggctgactctcagatctaaaattccagtttataggtctcccctgagctccagattcaaaagcagcatactatttctgacacacctaagctgagagcaccccacgtgtcttcgaactcagtgtcttctcactttaccgccacacacgtttttcttcctgtgtgccctatggcagtcaaggccattgtcatctatgcagctgcctgaggcagaacccaatcaatcactggtcctactacttttaaaacctcccctccatccatccacttctctccctatcttctcatcctaaccactccagtctaggccaacatcatgtcatgactgaactacttcaagccacctcctgactggtttccctgtctaccatcccaaccccgctcctatccatcatctacattactcccaagccatagtttctttcttttaagatggagtctcactctgtcacccaggctggagtgcagtgttgcagtctcagtgatctcagctcaccgcaacctccgcctcctgggttccagtgattctcctgcctcagcctctcaagtagctgggattataggcatgtgccaccacgcctggctaattttttgtattttttgtagagacggggtttcaccatgttggccaggctggtctcaaactcctgacctcatgggatttgcccaactcgacctcccaaagcgctgggattacaggaacaagccactgtgcccggcctgtatcttctttattgaaactttagtggtcaccttggagcaaaagaagtgaatagtggaggtcccaaattacagcactgaggggcaagcattgtctccaggtggtatagatgagtagcagtggtgtggtatattattagcagccagactcctaagaacgtgtgagatatcctcttgggactcattaaaacatttagagaggggagtcagtcaggtatggatgataatgttaatatggcctcagaggcatcaacgtaatgcatttatagtcaaaagctgatgaaatgtggagacattctggttatagattgaactaagataatctcatagataaaggggctacagggtgctatggagagttgctcagatgtttggaagatactagtcatcatggcagttaacatcaaagaagataatcatgcccttctgtaatgtgtcctccttgcaggttaccttcaaacacaggcttgggaatgtggaggatcatatatccaaaagggcaaccaccactattcttaggagttgctaatcttcacgtttggagctgaatgattaaatcaactactgaaagcagccatagggccttcaactcttttctctttcccagaacagaactagagtcactcattcattaagcatctacaatgtacctactatatgtaagggagagcacaaagatagaccacacacagtccgcatccccaaggaaatttaaattaagcaatgtgggacagtctgttgcgagttcatgtggtatgatattggagggtaccactaagctcacctaataactgcttcttaacaaagaaatcccttctagggctcccccgagccacagagccattccccttgagccatagagccacacagagccactcccttgagccacagaaccacagtcattgtccaactgtgcaataatctgaggccaaggtaatttccaaccctccttttccagagttctcttcttcctaactcatttatattatttctactggctcctctgtgggtctggaacccctactcttctctaaggagaaatgaggaaccccacctaccataggtgcaaaacattccaatgttcctttgtatttctctactaaatgacaactaaacagaagctgtttgtctggtgggctgacatgatcacaggcaaggcggaccatcagctcttattaccaaatacccaatatacacccttcctttttggcccttcctcaaagttttccactttgcctggcccttttcatgaataacttcctgtgtcatcatgtgacacgacgaatgatttctgtcatcgtgttcattcatacctatccagaacataccatagcactgtatcatacctagtttgacacaaagacctccctcacacttctatttcctgtccaccagtcctcatcccattctttattcacacacactttcgcacattcttctctctttctctctctctctcctttatagagacagagtcttgctatgttgtcccaggctggtctcaaactcctgcctcgagcggtcctcccactttggcctcccaaagcattgggattacaggcatgagccacccctccctgtctgttcttctcttaattacttcttcagctctaacaacgcaaagcgcatctgctagcccttggtttctggattatcctgcccctctctgccctagtgaatcttaagaaagttcacaatcagtacgacaaatcatgtgtgtcctgactagcgctgatttggtggaattatttccagtttagatctggtccttccttaattaataataataaacctcagttaaagttgtgtagcattttccatagcagtaacacaatgttaatttcatcttgagcttggagaagtcagctaaagtcctaaacctcaagatctttttatatataagggagaagtctccagagatggtgcatccatgagcacatcatctttactaaagaaaagcaaaatatatttatcttctatgtatgcacacaaacatgtattttttcttcctttttttagtgcaacttcctgacctctgaaaacaatttctttaggatactggctgtaaatatttgcacggattgttcaatagctggttgtgcaaagggagacaggctttttgtctttaccccggaaaagaattgaaacagactctttctttcaaaagttggcagagatatgttacagaggggtccagctcatttgtagaagcaaacatgttgccgtctaacacagattgatcaccagctgggaagcaagtcattccaccgtaggttcacaataacactggctctctgctgagctgctgaccactggtgacagattgatgtgtagttcgagtggagaagctagctaaagagaacttagggaagctgagcaggttgcaagtgtattattcatgcactctctgcccagaaaaataaagttccccacctttctgacctaagtttggagaaccgttagggactgagtttgctttgtgactttgaaggctgcttacagctttccagagcaacataaaaaatgaatacctattggcactccaatgaaatgccaaaatccacaaagagaacgaccaaggaacatttcttttttccttttcccactgcgagtgagaaagaagagacatgatatttcatgtcactgctaaagagtttgtttggtaaaaaacaaatgaaaaggtacagcttgttaacaccactcagaggtagacagtccagggtctcagaaagaagaatggcatgcccctgggtttcttttagaatgcgaagagtggtggccggggagggggggatggtgggggagggggttggggggtgggggtgagggctcacggaatgaagagctttaaaacaccacgcaagcggggaaggcatatttacttaagaaaactggtacctaagttgtaaatcggaataacagatcaagcaggtaccgtgttttataagtttgagtcattaaattttccaagattctgcatgcttttcaaaccataaaagacccacttccaaactattacccactttttaaaccatgaagatacattaagcacactactttttcaatagcagtttttttgcacatcttttctatcatctttccttaaagaatatacatttttttctttttttctctttttttttttttttgagacagagtcttgctctgtctcccaggctggagtgcagtggtgtgatctcagctcactgcaagctctgcctcccgggttcacgccattcccgactcggcctcccgagtagctgggactacaggcgcctgccaccacgcccggctgatttttttgtatttttagtagagacggggtttcaccatgttagccaggatggtctcgatctcctggccttgtgatctgccctcctcagcctcccaaagtgctgggattacaggcgtgagccactgtgcgtggcctccttaaaaaatattttaaacaaagacatttagcacaagaaaacagaataattacatgggggccagggactattttattcaccatggtgtcactaaagcctagaagaatgcctggcacatagtagatcctcactaaatatttgctgactgactattcattggaagccaacttagcaacactgtgctttattattctagctcagatttaatgataaaatttcatgagcattttcccacaactttcgaaaattattttaatgaagaaatacaaacataactgcaccatttctgctattaccaccacgtccacagttgaaactattagtgtgaagtgaaagctgaatataaagaagaaatttagcccaggggattaatttcttcaaggctggtgaggaggaggaagcaaactactgttttccttttcacgggagtgctacacgggttactatccacaaagatagaaaggaataaataagtagtagttaatgatgaggagaagcaacagtttttttggcagtagtacaaagccaggaaatatagcagtttccagagagttgcatgtgcttttcagtgaaaaggtttgagatagcacttcctaatgaaatgccaaaatccacaccaagaatgactgagtagcagtttttttccgttttcccactgagagtgagacagaagatccgtgatgtttcatgtcactgccaaaacagtttgttttgtaacaatgtatgaagagagacagcttattatgccacctgtattgcactatttgttagtattttaataggtaattaatcttgatttgataggatttaagatttctattttttggcacatatgctcaagctattatgttataaatctcaaacatttcagcaaatgtcatcctgattgttccctactgcatagaatacgatcagtgaaatattcaaggtcaagaacttggattctttacccaccgtattcaggaaaaccaatttattgttctgtctcagtaaagaggggtgatttctttggggcctatattatattggcagtcaatctagaaaacttataattacttttaagcaatggaggtttggtaagtgcgttaatctgttcctgaatttaaacacataccctttagctattactatgacaaaacttcagagttcaacattttaaattacaagaatgaagtgtgtgcacaatacgttagaatggtgcacaagagtttttaatataaaatcaagaacatgtctttgcatttgcctggggataaaatcttaggaagattttgaggagttgttcttttgttttttcttttttgagacagagtcttgctctgttgcccaggctgcagtgcagtgacgcaatctcagctcactgcaacctcggcctcccgagttcaagcaattcttctgcttcagccgccccagtagctgggattacaggcacctgccaccatacccagctaatttctgtatttttagtagagatggggtttcatcatgatggccaggctggtctcgaactcctgacctcaagtgatccaccagcctcagtctcccaaagtgctgggattacaggcgtgagccaccacacccggccttgagaagtttttaaagcaatcttcataccaaatggtcctggtttggcaaattaatgttctcatcaatttattggaataaaaaaattgaatgatgtttggcattaaaccaaatcattacagatcatttcaactgaactaagtttatgcattttctaaaatataagaatatggttggccaggtgcggtggcttaagcctgtaatcccagcactttgggaggccgaggcaggcagatcacgaggtcaggagttcaagaccagcttggccagcatcatcaaactgtctctactaaaaatacaaaaattagctgggcatggcggtgtgcgcctgtagtcccagctacttggaaggctgagacaggagaactgtttgaacccaggaggcagaggttgcagtgagccgagattgtgccattgcactccagcctgggcaacagaatgagactccatctcaaaaaaaaaaaaaaagtttgatcctcattattcatggattgcatatttatgaatttgcctacttgctaaaacttatttgtaacccccaagacaatatttgaggaactttcagagtcattcgtgaacatgcacagagaggcaaaaagtctgagtcgcccaacccgcacactcctaactgaggctgagcaaggcaacgccctgccttctcgtttcagctccacatactgcaaacaagtgtcctttcggcggtgtgtttagtctttcacatttctgttgttgcttgttgtgattctgccgtttaaaatggccccaagtgtactgctaaagtgccgtttggcgttcctaagcacaagaaggctgcaatgtgcgttacggagaaaatacatgtattcggtaagtttcattcaagctgttgcccaggagttcaatgttaacccactatctatctatacctatctatgtatataaaataatatgtccttaacagaaacacttagaagcagggtttcattaattggttgatgaaaatgctatgagcttgagggaccctaacgctgtatttcccctaagaacagtggttcagtatgcactaacttggtgttcacggtgactttacagaacatgagcgccacaaatgaatgaggactgactctaattattttcagaaatgaccttaatacaaaatttttgcttctcagagaaagacagatgtttttgcttttgaaaggtaagggtcagttctctacattattaaaaaaatatatattactgcaatcttttttaaaaagatacatagattaaaaaaatttctaaaatgacaataccaagtgctgacaagaataaggtgcaactgaaactctcatacaccactgatggaaatgcaaataatccagccaccttagaaacagttgatcagtttcttagaaaactaaacatatgcttatacaaaccagcaatcctactcctaggcaggattacccaagagaaataaaaacaattgttcacacaaaaatccaaacatacccatctgtagtggctttagtcaaaactgccacaaactgaaaacaactcaatgtccttccactggtaaataaacaaacaaattgccgggtgcggtggctcacacctataatcccagcactttgggaggccaaggcgagcggatcacgaggtcaggagatcgagaccaccctggcttacacggcgaaaccccgtctccactaaaaatacaaaaaattagccggacatggcggcgggcgcctgtagtcccagctactcgggcggctgaggcaggagaatggcgtgaaccccgggggacggagcctgcagtgagccgagatggagccactgcactccagcctgggcgacagagcgagactccgtctcaaaaataaataaacaaacaaacaaattgtggtacagctagacaataagctattccaccacaataaaaaggcacaaactacggatgtatgcaacaatgtgaataaatcttaaatgcattatgcttagtgaaagcagccagatacaaaaagctacaaacttcacaattctatttatattccattttggaaaaggcaaaacttgagggacagcaaacaaatcagtgatgcccaggggctgggagtgagaagagggtctacctgtaaaggggttgaatgagccaagcacaggtggcacacacctgtagtcccagtaacttgggaggctgaggctggagaatctcttgagcccaggagtttgaggccagcctgggaaacatagtgaggccccgtctcaaaaattaattaaaaaataaataaaggagaatgaaagaacctttgaaggtgatggacttgttttatatctcaagtatatatatcaaaactcattaaattgttcataaaaaaaagatgaaatttgctacatgtaactttttttttgagatggagtctcgctctgtcatccaggctagagtgcagtggtgcgatcttggcttacagcaacctctgcctcccaggctcaagtgattctgcctcagcctccctagtagctgggaaaacaggtatgcgccaccacgcccggctaatttttgtatttttagtagagatggggtttcaccatgttggccaggctggtctcaaactcctgacctcaagtaatctgcccgcctcggcctcccaaagtgctgggattacaggtgtgagccaccacgcctgaccttacatgtaaatttaactaaataaacctcacactaaaaaaggtagtaaaaaataataatgctgtaatgatagacattccttcaaattctccaagacccatatatacggatgtgtgtgtgttagagatagaatctccctatcttactcagactagcctcaaacgatcctccagcctcagcctccctagtagctgcgaagcatgcagctgcgcctgacttcctctaatttttaccgatgttcataggcacatttttatctagctataatataaattgatgatttgttttattttataaaaatctaattaattctgccattctagcaaagaccagcatgataatctggcaaggtaggactcattgatcaatttcaagtcagcacttttctccccattcacacagcagtatttcttaagaaggaattttatttctcggtggtattctcagtattttgtagacatacctgctcttaaccagcaatgcaggaagtccaaatgacatcctgaaacaaggcctcttttgcagccttcctccataagaggtcctgcctttttgtccagtaacacaaaaaagatttgccaagcatggactgtgttctgggccctgcgctcagtaccaggaacacaaaaatgaataagacagccttacttatatcacttcctcactctatcttaaagcaatggtgcttacacaaacttaagccctcaaatcttctggcatatatgttaaaattatctcctttgtttataccgtccctcccttccagcatttatcttgggaattattcactttttccagatctaatccacaccataatcccattaacaacttcttcaagctagacttggagtggtcagaacttgattccacatatatgtatctctctgtggagaaaaaacaggatcccataagtcaatgccatttcgtctcatctttccatgtcacactttgttactaagtgtgtgatctacggcgacagacatctcagttcgagaacttacacaaggcatcatctccacgtttaatgtaactttccaaagtaagcactaattccctttggaaaccatagtttttaaaatttttctaaataaaatggtacctctgatgtagctatgacccctgctagggttcgtggtgtctaatgaagtgaaaatattatatactttgcattcagtaaaagttcctattccaagagatataatttaactcctatgatatatatgtccaaattatttttataactttataaataaacccatctctaagttctcctttcaataaaaaatgaatatttaaagaaaaatagaaaaatacccaagttgctagatttttccaaaaatgattatttttgaatacttcataaacaaatgtgcaatttaaatatattcatatatacacaaaaatatacatatatacagagagagagagagagagagatggacaccatgaattcttagaaaacggaacaaaagtttcactgcttagaaaatttgagtttgatattttgcttcctctttcttatttggtttaatttgagctgcatctgatttatgtttttctcttaatccaattaaattaccttgatggtttcagttaaaacatggaaggatttattgcaatctctcttaatataaagtgcatgaattgtcctactggagtcaaataataatgtgtaactatgacatacattccaatgacaatttcaccattatgacctgagatatgactcaaactctagttacttagtaactataacttaatttagtaacttctttgacttttttttttctgatcatgttttcaccctggacactccaagtacctgacagcttcttggtggagcccatctcttatctaaaaatacctgaaacaattagctttattttccctgctttcaaacacaagagcacttatgagaaagaaaattgacatcggagaaaggtgggatgagagaaaaatctcttctatctttaatgaaattagttaccaaaaatagaaaaaaaaaaatctttgctcaactagaagttaaatgtgtgtttctatttccgaacactagttcttactcaactatgatacagcctgtgagaaggaattagtcctctacaacacactgccactctgaaaggttcaggtaggtggtaggaagtgcccagctttgggatggtgctgaacccgatgccgcagaagccaaatgaacacttggggcaaatggtcccccagcctggcagtagctttggctctcggtgtgacaaagcagaacagctaggggttctcaggtgtaggcgagcacctgaaacccttgaaaggttgtcacatgacgggtgttctcaatgtataaacttctacactgccttggttgttgatgattttaagattaaaaatctacttgggaagttggataacaaagtatcccagtaggatggcccttgtttttttttctttttagacagagtctcgctctgttgccaggctgcagtgctatagtgcagtggcgtgatctcggctcactgcaaccctgcctcccgggttcaagctattctcttgcctcaacctccccagtagctgggattacaggtgcccaccaccacgcccagctaatttttgtatttttagtagagacggggtttcatcatgttggccaagctggtcttgaactcctgacctcaactgatctgcccgcctcggcctcccaaagtgctgggattacaggcgtgagccaccgcgcctggccaggatgggccttcttttagatgtttctcatctttagtactcagtatggctagaaaatggtgtggggatccgaaaggttaatttcctatgactagaaactcactgaccctggttcatagggtaggttcatccaatccactgtaagcctccaggaaaatcaaggaagatcattatgaatcagctcagctgctactgtgatagtaatctcaccatcattatgtttaccccatggagaaaacactattgtaattaacaccaatttataatctaattgtgggacagatggtgaaggatacctaccatattcagatctgaattagacaggaaggtatgaactgtatacaaccttcaagagcactttatacctcctgtcactactcatctttttttttttttttttttttttgagatggggtctcactctgttgcccaggctggagtgcagtggtgtgatctcggctcactgcaacctctgcctcccgggttcaagcgattctcctgcctcagcctcccgagtagctgggatcacaggcatgtgccaccatgcccagctaatttttgtatttttagtagaggcagggtttcaccatgttggccaggctggtctcaaactcctgacctcaggtgatccacccacctcagcctctaaaagtgctgggattacaggtgtgagccaccgtacctggctacttgtctttcttatggaggatttttaataactatgtgttgagttaataaataaattgtgccatgagtctcttgctctcctaaggggacttatgggtaagagtctgtaaaagtcaccagtctggatggggaagcatggatggcaattgaagaagagggaaggcgaggctctgggaaaccgctctcacatggcttcagacactggtgcaaaggaagcgtttataagaaactatgtcataaagttaaagtggaatgactatattctaaatatgttttctacattatatatacatcattaaataaattgaatatcatatttgattatttcagctatagtcctaaaagtatacacagtagtccccgcttgtcctcagggatacattctaaggtccccagtggatgcctgaaacctcagatagtaccaaaccctttctcaatctgataaccaagagggctaccaaatgactcgtaggccgggagcacgtatggcatggagatgctggacacagggatgattcgtgtcccaggtggaacagagcaggatggcatgagatttcatcatgctacttagaacagggcataatttaaaacttatgggccgggctggccgggcgcggtggctcacgcctgtaatcccagcactctgggaggccgaggcgggcagatcacgaggtcaggagatcgagaccatcctggctaacacagtgaaaccccatctctactaaaaaaatacaaaaaattagccaggcctggtggcaggcgcctatagtcccagctactcgggaggctgaggcaggagaatggcgcaaacccgggaggcggagcttgcagtgagccaagatcgcgccactgcactccagcctgggcgacagagcgagactgtctcaaaaaaaaaaaaacaaaaaaacttatgaattgtttttcctgctattttccatttaatatattgggactgcagcagaccatgggtaactgaaaccacagaaagcgaaaccacatataagggggaactattgatttgggaaagaaactgttctagggggcagaggatggatcatcctctttggagacaaaaaaaattatcttacactcaggaatatattcaggtacaatgtttttacaacagtagattaaacagtttaaagtgggcacagtggctcatgcctgtaatcccagcgctttggaaggtcaaggcgggagcatcacttgaggtcaggagtttgagaccagcctgggcaagacagcaaaaccccgtctctacaaaaaattaaaaaattagccaggtgtggtggtgtgcacttgtagtcccaactacttggaaggctcaggtgggaggattgcttgaggttgcagtaagccatgatgacaccattgcactccagcctgggtgacagagcaagaccctgtctcttaaaaaacaaaacaaggctgggtgcggtggctcacgcctgtaatcctagcaatttgggaggccgaggtgggcggatcatgaggtcaggagattgaaaccatcctgcctaacacggtgaaaccccgtctctactaaaaatacaaaaaaattagccaggcatggtggcacgcgcctgtaatcccagctactcgggacactgaggcaggaaaatcgcttgaacccaggaggcggaggttgcagtgagccgagatcacgccactgcactccagcctgggcgacagagcgagactctgtctcaaaaatcaatcaataaataaaaacaaaacaaaataaaagaaaaatagtgaaggctttggtggctacaagaaaaggcacagcaaggaaaatattttggtatcttggtgtaaaaaaaagcacaaatgaaaatattacaatgcaataagaatttttaaaaaactgaataaaaacagtaagattttgactatggtatcaggaagggaagaaaaggagaaacttaaaatatggacaggaatacagacacttcagcaacagtcaatgtcctctgcagacagtacatacaatattattcacaaagtgggctaactctgtaacagtcttccagccaagagtctctgaaaattatttctaaaactttacaacttgctactataagggggaggtacgcaaccaataagtctaattaggattctgaccatttctcatatgcaaaggcatatcaacaaacccatctgcagtgtacagctcatcctcatctgggatctgggggcacaatttactctcccagcacaccctccctccctaacctgacgatccaactgtgtttcacccaggattcagatcctgggaggaatcctaactatcagggctgttaagcttttaaatacgccaccctcagagaaggccctcactagatgggtaggggctgggtgtcatgataagagaattcctattttcccacggaaatgaattactttttaaaaaaacccatttgctggtgaaagggaggagagggaggaagtgaggctaagcaagtgtatttggggggtggcagatgaagcgagtcttgtgggtctcaggacagtctttggaacagaaattacaaaaactaatttgaaacccagaggcagtgaagaaaaggcatggaaaccaaatgaaacaccatttgatctttggcctctctgatctgaaactgggctgggcctccagctgagttcactgaggccactgaacagctgtccggtgataaccactttcatagttgtcagcaacatttgcttcaagccagtaccagggctgttcccactctgtggagatggaaaaagagtctatgtttcccttcatttcttcctctgcttgagccatcctaaattaggaaatcatctggatttgtaaaaataatcacttcttggcatgttcacagaatctgctgaaatgttatttcagaaaagagactctgaatgcctggaggtcactataggaaatgaatctggcaatttgaaagtgcacctgctgaagttctaggccatctcagcattcaaataatttatccatctttccaaacatcttttgtgtcttttatttttaaaaaacaaaaaaaaagttctaagttattacacttactatgaatcggaaaacagccctgcttctttagatgtggattctggggtttttttctcctgcattttttcactattcagcaaacactcatttagagtccgccttagacacagaactctgctaagtacgtatgcatcttgcttaggacagctgtggctgcaagtagcagaaaatgagactcgaactggattaaacatcacagaaatgtgtctctcatggtaagaaatgcagggttgctctagagttggctaatgctgaggttctgcaaagtcatcaagcagccatcattctttccatctcgttactagtttcctactgctgctataaccaattcccacacacctagtgccttaaaacaatacaaagttatcatcttataggtccagaggtcagatgtctgacgtaggtctccgtgggttaaaatcaacgtgtcagaaaggctgtcttcctttctggaggctccaggagaatccatttccttgcctttccagcttctaggggctgcccacactccttggcttgtggccccttctatcttctaagccagcaatgactgctcgagtctctcacatcacatcactctaacactgactctcttgctccctcttccacatttaagaactctggtggttacactgggcccatcagagaatccaaaactctctctccatctcaaggccatacccttccttagcacatctgcaaagtctctggccacgtaaagtaacacatcttcagattacagagcctaggacatggatatctctagtgggggctataattctgcctaccataatctctgtgctcttccagcctcaatgagggctttgccctcaggctggctgttctcatgatcataaggtactaattagagaagtttcagatgccacatccagacatactttgtagaggaataaaaaaggtgagacacctctttctggtctctttctttctaggaagaaaactttagccagaggccctagagcagattttccttcatgtttaattggctgaaacgggttacctgcccattatcaatccaatttttgacaaggagaataggttcactgtgattggcataggataagaatttggaatggatgttggagagtcagccatcatattcactataatgtagcaaataccaagaagggcagaaagttactatttacagaatacttataactaaaggtccagtacttaaaccaatcttgctaagaaaaccaaggctcgtttgaattttactatgtattctagttatggttacctctgcatatactattatatatggaggagtaaatatgctggcttttaattttatttttttgagatggagtctcgctctgtcgtccaggctggagtgcagtggcgccatcttggctcactgcaagctccgcctcctgggctcacgccattctcctgccttaacctcccaagtagctgggactacaggcgaccactgccacgcctggctaattttttgtatttttagtagagatggggtttcaccgtgtcagccaggatggtgtcgatctcctgacttcgtgatccgcccgccttggcctcccaaagtgctgggattacaggcgtgagccaccgtgccctgccaatatgctggctcttaagcacaggagagttgagttgaaatctgttgttttctaccacattcttcaaaaacacatcaaataagtttttaaaataattcaaaagtaatcatgactttgagaagaccaatgcatgacttgctagaaaatatacgagaggttctaacttcgagtttgctctcgtgctcttgttcctcaaagaaatccagcactcccaatgcaatatgaagtatggatcagagaggctgcttagaggactgactgctcttccagatgacagtgtcatatgatgaacgaagctgaagccaaacagcagaggcctgaattatataggcgtatcggccagggtctgatcaggcgacagaaatcactccagttatttaatttttttttttttttttttgagacggagtctcactctgttgcccaggctggagtgcagtggtgcaatctcggctcactgcaagctccacctcccgggttcacgccattctcctgcctcaacctcctgagtagctgggactacaggcgcccaccaccacgcccggctaatgctttttgtattttttagtagagacagggtttcaccgtgttagccaggatggtctcgatctcctgacctagtgatccgcctgccttggcctcccaaagtgctcgaattacaggcgtgagccaccatgcccggcccactccagttattttaacagaaagaatttaaggcagagagagccattaacaagacatagagttgttaactaggtgagagggtaaaaacagaactctaaggtatcatgggagcagaagagataaaagcaagaggtgaaaattattaaaataaagagcctggacgagggcccccatggaagtgaactcgaaattctgaggaggaggaggtgctgctcaggtgacacaagtgtctccagggtacctgaagaggctgattgtgcaagtgttgaaaaacccgtggactgaattcagccagctgctgcctcagggaaagaactgctgctgccagggtgaagaagcgtatcttgtgtaccacagacgggaagctcacaggaagcaaatgggaaatacacatcacttccttgtatggagcctcgctctgtcgtccaggctggagtgcagtggcatgatctcggctcactgcaagctctgtctcccaggttcactccattctcctgctttaacctcccgagtagctgggactacaggcacccaccacgacgtccagctaattttttgtattttcagtagagatggggtttcaccatatcagccaggatggtctccatctcctgaccttgtgatccacctgcctcggcctcccgaagtgctcggattacaggagtgaaccaccacgcctggccaatatgctggctcttaagcacagaagagttgagctgaaatctgttgctttctaccacattcttcaaaaacacatcaaataagtttttttggcatctagaaggatgctgcagctttgcagcatctagaactcgctactggcagagccgaatagagaggcagctggcaagacagaaatgtggcttgcagaggccgagctccagcatcacacaggagggcacagaaggccatgtttggggttgagagacaatggcttcataaagggcacaacaagaaactatcctgtgataccagtagcaaagtctccttcttttgcagttgagtatacatctttgggaatgataaaggagatgaaggggcttcagagtgtatgaaagggttaaaaaaaactttcatagttaggaaatgcttatttagcttctgggaatgcaactgttccctcactccacaatcatatcacaatatttactagtaactcttggatgttactatcactcccattcctttctgggggaaggaggtagataagcacagtcatatttgtattttgaatatctttttaaaaaattactaaattcagccaggtgcagtggctcacgcttgtaagcccagctctttgggagtccgagacaggtggatcacctgaggtcaggaattcaagaccagcttggccaacatggcaaaaccccatctctactaaaagtataaaaattagctgggcctggtggtgggcgcctgtagtcccagctactcaggaggctgaggcaggagaatagcttgaacccgggaggtggaggttgcagtgagccgagatcgtgccactgcactccagcctgggagacaagagtgagactctgtctcaaaaaaaaaaaaaaacaaaacaaaactactaaattcacaacaacaacatatctttatcatgtagaaagacagtaaatatgtatatggtggttaaaagaacatattttgtcatcagactgatctgggttcaaattctggctttgacacttggtagctgtgtgcctttcgccaagttacttagattgcctcagcctcactttccccagctgttacatgggaataataataatactaacttcataaggtggttgggaagattaaattaattaccactataaaacttaacttggtcatcactgcttttttttttttttccctgtgagtctcaacagcctaggaaagaaaaatgtttccaacccctgctttggggaaaaatatttatagcctttccacagtattcttacctctgtgacagcactgagctcaacgtataagtttttaaataataatattcccaagtgagagttccttacaaccagaactgtatatttttcaccatgtacacagctcctgaaaaaatggttatcttccttgacagatccagacagtgaaccaatccaaaacacaagcagatacacagaaccccacagcgggaggggatggaggcaatccaggaggtcaacatggagaggagtggtttccagtggagggtaggaaggtgagagggtgggcaacagaattacctttttccaagggtgcacaccctccacctaccaccaccctagattctagctcagcttccttagaaaattatgaatacattgttcctttgggtgctagagatagagacagaagccaatataaagtcaagaagagatagtcttgactttctaggaagtgtggattcacagtaagcccaaagggaggctaaactattcaggctcagctgccaggagaaagtgtgaatttgcacagagaaagctggtgcttgtggtgggttagagcagcggtctccagccttttgggcaccagggaccagtttcatggaagacaatttttacatggactagtgggtggggggtgatttcaagatgattcaagcatattacatttatcgcgcactttatttctattattattattataatatataatgaaataattctacaactcaccatcatgtagactcagtgggagccctgagcttgttttcctacatctagatggtcccatctgggggtgatgggagacactgacagatcatcaggcattagattctcataaggagcatgcaacctagatttcccttgtatgtgcagttcacaatagggttcacgctcctatgagaatctaacgctgccgctcatctgacaggaggcggagctcaggcggtaatgcaagcaatggggaggggctataaatacagatgaagcttcagtcagttgcccgccgctcacctcctgctgtgcaacctggttcctagcaggccacgtaccagtactggtccatggccaggagttggggacccctgggttagagaatcaggggaacaaacatgacagtggctggttctatcggaggagaagcacaaataagtctctcactaagtcacacagaggccaagcgcatgagaccttcacctaaggaaacctgaggctgacaagaaaggcagaaaggagcccctggagtgatctaatgaagacaaactcactttgtggctttataagttctaagcaaaccaaggcagagatcatttgtgactaacctgagaagaaaatctcatttcaaccctgagttcttttctctttcaaaaatttccatcaggaggccgggtgcagtggctcacgcttgtaatccaagtactttgggaggccgaggtgggaggatcacttgaaaacaggagtttgagaccagcctggccaacgtggtgaaaccctgtctctactaaaagtacaaaaaattcgctgggcgtggtggcaggtgcctgtaatcccagctactcaggaggctgaggcacaagaattgcttgaacctggaaggtggaggttgcagtgagccgagatcacaccactgcactccagcctgggcaacagagcgaggctctgtctcaacaacgaaataatttccatcaggaaaaaagcatggggaataataaaacatccaatgaaaccctaattataatccttttaataaagtgaaactgtacagggaaggactgcttggggtatgttctggattcctctacactggggcagtatccattgaggaagagtgacagaacgactaaagaaatggactggccaaggggcccgccacacttcccagacaccagaagacagggactcagcatctaggccacagccttataaagtccaaggaataatattcatccaccctggcaggaaaggtaaaaagtaaagcaagagctccctggtcttctaagaagaggggaggggagtctcactgaggaagaatgtaaaagaatcctcatcccagaacacatccctatgcctagctggcctcatggtttacagcttgagcagattcacctctttattagctacgtgatttgaggctggtatttaattctctgagtctcagttttcccatctgtaaaatggtaatgttattaccgctcacagggacactatgagtattaaatacaataatttacgtaaatacaatactttatagtactttcctggaacagagtgagcacccaatacacagtaacaattatgtttgtttcgctatcacagaattactgataataacaggtatccctgcaatctattccattgagactatttttagtattaagttccttcctccaaatcaaaatacttttatttcacccattcaaagtcaaatatttacaggctgggtgcggtggctcacgcctgcactttgggaggctgaggcaggtggatcacttgaggtcaggagttggagaccagccaactcctggttgaacatggtgaaactccgtctctactaaaaatacaaaatttaggccaggcgcaatggctgatgcctgtaatcccagcactttgggaggccgagctgggcggatcacctgaggttgggagtttgagaccagcctgaccaacatggagaaaccccatctctacttaaaaatacaaaattagcagggtgtggtggcgcatgcctgtaatcccaactacttgggaggctgaggcaggagaattgcttgaacccgggaggcagaggttgcggtgagctgagattgcgccattgtactccagcctgggcaacaagagtgaaactccatctcaaaaaaaaaaaaaaaatttagctgggtgtggtggtgtgcacctgtagtcccagctactcaggaggctgaggcaagagaattgcttaaacctgggaggcaggggttgcagtgagccgtgatagggccactgcactccagcctgggtaacagagcaagactgtctcaaaaacaaaaacaaaaataaaagtcaaatatttatcatgagattgaaatattcttctttgagacaattaccatatatgctccacatcttcctaaatctgattcttaaacagcagcagctgaaagaggcaattattgtaaagagcagttgctttagaaagaaacatttttctcaggcacttctataaatagaaaggtgtggtgagggatgtaaattatgatctgcaattgtgatctttcaattatgacatgcaattatcttagaaattcagctacgataccaggcaaatgtttacacctatatcacaaatctgccgctaggtataatccttaaagtctcaaaattagctccatgcattacacagagtaggctgaataaatgattgcttagcaactttagcaaaatagcacaagaagggaagaaaagtactgaaacaggagatccaaccatgatcacgggtctctagtacttaaacactgagatttctgcagggctctatgtgctgaaaaatctcaagtatctcaagagtgtgtcataaatgaagagtgtcagaagtgagcagatcataaatgttcaaaacaagtgtgggagggacctagatgcagggactacatccggaatatacggtgccctctgatgccaatctcattgttttttttttttttttttgtgacggagtctcactctatcgtggaggctggagtgcagtggagcaatctcagctcactacaacctctgcctcctggattcaagaaattctcctgcctcagcctcccgagtagctgggattacaggcacctgccaccaggcctggctaaattttgtattttcagtagagacagggtttcaccatgttggccaggctggtctcgaactcctgacctcatgatctgcccgcctcggcctcccaaagtgctgggatcataggtgtgagccaccatgcccggcctcatcctcttatacacacactttgggtcacacctttgagctttttaggtttcaatgtattctccaccatgaagctattcagaattatccttctcccctaagtcatctaattttccctcctttctcaccaaaaacacttcctcagtaataggcagaggattattacttgaagttgctttttttttttaactgaggaaatgtcaggcatgttattttcagagtgatttaaacagctctagtgttatagctaaacagaaagaacaaagatgctaaaatattaatcatcctgcccagctgcccactgggagtagctgaaaatggcaacgtgctgctgtctcctggcttcatgtctacgttactgcctgtgcagctcacaaacactccctttcctgaacatatggagcaatctcaggaaggaatttgcctcagtgaaccctgactagccaatcaaaaccagacggttccaagttcagtgactaatatcagggatgaattgtgcgtggtgaaaaggaaattttgtgtgccggagaaatgtataccctgagatcagccatatcacaggtgtgcaggatcacctggagaaaatgaacttgagaaaaggcgagttcaaacatttcttcaagcagcacgcctgtcatcacagagtatgaaaaactgaacagcgctatgcggtatcggatcactcgaacaacgacgacaacaatagctgcctttagggaggacttccgggactgaagccagggcagccactgcactgagccctgcatatacgcgatcccatttagtttaatcctcacaaactgtaaggtaggtacaatcacctctggtctacatacaagggatgaggtttgagaagattaagtgaattgctcttccttgcacacctagaaaatggaggaagtgggtatctctgattccaaagcccttgtttttaaccaccatactattttagtattctttttttttttcagatggagtctcgctcttgttgcccaggctggagtgcactggcgcaatctcggctcactgcaacctctgcctcctgggttcaagtgattctcctgcctcagcctcccgagtagcagggattacaggtgcacgccaccacacccggctaatttttttgtatttttaatagagaaggggtttcaccctgttagccaggatggtctcgatctcctgacctcgtgatccgcctgccttggcctcccaaagtgctgggattacaggcttgagccatcacgcccagctattttagtattctttccttctttctcatgccctgatattcataggaaaggtaaaaagcttgtaaattagatggaagaaacattaaaacctaataggtattggctgtgtgggatgccttggaaaacatggtggactgtttccaaagagtggactaaattcattaatcgccctgggagataagtactacttccaagatgaaaggcatttttggctcttgagaaggcccaacatttacacattttaacacaggcatggaaataagcactggagagacatttgctagctcttcagaatccatacaaactgcaaaaactcaggaagagtgctacagatttctagccagtttcatcttaacaggtatagtgatattaaatccccaaattcatttccaatatcaaaagtgacataggcctgtgtccaatatgccctcttctcatcaaacttggcctggcagggttaccaggacagtggtgtggccaggcagctccatgagaacctggggaatctcaattcaaccaaccttcaccaaccacctccgaagcatgaggcattcttatgacaataacaatgcacacttactgagcgtttactatacactaggtggtgtgctaagtcctttacagcctttttttcttttgagatgaagtctggctcttgtcccccaggctggagggcagtggcgcgatcttggctcactgcaacctctacctcccaggttcaagtgattctcctgccttagcctcctgagtagctgggattacaggtgcctgtcaccacgcccggctaatttttgtatttttagtagagatggggttacaccatgttggccaggctggtctcgaactcctgatctcaggtgatccacccgcctcagcttcccaaagtgctgggattataggtgtgagccaccgtgcccggccttttacatgcttttaactcatttgatcctcacaacaaactctgtgaggtgggttcttatttttcctactttataaatgtgataactgaggcgtacagaagttaagtaatttgccaaatcctagaggcttccagagctctctgtcttaatcactaaggctatgctgtagggtctggagggtgaaagcagtacccagcttcaggactgcaacagtgttgcagaggatccagtctcccctgggttaaggaacagaatgaatatccatccactcccctccctgacaacaatgactgcagaaaacaagctaggaagacctctctcttccccttaaggagtgggaagcatgcttggttaattgagagaagagcatcctggagaaaggctcgctttggaaaaggaagaggaaacagggaagaaaagaacaccatgaaggtgaccaaaccatggcttccatgcactcttgcttcaccaaagtgcaggggaaaccctttcccctgaagagggcgttgtgctgcttaatccactctccggagtggctcggggcatggaagagaagcaaggagcaactccaggtggcaggggaccaaggttgcctgctctgaccctcccagttgttccaggcacgtccagggccttttatccagcacagcaactaccatctcccactatttttacaaatgttagtttgaaatggatcttgaagtagtgggagctataggacagattccagttgttttcaaacaagctgtaactgagtaacagtttttaatacagaaggtcctaaaatatacagctgccataataatacacatgtaactctaaaaggcataggagaaaagacacaatattacacattttaaatgtaacacagctatggttagaaatagcgtagaaacaatatagcgaggtttgttttattttgtttttggttttttttgagatggagttttgctcttgtcacccaggctggagtgcagtggcaccatctcggctcactgcaacctctgcctcacgggttcaagcaattctcctgcctcagcctcccaagtagctgggattacaggcgtgcaccaccgcacccggctaatttttgtatttttagtaaacacggggtttcaccatgttggccaggctggtctcaaactcctgacctcaagtgatccagccgcctcgacctcccaaagtgctgggattacaggtgtgagccactgcacccagcaatatagtggttttatctcaaggattaataaacatcttacgaaaatgttaggaatggggtgataacatccagagacttgtattctagttaactcagtccccatccgacccaggtgatttaatactccatacctaacaattttcaaatgcttaaaactggcagatcaatatcccacgtgtggcaggcacagagacgcaccacacagttcctctttcaagcaaggcctttctgcctcagctgctgggagtgctcttggcagacggtcttcaactgccagcctctcaagggcatagagctgccctgcccaaggacccggccttcccagggtgttccccatccaatgactgatcaaggctggggcatataagcccagcaatgtgaattcaacgtgggacaatcctgaaggccatttcggcacccgggcttcccagggggctgtcgtcaaagccagccgctccctctgctaatcctgctgcccagctccctcccacaaatgttgatcccatcagtgctcctcatacgcatcccgcatacaaaagcccctccgaggctgctccccagagaatccaacccgtgcctcaatgcctctatggagaagaaaaagaaattcaattttcaagggaagtggtacaggttaagccagatggttagaaaaattgctttcattgttatcttgggaattttcctcctccaacagatggttaaagctcaacctaggagaaggctgggcagctcagccaaggtggtcatttgcgtggttccaatcagataaaggagcacagaagaactctcagggaggcacactgagctacgtggtcagcctccaatctcctttgagcaaggtgagtgctgtcctgacccactttaaagccagctcattagatatattcccattcaaatctaagtctaagttcatgtctgtctctcatcagtctgtttcatctctctctctcatacacacacacacacacacacatctacccctaaagatgttccatgtctctttctcttcctttccatagaaaactgaggcctgattacagtggtattagtcagttacatgttcataagtgataaaagattaagaagaaataggatcaccttattaatgtacatcccaagtcgttgcttcaaggacaaactctccgtgagcccatcctaaatatatctcccataaacacaaccagttcttcttcctaaagctctctgtccatttctggcaagaaaaaagtaccagagaaaatcctgtttataaaacaaagcaaaacaaaaaatggctactcttgggctctttgattggctgacaaaagaaaatggtaaaatgagtcttcaccttatcgtcacccctagagatggccaagtttggaatgagtttagcaacatgaatcctacacgagctaggagtgaatccagaagcagagaggagggtcactcttggacacaggacctcaaattatcctgttcaaatgacccaagggagtacagaaacaccttggagggtctcctaaattcacctgttcatagatacaaaacgcttatcactgaaacatactctaaaccactagctgttaattcctcaggacataataaattttttttaattgtgcttgtggatttcaaactaaccaaattggttgacagaactgttctacctttgatgtcaattcagttccccaactactgtttgaaatggttaaaataaaaacaacaacaaaaataataaagagtccttatcactgcattcaaaatgctttctcaaagatttcaccctcctggcaggactgtctagatggaaagagaatgtcgtgtctcttcccagaataaaccgttgagaccacattaccttccagttcaagctcctttaaggatttgaaattacttgaaacaactactcagcagcttcagtctctttcttacgctgtctttccctgctcaagcacttggttctaatcagaccacttccttcctgctgctttggtttttattaccaaagttcttcagtccttttcaccaccccatatgctaaacaatttccactttgagaagcacattctcagagaactctgaggataagccaagctcagctaaagatcttcaataatgaatgaaactgtgaagagctacaatttgtcttaagcggctttcaccttctttctgtatctttttccttctaaagagcatgcatctacttttctcaggaattaagcattctcattctttcattgattctccaaacaggaaaagtaacatgataaataagtcatatttggtgtaggcctctatgcagaaaaagctaacacagcaggcctaactgcttttttcttttttctttttttgagacagagtctcactctgtctcccaggctggagtgcagtggcacaatctcggctcactgcaagctccgcctcccaggttcacaccattctcctgcctcagcctcctgagtagctgggactacaggtgcccgccaccatgcctggctaattttttgtattttttttttttagtagagatggggtttcactgtgttagccaggatggtctcaatctcctgacctcgtgatccacctgcctcggcctcccaaagtgctgggattacaggcgtgagccactgcatcctgctttttttttttttttttttttttgacagagtcttactctgtcacctaggctggaatgcagtggcgtgatcttggctcactgcaacctccgcctcccggggcgtgagccaccgcaccctgcttttttttttttttttttttgagacagtctcactctgtcgcctaggctggaatgcagtggcatgatcttggctcactgcaacctccgcctcccgggttcaagcaattctcctgcctcagcttcccgagtagctgggattacaggcgcccgccatcacacccagctaatttttatattttttattagagacagggtttcactatcttggccaggctggtctcgaactcctgacctcatgatccacctacctcggcctcccaaagtgctgggattacaggcatgagccaccgcgcccggccctaactgcttttcttaacaaggcactgctgccaaggttggcccttccctggctggcatcctggagcttggattttgggaaggacccgccattaactggtaagagtggcaatctgtgcctaagctgtatcaatgctctgtttcattaacacctggtttccttctgggagtctgggatgtgggtacatgccagacagggtgcctatgtgaccaagaccctcaaaaaaccccgggcactgagtctctaatgagccttcctggttggtaatatgtcgcacgtgctgtcacaactcatcgttggggtaattctgtgcaccctgtgggattccactgggagaggatgcttggaatcttgcacctggtttccccagcacttcaaccaggagccttttccctttgctgattttgctttgtatccttttgctatgataaatcataatcatgaggataactacagtccattcccgctattcacagtaattatgttccataaagtcaccatgaacactgaattagcaaatactcaactgatgttcctgagggagacatgtacctctatctgtacataccccacacagatcataatattaaatcctaaaaacaactcatcctggtagattccttttttttttttttttcaaaagaaaaaacaaagttctgaagtgttacataacttgcctgaggctgctccactaagaggagccagaggtgggatttaagcctgtctgtctggccccagagccagagtgtccactggtcatccctctctgaggccgaaacaaaaggcagggcatcaccttgttcaacctcggctgggaatgtgcttgtggggtgagtcaaaccttttgccactttatccacgtccatgagtaaatgcgagagtactgctagtattcacttgggggttttaagtacattttagtgggtaggtgagtataagctgaatcctttgagtcctcctagcaaaccactaaacctggaggttgtcttggggacccccaccgtagcctccaaggagagaccaagattccccttcctgcagaggcactgaggaggagaaacagtatgactagggccaaagtggcaagaggtagagcttccagagcaacctgctctttgcatctgtgattactttggctgttcctttgaggttctctttggcctctctttttggcttgcttttttgaagtcccttctccaattcagctgctacagctggatgggcctgtggtagcctccctcttggaggtcaaataggaacagcggtgaatgaagttcaggggaaaggaagccgggtgagtcacccaggccagctgtcccagggcctgaggagagatggccttttccttgacaagtgtttccacagcttttccttggaaaaccctcatccctttctagttagatggcttctcagcctggctgcgtggccagggtcaagaccagtatatgggcctagaagaaaaaagtcagggaggaactagggcagaagcagcaaaaggtccttgtgactcaaagctggccaaacccatcaccagagctaaagctagcagcaaagtcataggacaaacaccatgcatgtgtctcaggatctttttttctttttttttttttgagatggagttttgctcttgtcacccaggctggagtgcggtggcacaatctcagctcactgcaacctctgcctcagcatcctgagtagctgggactacaggtgcccaccaccacacctggctaatttttgtatttttttagtagagacggggtttcaccatgttggccaggctggtctcgaactcctgacctccagtgatctgcccgtcttggcctcccaaagtgctgggattacaggcatgagccaccgtgcccagccatgtctcaggatcttttctgcacagttagcagattcaaagactctggtttccttgctgtaatataataaaaatatagtcatcccttggtatcttgcgggattggttccaggaccaccccttccatatacaaaatccatggatgctcaagtcccatatataaaatggtgtagcatttacatataacctacacacatcctcccgtataactttaagtcatctctagattactcataatccctaatacaatggaaatgctatgtaatagatgttacgctatatggtttagagaatcgtgacaagaaaaaagtctgcacatgttcagtgcagattcaaccatccatttttaaaaaaaaaatttgattctcagttggttggattcatggatgcggaacccacagatacagagggccaagtatacatatgtttggtctttaccccaggttcctggcacagagcttcaaaaacctttggaatttcctgagtgctagacgtgtcttttgttattcatgatgagtctttttggactcctgctaatttctttggggaaattcatctatgaacacatcagataataactcacggtaggctcttagacaatttcaaagaaagggctagccataccaatggctagagggctggaactttcaggccaactcccaacccccagggaggggagggaggctggagatcaaggtcagtcaagtggctgatgatgtcatcgatcgtgcctatgtaaagaagtctccataaaaacccttgaacaaggttcagggagctgctggattggtgaacacatcagtgtgctggggcaggagttgggggacaaggagagggtgatacatggagagggtgatacatggagagggcatgggagctctgtaccaccaccccaacctctataccttgccctatatactgtgccttttccatttgactgtccccgagttggatccttttaataaaactgtaatagtaagtatagtgctttcctgagttcagtgagtcattctagtaagttatcaaatcctgaaggggggtcatgggaacccctcagtttttttctttctttttgagatggagtctcactctgtcacccagactggagtgcaatggcgcaatcttggctcactgcaacctccgcctcccgggttcaagtgattctcctgcctcagcctcccaagtagctgggactacaggtgccactaactgggtagccaacaattcaattctgacattacccagagttagcatcagactccacaggtttaagggcttgatcccacaagactgttctaacttcagataccagccattagtcctggggtatccccaagtactttagtccaactggctataaagcgaagggttcccagccaggcacagtggctcacgcctgtaatcccagcactttgggaggctgaagcgggcagatcatgaggtcaggagatcgagaccatcctggctaacagggtgaaaccctgtctctactaaaaatacaaaaaattagctgggcgtggtggtgcatgccagtaatcccagctactcgggaggctgaggcaggagaatcgcttgaatccaggaggcagaggttgcagtgagctgatatcatgccactgcactccagcctgggcgacagagcaagactctgtagcaaaaaacaaaaacaaacaaaaaaaacttgttttactgaagcctccagaacaccagctgtttcagcaaaatgatttctatagatactatgacctggtaaaaaaatgcaaaagagagagactttgagctccaaacagtagagaaagcacacatggttgcctccttcattccaaagagcacaatgaaatggcagtcaagctatttttgaaagaataaatccatggtggcactgaagacacgaagaagcgttatcaatgaagacatcattttggagattctcttcaagaatagagttgggactgtattgaccaataaaccaaaactgggggtggggaatgggtgaaatacagctggaaatacatcaggctgcagataagaagctctttctttttgacagaaccctggagaggctccaagcttagagtcaatggctattggcagccacagaatggcctacaaagaagtggttataaggcaggaatcagggcatctgagtggagagctgtctacagaacagctgagccagtctgcccacagccctgccctgtgtagactgcagtctgcagtacttgcccccagctggaacccccggaacagccttctctggagaggaaagtttgcctgggagtgcgcatggtgttggtgtccaggctagagaatgagtcaaagaagagcctctaggatagacacaggggtaaaaagaaataaaacatataaaagatgtcaccccaagattggagttctccttatgttattagttttgttatagcaaatggtcctgaatcggcttgtgccctcttttacctaaccatatatcctagaaagaaacctgccgactggcatatcttgcccatttacacagagtacacatcacagcctgtcttcccactcaagaaagaagcctttcgggtaaataaacttgcctaaagggccgcccgtggtggctcacgcctgtcatcccagcacttcgggaggtcaaggtcggcggatcacgaggtcaggagttcgagaccagcctgaccaacatggtgaaaccccatctctactaaaaatacaaaaatcagctgggtatggtggcacatgcttgtaatcccaactactcaggaggctgagacagaagaatcgtttgaagccggggggcggaggttgcagtgaggcgagatcgtgccactgcactccagcatgggcgacagagcgagactccgtctcagaaaacaaaacaaaacgaaacctacccaaatacaaagaaagcctattgcagctacctatacaaatcaatatggtccttcattcataaatatgaagaatcaatgaagaattagcagacgtgaggaaaagcccatagcatgtgtattagtttgtaaaggttgccataacaaagtactacagactagggagcttaaataacattaactttctcacaattcttgaggctagaagtccaaggtatagatgtgagcggaagttgtttcttcttttcttttttttttcttttttttttgagatagagtctcgttctgtcactcaggctggattgcagtggcacaatctcggctcactgcaacctccacctcccgggttcaagctattctcctggctcagcctcccaagtagctgggattagaggcacatgccaccacacccagctaatttttatatttttagtagagatggggtttcaccatgctggctaggctggtcttgaactcctgacctcaggtgacccgcctgcctcggcctcccaaagtgctgggattacaggtgtgagccaccgcacccagccagaggtcatttcttctgaggcctctttccttggcttgtcttctccgtgtcctcacgtggcctgccctctgcatgtgtctgtgtcccacgtgcctctttttcttttttttgtgagacagggtctcactctgttgcccaggctggagcacagtggtgcaatcatggcttactgcagtcttgacctcccgggctcaagtgatcttccgacctcagcctcctgagtagctggtactacaggtgtacaccaccacattaggctaatttttttattattattattatttcttgtagagatggggtctccctgtatttcccaggctggtctcaaactcctgggcctaagtaatccacctacctcgacttctcaaagtgctaggattacaggcacaaggcaccgtgcccagcttcaggttcctctgcttaaaaggataccaggcatattggattagggcccaccacagtggccccatttaaacctaattatctctgaagaccctatctctaaataaagtcacaatctgaagtagtagggggttagtacttcaacatttgaatttggggggtgacatataattcagcccatagcagcataaaagagaaagactaagatgaataaaccaaaacttacctagagaagaaacagaaataacaaaaggagcaaaaacactcaccattttttaaagttctaactagtgccattcaaaggattaaaaagtttacaaccttatatacacacttgtgtggaaaaaaaaagcaatcatgaacattaaaacctcttggtgtttaaaactatcattctcaaaattttaaaaatcagtgagaagagctgagtaataaaatggatacagcaattgtaacagcagtcagtaaaacatgttggtaaatgtaaataaaatactgactacagaaataaaagggggcttcggttgaaaacaaaacagaagatgaagagtttaaagggaagtttaagaattctaaacttgatttattccaagatatttatttgctttagactttgttagaaaaatgtaaacttaggtatgcatgttaaatatgtgggggtggctgtggcccaaggtgggtggcctgagtatcccattcttgggtggggaagggggaaattttcccataaagctgtcatttcccagcttctagctttatttggaaagcccactttcagctgcctgcaatgcgtaggccctataacctcaactcccatatccacacgggtgtggaaatgcaggtccctaagctacatatgtggtttggttatctctgagggccatgaggcttcactcactcactggtgtaggtaagtttcttcatttctggcacctggagaactccctttgttgctttcaagctcagctaagaatatgagaacagttttttttattttgttgagacggagtctagctctgtcgcccaggctggagtgcagtggtgcaatctcgcctcactacaacctctgcttcccgggttcaagtgattctcctacctcagcctcctgagtagctgggattacaggcgtgcaccatcacacccagctaatttttgtatttttagtagagacggggtttcgccatgttggccaggctggtctcgaactcctgacctcaggtgatctgccctccttggcctcccaaagtgctgggattacaggctccagccactgcgcccagccctgaaatgctatttgaaggccgacttacggtcttttgtatacatgcaaaggagaaacggtatacattagcatggagccctagtcctgtcccaaattactattagcataaatgtttcctgactgagactattgattgtgactaaaaaaacaaagtccttcctagaaaaatataaataccttatagttttcagggcctgtgaggttttcacactgtgaagccctctgcgtcctgtctcatgacccctccacaacttcatctgggtacatgattcttgtcacttgctgttttccagccacattatacatttatgcagaaatataaagccttttgatttctccagcttgcaaagttctctgtagcctctgagatctcacaggagatatccccgttttccctgcgactcttcactggccacctcctcatcagctcccttcggcccattcctgaagctgcagcagctgcctcctcaccatcccttccacagcctcctgtccttttccttgacagtacttattaaaatctgataaaataccttattttgagatgtatttgttgaatgtctccctcccgacactagagtgtaggaatgataaaggaagggacttttagttgttattgctgtttttcactatctaggggaccagtcacacatgcagctggtacttggtaaacacctgttgaatggataaacacccccttgccaatatggctatttcttctccccaaaagtggctaaactctctcagtttagatatgctattggctgtgggacaatgaaaaaatatatatacttaatatatagtataccatatataggccaggcgcggtggctcactcctgcaatcccagccctttgggaggctgaggtgggtggatcacctgaggtcaggagtttgagatcagcctggccaacatggcgaaaacccatctctactaaaaatacaaaaattagctgggcatggtggcacatgcctgtgatcccagctacttgggagtctgaggtaggagaatcgcttgaacccaggaagcagaggttgcagtgagctgagatcgtgccactgcactccagcctgggaatacatgttatagataaagtatgcataatatacatgtattatatatataaatatatattaagtatatattcatgtattttaaatttaagtatagatgtattttataaattatatataatatatataaattatatgcatgggagaattttatgtctccctgattttcagtaaattatatagacaaaattacagaatccataagtagcaaattaagtaattttacattgaaaccactgactctactttatagcatagggtgatggtcacaccgacaccacaagccctaacccccgcctcctgccagctctcctggccccctcctgccagctctcctggccccctcctgcccatgctctctagaccctgggtacactgactgactggccttctctcaaggttctcaaccatgttacgctcctttgcgtaaaggccctttgcctatgcccttccctctgtttgcaagggtcttccctttgcttttcatacaggtaactgctgtttatccttttcaatctgttcaaatatcattttcccaggaaaggcttttctaaccctcaaaccatgccagttcttctgtttcacattcgaataggtccctgtgttatcaccgtctctaactgtgtatctgtgcagtatctgtccagcagctgcctccctgatgagaacaaatactccaggaggggaaggagccgtgacaacagacatgacatgtatatgtggattctggcacagtgcttagcacataataggagttcaacatttgtttaacgaataaacaatttggagaatgtactgaggaaggaaatatattattttggatttaggaaaaataccttactatgtttaataacactttttcttattaggaaaagaaaaagtttatttaatctagattaaaggatagctacggagctagtcagtaaaatgttcaaacagatgtgtacaaatgtggacagcagaaaggtgagttgctgccactgctgctgattttgcacatcaacttccgggaagatcttagaaagtacaggtgactctctaggtcacagatcactaaatggaagtccttccaaaagatggaaagatggcatggggtaggggagaaggatgacctcataaactcattctggtccaaaattctctgagacgaagcaacttgcaagtttatttatgaatgaaatgcagacttgagaagccactccatgaatcctagcagccagccaaagtccgctgaatgaaatctcaataaagaaaacctgaattcagactaacacagccacgtagagaaaaccctttcctcatctgacatcaatgtgtgtctatactccacatttggagggggcaggtgttaggttcctatgccaatttctttctttctttctttcttttttttgaggtggagccttgctctgtcgcccaggctggagggtagtggcatgatctcagctcactgcaagctccgcctcctgggttcatgccattctcctgcctcagcctcccgagtagctggaactacaggcacccgccaccacacctggctaattttttgtatttttagtagagacaggtttcaccatgtaagccaggatggtctctatctcctgacctcgtgatccatctgccttggcctcccaaagtgctgggattataggcgtgaaccaccgtgcccggcctcctatgccaatttctaaaagactgcttgacccataaagtgcctcatgccaccaggaagtgcacccaaagtcctcagcatagctcttccgggttacagctctgggctgtggatgagcgtgtcttcctgctcacgttccacctgccaaagagtaacaggaactccttccacttcaaatcattccatatttcctttaaaggacagcggtttctaactgtcttgcttccttcaaaaggcaaacgtacttaaattctaggggtgtagcatcagacaacatcactcctgccatagccattacgttacacagctctgagctcacaggctggagggcattgtttcaatagatcttccaacccctcccctggtctaacatgtgctcttatcaccaggagggtcaagtgggaataggtcacatattaaaccacatggcatcatactaggatggaaccaaaaatgaagtatgctatagcaggggtcccccaccccaagccgcagaccaacaccagtccatggcctgttaggaaccgagccacacagcaggacgtgagcagcaggcaagtgagcattactgcctgagctccacctcccatcagatcagcagtggcattagattctcataggaggataaaccccatcgtgaactgtgcatgcgagggatctaggttgcacactccttacgacaatctgatgcctggtgatctgaggtttaacagtttcgtcctgaaactaccccccatcctggtccatggaaaaactgtcttccacaaaactggtccctggtgccaaaaaggttggggaccgctgttctatggcaacctagactttaacaaaaagaatcttctaagccaggcgtggtgggacatgcccatagtcccagctagttgggaggctcaggcaggaggatggcttcatcccaggagctccaggccacagtgtaccatgatcgagcctgtgaatagacactgcattccagcctgagcaacacagcaagaccctgtccctatttttttttaatcgtcttacagcaatgtttctcaaacttcagcatttcaaataccacctacagaattttttttttgcctcgttcatatttcatctgtactatttttctggcttatacaagttaaatgaataaagaaattttatattgccgagaaatcagttttcagatgctagccatttttatttctatcacacaatgaaatatacaactattaaaatacaagatctttctctgtatattatctaaaataaatttgcctagcatactttggggaattctgatatcagataatacatgaagaaattccttcaccaaactttcctcacatttcaccagtacatgattaattccattatcaaagtgctaaataaacagtttgagaggcatttgagaggcttctgatagtgacttgtgcaccagcaacgaaaacttctttctgtaaagtctgcttttaagaaatctctcacgcctgtaatcccagcactttgggaggccacagcaggcagatcacctgagacccggagttcgagaccagcctgaccaacatggagaaaccccgtctctactaaaaatacaaaaattagctgggtgtggtggcatgcacctgtaattgcagttacttgggaggctgaggcagaagaatgggttgaacccgggaggcggaggttatggtgagccgagatcgcgccactgcactacagcctgggtaacaagagcgaaactgcgtctcaaaaaacaaaacaaaacaaaaaagaaatctcttcaagagttcagaggagctgtagacacaaatgactataaacatttcttagcaaaagggtggctaacctcaattcaatgacaattcacaaaaagacaccatgattacttctattagattcctgttgctactctaacaaattatcacacactgagtagcctggaacaataggcatttactccctttagttctagagatcagaagtctgaaaccagtttcactggactgaaattgaggcgacccccgcagaagctctcaggaagaatccatttcctggctttattccagcttttagagcttcattccttgtacccttggctcatggctccgttctccacgttcagagtcagcagcgtagcatcctgcttcagtcactgcactgcttcaatcttccgtttcaaactccctctgcctcccctttgtaaggacgtttgggatcgcacttagggttcactgggataatccaggataatctacccaccgtggcaatctggactttgcacatctgcaaagtcccttttgccatttaaggtaacattcatagattccagggatcgggactaggatatctttgggggtcattattcagcctaccacgctgttcttctaaacttttaacatgaaaattcagctgagcagttctaagagccccttaccatggtaaatcactgatgtgtatgtgaaatctttatctgatccttttttggaggcgcagagtcgtattttatcctttaaggagcacagtcatattttctagcacgttcaaaggacacgctggtctcctcaattccaggactgactctacgaatacaattggttttccttatcactctggttcccggtgtgtcacacaaagcagagaggagatgcacgcctggtcccttgtgcctacactgtcagatctcaataatccagcatcttgggcacaggcagggtgggaatgggaagtacttttaggcaaaaataagagcctggccccctttggtaagatatctccgtatgtctgccagctcctacagtggggctgaattgctatttcatgagcaatagtgtcatcttcatcaatgccaaacaaacaaaatgctctcattcaatttagcaaccatgtagtaaacattttctacatgttcacttcaggtagctgtagtgatcttgatttctggaaaaacatgtaaaataacagtttctgaacccttattcatattcattaatttaacaaatatcatcagtcactatttgccatgtgagttagcactagtgatccaacaatgaatagaatagagtgcctcccttcaagggggttccagtgcggtggagaatacagacaagtaaatgtcaatcagtcagtgacggatgctatgactagggaaatacaggatcctaggggagcatgaaagaagggaagatttcttaagagaaaaggatgcccaacctaagctcaaaaaaaaaaaaaaaaaagtcagcagtagctaaagcaagatgtatgctgaggtgggggttggaggaggaagcagagagggaagaacagtaattggcaggagggggaaggtattccagccactgggaaaagtttaatgaaagtatcagagggccgggcatggtggctcacgcctgtaatcctagcactttggaaggctgaggtgggtagattgcctgagctcaggagttcgagaccagcctgggcaacatggtgaaaccctgtctctactaaaaatacaaaaaaaaaaaaaaaattagccgggcatggtggtgcgtgcccgtaatcccagctactcgggaggctgaggcacaagaatcacttgaacccgagaggtggaggttgccatgaggcgagatcgtgccattacactccagcctgggtgacagagcaagattctgtctcaaaaaaagagaaagtgtcagaggccaggcccagcattctggtgcaactgatgaacttgaagtgagtcagtatggtggggtgtgtaattctagtgacagggaatgcaatgactagatcattgagaactagtgtggactttatcaggaaggcattgggagggccacttaaaattaataatgtagctgggtatgatggcacatgcctgtggtcccggctactgaggaggctgaagcaggaagactgcttaagcccaggaattcaagtccagcctgagcaacatgccaagaccttgtcgcttagaaaaaaaattataataagatctgtgttctgaagacaacactgatacaaggcagagaaaggctgagaaggaaataagacacaaggcaaggtatcaggctattgcagtaatcgaggccaaggatgacagtggcccagaggtatgaacagactctagtgatctttaggaagcacagctgacaggacaggacaggactcacctcatgaggaaggagtaactgggcagatgaagaaggcattcatggagaggaaagcatagggcctggcttctatgacatatatacacatacctattctgcttcataaataaaatggaaataaccctcaaagggtaaaaaaatgtatgcctgctgttgttcaaatcagaaagaaaaacaataagtaaactagacagtatcacagaggaaaaactaggaaacttagaggattgatccaggagttctttgtttttgtttttttgttttttggttttttttttttgagacagagtcttgctctgtcacccaggctggagtgcagtggcgtgatctcagctcactgcaacctccacctcccaggttcaagtgattctcctgcctcagcctcccgagtagctgggactacaggcatgtgccaccacacccagctaatttttttatttttagtagagacggggtttcaccatattgaccaggctggtctcaaactcctgacctcaaatgatccacctaccttggcctcccaaagtactgggattacaggcataagccaccatgctcggacaatccgggagttctaaatctgaccagtaggagttgcagcaagagaaaatacagaaaaacagagggaaggaaatgacaaaagaatgtcccagaatggaatctctagattgtaagggatgccaagcatccaaaacagtgaatgaaaatgtacctactttaaggcatgctcataaataaaagatcctaacatgttccagagagaaggaaataactcacctataaaaaatcaagaatcgtgataatgaacggcctaaaagtaacaacactccagtggcaatgggtacagtacagtatgcaccaagatcttagattccaaacagcatttcccaataaaaggaaccagggatccttgaggaaacagcagattccagggataggatagagaaaaaggagagcctgggacattttatgcttccagaaagcaaggaattgctcatagattgtcagggaaacatccaaaaggattggtcaatttgggatatttgagcatcaaaagaatggcaaagacctgcacacaccagcagagatttgttcttggtgtgatgtcatccatcaaatcgtgcctctatgattctttgtgatgctgatctttgtgatgtgattctttgtggtggctcatgccaaaaggtctcagaacatcaattctgttcattttcttgttttggtgttctttttaaaaagctctgctgcgggtggtggctcaagcctgtagtcccaatactttgggaggctgaggtgggaggattgcttgagctcaggaattcaagaccactctgggcaacacagggcgaccggacccccatctctacaaaaaataagttaaaattagccaggtgctatggtgccggcctgtagtcccagatactcaggaggctgaggtgggaggatcacttgagcctgggagatggaggatgcagtgagacgtgactgtgccactacactccagcttgggcaacagagtgagaccagaaccacaactctgggttctggagaagtgctggtggtctgtcatgagccctttgtgccctcccacccatagaggccacctggaactaaagagcactagaatttgtggctgcatgaggggacgtcatccactcagtgttccacttgccaacgcccctagtcagtggccattagggtctgtcatcactgggattttcacttaactgctgatccatttcctcgcttggcttggtcactggcataggaacagggtaattactggggttggtcaggccctttttaattctctatgaggaaattagaaactgaattccaaaactgaagataattcgacctttcagctttgtggttatactctaagtacaacgtattttgttagtaagattttgatacttgattccaaaatgacctagcctattgttttcctcatttaatgaaaaccaaaattcagcaggccggtaaatcacatgcagatacttgcagccaatgtgctgcccttttccagcgcccctgactccctatcactcagatcacaataaaaatccagatggggctgcagccccattcttaacacctacagctatcatggccttttttcgctttaacaaaaggaataaaagctgatgatggtcttggcagggatatacttttttatcctcagagagtctcttttcctgtgactgaaaatggctgactctgccctatctccgaggagcaaatgttcacattagaaaaccaccagcatagctgccttctctccgggaggccaccacagagaaaaccaagtttgcactggcaacgaatggaaaaatacctcctatttgtatatgtacacatgtagccacccgggtatgagatggagatgaggacaggggaggtgtgggggaagcagcaaaagggataggggcaaaatgtgcgagtcgaaggacctctgactgtgactgtgatgctgtgtatatacacgtcgccacgtggatgcgcttctgtgcatgtgggggatttagacctgtaatgtgagcatataagaaccaatacaaagtacagcgctaaatacattgtctgcatattcaacaagggcactgcttctcaaatctggcagcaccttgaaatcatcaggggtggcttcaaaaactactgatgcttgggccccacccctggaggttgtgattcacttggtataaaattactgtggtaggctgggtgcagtggctcatgcctgtaatcccagcattttgagaggccgaggcgggtagatcacctgaggtcaggagtttgaaaacagcctggccaacagggtgaaacctcgtctccaccaaaaatacaaaattagctgggcatggtggcaggcgcctgtaatcccagctacttgggaggctgaatcaggagaatcgcttgaacccgggagatggaggttgcagtgagccgagatcgcaccactgcactccagcctgggcaacaagggcgaaactctgtcttaaaaaaaaaaaaattactgtggtagacagaacagtggctccctaaagatgtccagctcgtagtccctggtgtctgtgaatatgttaggttaaatggcaaacgagccattaagcttgtagatggaatatgggttgctcatcagctgacctcaacatgaggaggtgatcctggattatctgggtgggcccaatgtcatgacaagggtccttaaaagtagaagagggaggcagcagtcagaggtacaagtgatgccatatgagaggcactcaacctactgttgttgtctttgaagacggaggaaggggtcatgggccaaggaatgtagctggacctctcaaagctggaaaatcaaagatatgaattctcccctacatcctccagaaggaagagccaccctgcccatgccttagttttagcccagtgtgactcacatcaaacttctagcccacagaactgtaagacattaagagagaaagagagagagagagagagagagtgtgtgtgtgtgtgtgtgtgtgtgttttgagagtctctcgctcggtcacgtgtgtgtgtgtgtgtgtgttttgagacagagtctcgctcagtcacccaagctggagtgcagtggtgcaatctcagctcactgcaacccctgcctcctgggttcaagcgattctcctgcctcagcctcccaagtagctgggactacaggcgcctgccaccacgcccggctaatttttgtatgtttagtacaggtggggttttaccacgttggccaggctggtctcgaactcctgacctcaaatgatccatccacctcggcctcccaaagtgctgggattacaggcgtgagccactgcacccagccttgtgttgttttaagccactaaactggtggtaatttgttacaacagcaacagaaaactaacacacttcaacctgaggaagctaattttaaaaatcaaattaaaaaaaatgaaaacaacaacaaaaaagaaaactaacacaggtatggcctgggctcttggagttttaaaagcagcccaggtgattctaatatgcagcaaagtatgataaccactaaaccagacgaaagacaagataaagacgtgcggcttgattgccttatgctggacaaagaaacggtgctttcatatgggaacttagtaaatcatcccaccaaattatgcatgtaaagcaccatcacttgttagccatccacccgcagacactgcagcttacctgcacgtatatcacaacacatgatcatcagtttggtggctagagtcctctctagtctcacccatcgaataggctaaatgtccttgggatgaggaacaattgtacaccagataggcagattttctataaagcttactttcctttttttttttttttgagatggattgtcactctatcgcccaggctggagtgcagtggcacaatctcggctcactgcaacgtctgcctcccaggttgaagcgattctcctgcctcagcctcccgcgtagctgggattacacgcatacaacaccatgcctggctaattttttgtatctttagtagagacagggtttcaccatgctggccaggctggtctcaaactcctgacctcgtgatccacccgcctcagcctgccaaagtgctgtgattacaggaatgagccaccgtgcccggcctataaagcttactttcttatcaatactatcacttaaggaaggaactgaccaataactgaattatatgcaaatacataaattagcctgttcgtgttggtaccatcagggaaagaactaagttgtcctctctgtgctgaaactattagaattgtaaagagagaaggcttctccattggatttagtaatctatttatttatgatagatgataaacagatggaattgatttatgacagataaatggaacagcactgcaggaacaaattaactcattcttcccaaggatggagaatagaagtgtctgctgtaggattctgagaagtgcagccctctcttcaaagcaggtgttcgtctatccccagggcttcgatgcttgctcatacatgataacttttcttttttttgagacggagacttgctctgtcgcccaggctggagtgcaatggtacaatctcggctcaccacaacctccgcctcctgggttctagcaattctcctgcctcagcctcccgagtagctgtgactacaggtgtgggccaccacgcccagctaattttttgtatttttagtagagatgaggtctcatcatgttggccaggctggtctcctgaccttgtaatccgcctgcctcagcctcccaaagtgttggaattacaggtgtgagccaccgcacccacctgataacttttcttgaaagccattccatcgtgttattactaaaagctgaaaccttagatagaatactttacattttctttttctcttcctactttgtcttctttagagaggaagccagtttagcagcaaaagcagtcacgttagaatcagaagacctgagctggagtttagctctgtcactcataagcgatgtggtctcagggggccctgcagccactctgagttttgcctctcacacgaggagggtgccgccttcatgatgttgtgtggagatgaaatgaaatgacatagatgaaagggcttagcacatagtgggggctttccataaatgccagcttcactgccactcaacgactccacgctgtcacacgtcacctctacactgcagctgctcccatctcttctctttggctccgccctctccctgagctctggtaccctgtctcccactgtcaactggacatctcccgccggcatctctaattagacacatgcaaactggacttaccatctcacccaaaaaccagtgtctgctctcaagtttcccaacttcatccttaacgtaaaatcactggcaatcccgtgcccccgtatttcttccccctttctgcccctacaacccatccaggccctcctcaagccaagagccttgcagatgcctacacgtcttaaacactccccaatccaccctgcttgcagtttgcaaattcatctttttccaaccagacttgtcacatcaaaccctgaacaaagatcttcaaacccttttttgccctgaagcctggtacataggatcgaagaagagcaaactccaccgggtgtggggatgacaggaggcccacacagcctcagtgtacaaagtgctgagcaatttcatatcactgccacatagaagaaaagctcttgggatgaatggatcataaaacacagtattgttaaaagcagctactgagaactggaaaatttttcaccaaatttctttgcatagtatttaacaactatcatctaaatctgccacaacccccactccaatgcgttaaactgtaacaatcattgacattaaaccactttacatgttgtataatcttaaactcattcaacaaatgctcaagcctttagtatttatgtcaacggcaaatctggtcaatcccagacttattcttaccattttgttcatccaattcattcccaatttcctgccccatttgtttttggcgacttatgatagaggaaagggcatcaaggcctgcgtcctgttctgaaagaaaaaagaaaaataattaactagaaactagaagaaaacaacttaaagtccataagtatacccaggcatataacacaagttgacatataaatcagtcaggaaaaaaaagagaaaagagttaacattattggaacaaaatttaaaaactaaacacctacctgacaccttaaactaaaacgatttccaaaagaattaagattttaaatatgaaaaacaaagtaagatttggaaacatgaacatttaaactttctgatacttaatatataaagagcatgtacaaatcaataagaaaaagactgaatatcccaattttttaaatcagcagaggatacaggcaagaacttcacaataaaaaagaaaataaagttttaacatcgctactaatttttttaaaaatacaaataaaaaactactttttttggcttatcagatgtataaggattaaaaagaatgacaatacctaaggttaattaaattgtgacgatctagaagctcccaagtactatgtaataggtgaataagttttactgacggccgtatttctcaagtgtagactgtgcccacctttttacctgccaattctaagtctaggaatgtatgtaagaaaatattcagatagcatgtaatgatggatatacaaggatattccctgaaacatttgtttcttgtgccagatatcaacttagtgcctctcagcaacaaattccctctttttggctgctctatgaagatgaaccagctgggcacagtggctcatgcctgttatcccagccactttgggaagccaaggcaggaggttcacttgaagccaggagttcaaaaccatcctgcatcaaaaagtaagatctcacctctagaaaattttctttaaaaaattagccaggcagccagtcgcggtggctcacgcctgtaatcccagcactttgagaggccaaggcgggtggatcacgaggtcaggagatcgagaccatcctggctaacaaagtgaaaccccgtctctactaaaaatacaaaaaaaaattagctgggcctggtggcagacacctgtaggcccagctactggggaggctgaggcaggagaatggtgtgaacccaggaagcggagattgcagtgagctgagattgcgccaatgcactccagcctgggtgacagagtgagactccgtctcaaaaaaaaaaaaaaaattagctaggcacgatggcatgtacctgtagtgtcagctacttgggaggctgaggtgagaggattggttgatcatccaggagttcgaggctgcagtgagccatgatcacgccactgcaccccagcctgggtgatagagagaggctctgtctctaaataaaaaataatttgaaaattttttaaaaaagaaaatgaaccaaggctgcttgaatactttttcctttgtcagagtttttgcttcctggctccagcctgcaatcttggcaggctccttcagcaactgcaactccttcagtgcctggccccttcagtgcacagtggccagcaatacccagaaccagcaacttctcccagcacaccccctcctcgggcaggtttataacaagagcgcctccagggaggttcttccccatgaagagtttcccccagcatcccagagggcagatctccaggaggttctgacagcagggcaccacgggggcttctgtgaaattcagggaccctcagctgagccttctcttagccctaggggcgtgggctcctccctggacattctgtctcagcctgagacttggtgattgcaccttatccctgctagttctgttttgagagttcttttgacctcttgttagctaatccctcgttactctaatccctgttaaaattaataatttacattcaactttccctgtcaaatttctctctcctgatcagacccatagtgatatacttataatagtgaaaaattagaaagtacctaaatgcccaaacacagagatgtttataaatttatagtatatccacatagtaaaacactgtatagccactgaaaatcatattgtttatctatattttgatgttgaaagaagttcatatgttttgtttttttttgttttgtttttttgttgttgttgttgtttttgagatggagtctcactctgtcgcccaggctggagtgcagtggcgcgatctcggctcactgcaagctccacctcccgggttcacgccattctcctgcctcagcctcccgagtagctgggactacaggcgcccgccaccacgcccggctaattttttgtgtttttaatagagacggggtttcaccgtgttagccaggatggtctcgagctcctgacctcgtgatccgcccgcctcggcctcccaaagtgctgggattacaggcgtgagccaccgcccccggcccccatgatatgttcttaagtaaaaaagcaggaagctgggcgcagtggctcacgcctgtaatcccagcactttagggggctgaagcgggcagatcacttaagcccaggagtttgagaccagactgggcaacactgtctgtctctactaaaaatacaaacattatctgggtgtggtggcgcatgcctatagtcccagctactcggaggtggatggatcacttgagcatgggaggcagaggtcacagtgagccgagatggcgccactgcactccagcctgggtaacagagtgagaacctgtctcaaaaaaaaaaaaaaaaaaaaaaaaaagatacaaaacaaagtatagtacaacagcttttgttttaaaaatgaaaatgtattactttgaaactttttgcaaatttaaagagcaaagttagtttttgaaaatttaaagaaaaaggtgagttaaactcaagttactcacgatcctttctttaaaatttaatatgtatattttgaactgggggtctcggtcatgtctttgtaaaaattttcttcctctaatttcaggtgctttgagaacactgtgaagctgagtgtaatgactcttgttcaccacggaacacgccgcatgaaggtaacattgtacccctcgcagcttcatttgtctacagggtttttgaaatgactgtttcacataaaggcttatctacaaaagcaaaaatcacaaaggtcttactcgaggtcgcattaacatttacttatattttttccaagtctttttatggaattaaatcatcaaacttagctctttaattcatctggaatttatttaaactaacggtgtgaggtaacaacccctttgtgacattgtttgacacactgtactttttttaactatacaaatgacctgccgtctttagggatcattcacaaggaccattttatagtaaaatcactttataatgaggtcctcttggtctttaataacaacctcttggatggcctccaagataaatccatcctcaaccaagtgctcctataggatgactgatgttatagtaaaattctaaatgcatctgatgaataatctatatatataggactgagggttgagtgtcaacgtggattaaaagataaaaccatttaaaaataggaaaggcaattcctccacagtttccattaggaaaagagtcattaaactcctaaaattgctttatctagtagagacatagattatgaatgaaaaatacactaattacactctttaatctcaaacttgactcattatctgatttagcaacctgatgatcatctaatgcacatgagaaagagaactaaaagttctgttcccctctaataatttgtataagcttagcaattctctccacatctttaagtgctgcagtaaattttcattacacaatccaaagacacagaagattcagataatcgagatgctgtagaggtaataataatcacattcataacctgggcttccccaagtcctgaagaggcatttctaaggggaaggtggtatggctatcttagagacaatgatcaaaacacaatgctgctgactgcaaaaatataaataatcaagaaccatgcatgggcatggtggtgtgcgcctgtagtctcagctattcgggaggctaaggcaggaggactgcttgagcccagaagttcaagtccagccaggggcaatatagcaagactcctgtctcaaaaagaaaaaaagaagaagaaaccataccatgcagtttctttttctttctctttttttttttttttttgagacagagtttcgctcttgtcgcccaggctggagtacaatggcatgatctcggctcactgtaacctccaccttccaagttcaagcaattctcctgtctccgcctccccagtggctgggattacaggcatccaccacaatgtccagctaatttttgtatttttagtagagacgaggttttgccatgttggccaggctggtctcgaactcctgacctcaggtgatccagctgcctcggcctcccaaagtgctgggattacaggcgtgagccaccacacccagccaccatgtactttcttaccaacaaaactaccatcatgtcataactgccaaaatctgccctactctttcacataacccaagtcatgatgatatcacaagagggcaattgtaacataccacactctatcagtcattattctattttacaatgatttgaatttttaaaaatggatggatcattgttacagatagaataatatcccccatgtttaagatgtccatatcctaatccccagaaactatgaatatgttcccttacatggcaaaagggactttgcagatgtgattaaggttaaaaatctgagacgggggattagcctggattatccaggtggatccagtataatcatatgagtcctgaaaagcagagaacctttcccagctgccatcagagggagtatgaagaagggtcagagagagataacttactggctttgaagacgaaagaagagatgtgggagccctctagaagctacaaaaagtaagggaacgaattctccagaatgagcctccagaaaagaatcaagctaactgcttgatctgagccctgtgggacctgcattggactactcacctacagaactgtaagatcataaatgtgttttaagtcactaagtttgtgctaatttattaaagcagcaatagaaaactaatacaatcattttttaaaaatccccttgaaaccattaggtgtttggatatttcctatctgtagacattcagaaatgcaagatctggatagtgggaaactaaagggcaaatgcagtttcaatgaagaaactgcatagaagaaaaaggaagagttggaaaaagaacctgtatattaaagaaacttaagagacataactagttgcaatgtatgggccatatttagatcctgaattgaactacctaaaagaaaacatcacagcacaatcagggaaacttgaatgctgagtatttgattagattcaggaaatattgttaacttcttaaggatgataatggcatgtgactatagttttccaaaacagtatttatcttttccaaacatatttcagatatatattctcaaatatccactgatgaaatgatacgatgtctgggatttgctcccaaaataacctaggggctgggtaggatgggtaggttacgggatggcatatacatgtgaacagattggctatgggttgacaatcactgaggctggaggatgagtaggacaaagtcattatctgacactctctactattacacgtttgaaattttccatagtaaaaagttatcaatattttaacaatacaacagagggacatccctaagagctgcaactacagtccctggattgagtacaagatccagaccccaatgactgtcttcttttcctgtgtctttgacatacatgagacttcttctttttctatgtctttgccccagatctgagcccagctagtggcacggagcaccaacatatttaaatcaaggactgaaatgtacaacacttgtttaaatcaatgaatgaccacagagggagggccctctaggtttacaaaagaaaggaatacagtctctgctagacagaaagactcctggccaatactagagagccctctgagtttacacagtcaaaaaagtagttgatgttgtgttgtccagtgcccacagagaagcaatgaacctttcacatttaacatacagaaggagctctccctcaataaaggaaggtaggaatgaaagagaagaaaatcaggtcacccaggtgcagtggctcacgcctgtaatcctagcactttgggagcctgaggtggggggggatcatctgaggtcaggagttcgagaccagcctggccaacatggcaaaatcctgtctctactaaaaatacaaatattagccagatgcagtggcatgcacctgtagtcccagctacttgggaggctgaggctggagaatcacttgaacccaggagatggaggttgtattgagttgagatcgcaccactgcactccagcctgggtgacagagtgagacaccatctcaaaaaaaaaaaacaaaagaaaagaaaaattaggtcaagctagataaaaagttaatcactatgttagaagactcagagcaagtttaagaatagatgtttttatttttgttttaagattttaggaaaggaatccttctagtctaggtgacagctacaagaaagggtatcttcaaagaaagttttctgtgaagctgtgactgcaagggttcaaaggttagctactaagattccccagtgtgaaatggagtctggctagccaccttctacagccccatttcacatgcaaacaccaagagacctaagaacgcagaaatctagaacgattgcacaatttcctgctagagtctagaaagaacatctatagaaaattcataagactagatgaagctgatgaagaaaccccatcaagaaagacctcctgggtgaaggtggaatgacacttcatacttctccaaggtctgcgatcccactcagggacaagggtgtataataaccaaagcattttgaaacaagaaacaagtacccttgttccttctatctcagggatctttgaggcaattaagtgattgtcatcacccacccatcttctgcctaatgcccatttcatgcttcaaattacagctgaaggggcacagaagccaaattggctaatttgttacgatgaggcttcacttctaggttaggcaaggaaggcattccctgcccttcagtctatgttctaccagtaaactgtaattttgggatgattttcaaagtttctaagggtcagctagagtgcagaatggctaagggattccacgggctaaaggaagtcagaaatgaccttttgtggctctttattttcatttaatgcaggacctggcaaggacgcaaacaaagccatagcaacttcagcacattgtcaagattcttgaggcagagaaaaggctaataagggttctgtgtgaagattacttccattttttgtatttgtccttgaaaaacagctcgctagcaaagaggaatatggcatttctttctttctttttcttgaagcagtcttgccctgtcgccaggctggagtgtagtagcacaatctcggctcactgcaacctccgcctcccgagttcaagccattctcctgcctcagcctcccgagtagctgggactacaggcgcccgccacggacgcccagctaatttttgtatttttagtagagatggggtttcaccatgttggccaggatggtctcgatctcttgaccttgtgatgtgcttgcctctgcctcccaaagtgctgggattaccggcgtgagccaccacgcccagccggaacatagcatttcaaaacacaaaggtaagagcagtggagagaaactgacctgcaacctgcgctgccgctccccgcaaactccacccacaccccacaggccagcaggcttcccaagggtgagaatcttcataaggaagctctgttttggagactgtgacaaacactttgaggagcatcctctcacactgacctaaagcaacccctgaaaatagcaccttctccgggacgagcatactcttcccgactgaaaacagcttttcttggcaaaatgcaacaatgccagaaaatgcatgagtattagctataaggtgctccattcaggaaatgtgagtcctgaagagcgaatggttgtgctgcatgtaaagctgtgttgtttttcatttttttcactttcctccaaatatggtaatgggtgaagtatgtaaaactgaagatgtaagagagtcacggtgtttcactgactcaataatttcactgtgaaaagggaattcgaaatagaatcagatttctgcttctgcccaagatggactgacaggcaccagacttccttctggactgaaacaactggaaaaacaaaacaaaacagggtaaatatacgaaacaacagttttaagacatggacatcaggaaatgaagggcagtgatccctgagagacgggaaacaaatgaggtgagttctaagactgccccggattactacctcataagagttcccaagccatggtgtggggatgggagaacacaggtggaacccagcattttcctcgagttgagaaaagtcccaagaggccatggtggttagaggatgtagggcacaggaccagagaggactgcagagagtactctgtagatctgcacaggggccactttgagtctcgagctgagtgtcattcagaaattagtgactttggcaaggctgcatgatccaagatcaatatacaaagatcaactgtattttgatatacaagcaacaattagaaattgatattttaaaaatgctacttagaataaaagatatgaaggccgggcgtgctggctcacgcctgtaataccagcactttgggaggccgaggcgggcagatcacgaggtcaggagattgagaccatcctggctaacatggtgaaaccctgtctctatttaaaaaaatacaaaaaattagccgcgcgtggtggcgggcacctgtagtcccagctacttgggaggctgaggcagaagaatgtcgtgaacccaggaggcagagcttgcagggagccaagatctcgctactgcactccagcctgggtcacagagtgagactgtctcaaaaaataaaataaaataaaagatatgaactatttagggataaataggataaaagatatataagacacgtatagcaaaaactaaaaggcattgctgagagaatttgagactcaatagtgttaaaatatcaattctcctcaaactaatctaaaaattcaatgtaatcccaatcaaatgcccaggaagctttcttttgtaaaattaaaaacagattctagaattcacatggaaatgcaaaagacctagaatatccaataaaattgtaaaaataaacgaagctggatgacctgtactatcttacttaatgacccatcataaaggtaaaataattaatacagtgaggcattggtataaagataaacaaatagaccaatggaaaagaacagagagtacaacagaaataggcccatacgcgcagcagctcacatctgtaatcccagcactttgggaggccgaggtgggtgggtcacctgaggtcaggagtttgagaccagcctggccaacatggagaaaccccatctctactaaaaatacaaaaattagctgggcatggtggtacatgcctgtaatcccagctactcaggaggctgaggcaggagaatcgcttgaacctgggagacggaggatgcagtaagccaggatcacgccactgcactccagcctgggcaacagtctcaaaaaaataaacaggccaggcacggtggctcacgcctgtaatcccagcactttgggaggccgaggcaggcggatcacgaggtcaggagatcgaaaccagcatggctaacacggtgaaaccccatctctaaaatacaaaaaattagccaggcatggtggtgggtgcttgtagtcccagctactcgggaggctgaggcaggagaatagcgtgaacctgagaggtggagcttgcagtgagcagagattgcgtcactgcactccagcctgggcgacagagcaagactctgtctcaaaaaacaaacaaacaaaccaaacatgatgagctgtcacctcacacctgtcagaatggctatgatcaaaaagaaaaaagataacaagtgttggcaagaatgtggagaaaagcgaatccctgcacactgttggtggggatgtaaatttactgcaaccattatggaaaacagtatggaggttcttcaaaaaattaaaagtgatactagcaatcccactgctgggatttgtaggcaaagaaagccaggcaaataccatatgatctcatttatatgcagaatctgaaaaagatgaacagagaagcagagagcagaggagtggttacccagccctggggtttgggggagagatgaggagatgtgggtcacagaatacaaaatttcagttagacagaaagaataagctcaaaagatcgactgtacaacagggtaactaatatacttaaaaattgctaagagagtagattttaagtgttctcaccataaataaatatgcatgtgagcttatacataagttaattagattgatttgcccattctactatgtatacatattttgaaacaacacattgcaaaccataaatataatttttacttgcaaattaaaaattgttttaaatttaaaaagtcaaacagctactatatgactcactcattccacttgtaggtatttaccccagaaaaaatgcaaatttacgtccatacaaagtcttatacatgaatgctaatagcagctttctttgtaacagtcaaaaactgaaaaccacccaaatattaatcaacaggtgaatggatacacagattgtggtaaatccatacaatggaatacaaatctataatataagagtgaaatgcaggccgggcgcggtggctcatgcctgtaatcccagcactttgggaggccgagtcgagtggatcgcttgaggtcaggagttcgagaccagcctggccagcatggtgaaaccccatctctactaaaaatacaaaaaaaattagctgggcatgatggcgggcgcccgtaatcccagccactcgggaagctgaggcaggagaattgcttgaacccaggaggtggaggttgtggtgagctgagatcgtaccactgcactccagtctaggcagcaaagccagactctgtctcaaaaaaaaaaaaaaaaaaaaaagagtgaaatactgatacacataaccagttcaatgaatcttaaaataattatgcttagacaaagaagccagagccccttcttccccaaaaggtacatactgtatagttctatttatataaaattatagaaaatggaaactaatttatagtgacagaaagaagttcagcagttgtctgggcatggcagggaggaacaataggaagaattacaaagaggcatgaagaaaacttttgggaataacaattaggttcattatttttattgcagtgatggtttcacaggcatatacatatgtcaaagcttatcaaatcatatacttcaaacatgggccatttatgatcatatcaactacatctcaataaagctgactttagatttattttctcctcctcctcctccctcttcctttttattcattaatttttttaaagatgggattttactatgttgcctaggctggtgtcaaactcctacactcaagccatcctgctgccttggcctcccaaagtgtcaggagtacaggcatgtgccaccaggcctggcaataaagctgattttaaaaagcagaattagaaagaataatgtatctgtacatactgacattttaaaaagtccataacacatactaagtggttttttcttttttttcctttgagatggagtctcactctgttgcacaggctggagtgcagtgacatgctatatcggctcactgcaacctctgcctcctgggttcaagcgattctcctgcctcagcctcctgagtagctaggactacaggtgcgtgccaccacacccagctaattttttatttttagtagagacggcgtttcaccatgttggccaggctggtctcgaactcctgatctcaggtgatcctcctgcctcagcctcccaaagtgctgggattacaggcgtgagccaccacacccagccgacacatactaagttttaaaaaggtgtggaattatatatatatatggagagagctaaatatctcatgattccatttatgtaaaataagtatatttatattgaatatatgtatgtgaatgtatacaaaaggtctaaggaaatacatattaatctgtttccagtttgagattggagaaacaatatggagggctttcatcttatacattcctatgttgtttacactttgtataacaatcatgcatacttctgaaattttaaaaatataagaaagtttaaaaaaaaaaagttaaaaagccacagggcaaaagataaaaaagaaaagccaaactgacatattttataatttaaaaaataaaatggagtcttgtgtttggagactaattcccagtcgtgaagctaaagtaaagagcataagcatcaaatttgcttggacttagattcagatctgctctctctgctcttgcccaatggaaaatcaccacttccatgagccaccgagatgagtgacagcaactgtctattcctcaggtatcctgaggcacacaccaaaagctttaaaagaccagcagttttcactccaattttcaatggggatgaggaacaaacaaggctccagtagaaaatctggtggccgggcacggtggctcacacctgtaatcccagcactttgggaggccaaggtgggaagatcatgaggtcaggagatcaagaccatcctggctaacagggtgaaaccctgtctgtactaaaaatacaaaaaattagccgggcatggtggcacgcacctgtagtcccagcttctcgggaggctgaggcaggagaatcgtttgaacccgggaggtggaggttgcagtgagccaagatcacgccactgcactccagcctaggcgacatagcaagactccgtctcaaaaaaaaaaaaaaaaaaattctggcaaggtttctgagcccacactcctcaggatatttagtaccttggataattttctgctgctgttgccggatttcatcaaaacccaagcctctggtctcctctggctcctcaaagagccaagggttgggtgctcctcgcttagcctcttcactcatcaggctggacctaaagaacaatattaaatgcatgatatatctcaaaacatgcagctcaaatgcaaattactcccacaagtgcagaggtggccagccttgaatgctttgaaaattcaattcaaacacaatttattgcatcattagtttatgccaggaactgtattcagtgctggacgagatacaaggatgaataaggcacaagcttggtcctcagaattacagcctgttatagagatgatgggagaacataatatttgtactaatcctccaagagatgtttgagttaataatcctaaaagaagttggtaataaatgaggttcttaaatttcaaaaacagaaggccgaacagcggcctttttattaggacaaagtttgtctcagaggctacgtgaccccaaaggtacaaatattatttctcaagcagacacaatgttgcgactacagattacaatgttgttgttgttttaaaaaaagaccatataatttcccattaaagggtatttggagccgggcgcagtggctcatgtgtgtaatcccagccctctgggaggctgaggcgggcagatcacctgaagtcaggagttccagaccagcccgtccaacatgatgaaaccctgtctctaataaacacaaaaaaaattagccgggcttggcggcagacatctgtaatcccagctacttgggaggctgaggcaggaaaatcgcttgaacctgagaggcggaggttgcagtgagccaagatggcgccactgcactgcagcctgggtagcggagcaagactctgtctcaaaaaaaaaaaaaaaaaaaggagtatttggttgctcagagacagaaacacatgcagggtttcaataccaattttgtgactataatgtagcattcataacagaataaacacattctgatttgtcaatcttaaccttactccctctaataatccatgtgccctttctgcacgagaccagttggtctcgctgtctaaggaacaggaaacacatgatttccacctcagtccccatgttttcaggatttttctcctctcaagtagctcctctcctctccccacctgtctgcattctgtccaagctgagaagatcatcttgtccaggacacgaccttctgaccaattcaacaaagagatgaacattagactcatctttagagctctcaacagattcatgaaaaatcatagaataaatgatgggtgggacatcagcaagatgactgattagagtcagctggtgctcacccgctcccccccccccccacccacctttcttaggaaaggactaaggcaatgaataaacagctaagatttgacttcagtgtgggaaagtgctgaactgcagtggggaagtggagaggcccctgtggtgactgaaagtctaggagggcagcatgaaggcccccagcctctgtggccccatctcttccaccaggactgaggaggcctggacatatgaaggccttctccctgtgaggaaaaggtaagcgggagattcccacctgcccccactgccactgcaaacacctacagtccttattacaggaggatcccccagtccttgcaagttctgagcccagtttggagagctgctgggaattcgtacagttgcactgccccagattaggagcattccccactccccacccactccatgagccaagttactacagcatggcgccatctttagaccacagctccctctggagtgtgccttcctcttggggccagtagccactgcacctttccagcactgggactccattttcatgccaccaaagctacacaggtggctgaactccacaacccagggctcgggaatggctgtgactctggtcctgcaatgaagggaaaccaccctctgcactttcagccacagaaacagtcccacccagggcaaacccactcttgagccaaccaaactgctgcataccctcctgcaagcagaaggccctgagcaactgacaggctagcagagtgactacgctcctgcatcccggatctatgaaacagtcgggcagtgcagccccctacagacatgcccccggcctgcccaaaggccccacacctcaatcagggcctgagaaacaaccctgcaggctgcccctggcagacatacccccaggccagccaagtagccatgtgtccatatctcaggcctgaaaaacagcccatgggtcacccctagcggcaactcccctaggccagccgagcagccttgtgttcatatcccgggtctgagaagcaactcctcaggccactcctggcagacatgcccccggggccatcaagcagacttatgcccacctctcatgcctgagaaatagccctgtaggctgtccccagcaggcattccccacaggagagctgagcagcagtgtgcccatgtcccaaacctgagaaacagcccaacaggccacctctggcaggcatactcccagactggccaagcaaccaagcaactgtgccctcagccagagtaagggcaccaaccccaaccccagcaagtgagaccccaagttggacaacccaccatgtgaacgcatgcatcgctgacctgacaaatagcccggtgaacacatccctggcaaagtcatgccaccaccaccacaaagcctctcagctgaggccactgagacactcacaaatgtcactggcatggattacagttaaagaaactacacaaaaactacactactatgcccacctggaaccaaagccaatgcatcccactgaaccaacaccccaagatccattcatacaaatatttctttccctgcaaaacctaccacataaaattggaagaggcaattattccaccagatgcatagacatcaacatagggatacatcgaacatgaaaaagcaaggaaacatgacacctccaaaggaatacaataattcctgtgtaatagaccccaatgatagagaaatatacaaaatgacagaaaaagaattcaaaatagtaatcttacagtgagatacaagataatagagctagacaatttgatgaaatcaggaaaacaattcatgacttgaacaagaaattcaacaagaagataaataccataaaaaagaacaaaacaggtatcctggagtggaagaattcaatgaataagtaaataagtacaagctagagctttaccaaaagactagaccaagcagaattttatttatttatttttttggagacaggttcttactctgtcacccaggctggagtgcagtggcattatctcagctcactgcaacctccacctcctgggctcaagtgattctccctcctcagtcctcctgagtagctgggactacaggggcatgccatcacatccagctaatttttgtattttttggtagagatggggtttcaccatgttagccaggttggtatcgaactcctaatctcaagtgatctgcccgccttggcctcccaaagtgccaggattacaggtgtgagccaccatgcgtggctgaatttttgaacttgaagacagatcttgtgaaataacacagaaagatggggggaagaaaaagtaaaatggaatgaagaaagcctacagaattcatgggacactattaagtgaacaaatattcacactgtaggtgttccagaaagagaaaagaagggcaaatgtacagaaaacattgaatgaaatagtagctgaaaacttcccaagtcttgggagcttccagatccaggaagctaaaagaatcccaaatagattccattcaaacaggacccctcttaggcacattagagtcaaattatcaaaagtcaaagacaaagaattctaaaaacagcaagagaaggactggatgtggtggctcatgcctgttatcccagtactttgggaggccgaggctggcagatcacgatgtcaggagttcaagaccagcctggccaacatggtgaaactctgtctctactaaaaatacaaaaaaattagctgggcatggtggcaggtgcctgtaatcccagctactcaggaggcagaggcaggagaatcacttgaacctgggaggcggaggttgcagtgagctgagaccacgctactgcactccagcctgggcaacagagcaagactccatctcaaaaacaaacaaacaacaatgacaaaaagaaaccagcaagagaaaagcatcaaatcacctatgagggagttcccattagactaatagcagatttctcagcagaaatcttaccaaccaagagagaataggattttatgttcaaagtactaaaagaaaaaaaaaatctgccaaccaagaatattacatgcagcaaagatatcctccagaaatgaaagagaaataaaatctttcacagacaagcaaaaacgaaggtaatccatcaccactagaccagtcttacaagaagtgctcaagggagtattacatctggaagtgaaaagatcataacagccattataaaaacatgtgacactataaaactcactggtagagccaatatacaaaggaaaaagagaaagaaatcaagccttatcacttcagaacactacccaaccacaaaaataaacagtaagaggaagtaaggaacaaaggatatagaaaacagccagaaaacaataaaatgacaagataagtcctcacctattaataataaccttgaatgtaagtgaattaaatatctcattaaaagacatagactggataactagattaaaaaaaaaaaaacaagactagactcaactatatgctgcatagaagaaactcacctgacctacagacacacatagactgaaagcaaaggtatggaaaaagatattctacgcaaacaaaaaccaaaagcaagcaggagtagctgtacttatatcagacaaaacagacttcaagtcaaaagttgtgaaattagacaaagaaggacattacataataataaagggatcaattcaacaagagaatgtaacaactgtaaatatatacacattcaataccagagcactcagatatataaagcaaacattattagctctaaagggagagatagactcaaatagagtaatagctggagattctaacatctcactctcagcattggacagatcattcagacagaaaatcaacaaagaaacatcatatttaaactacaccacagaacaaacagacctaacagatatttatggaacatttcacccaacagctacagaatatacattcttgtcaacagcacatagaacatggactgaccatatgttaggacacaaaacaagtctcaaaaatttttttagaaattgaaatcataccaagtatcctatttaaccacagtggaaaatatcaataacatgaggaacatgcaaaatgatacaaacacatggaaattaaacaacatgctcttgaacagccagtgagtgaaggacaaaattaagaatggaattttaaaattccttgaagtaaatgaaaatagaggcacaacataccgaaacctatgggacacagcaaaagtagtactatgaggcaagtgtataacaataaatgcctacaataaaaaactagaaagatttcaaataccctaacaatgtatctcaaggaaactaggaaaacaagaataaaccaaacccaaaattagtaaaggaaagaaataataaagatcagaggagaaataaatgaaattgaaataaaaaatgtatttaaaaaatcaacaaaataaaagttggttttgtgtaaagataaaattgagataccattagctagactaagaaaaaaagagagatgactcaaacaaataaaatcaggcaagaaaaaggagacatgacaatggatgccacagaaatacaaagaatcattacaggatactacaaacaactctacaccaataaattaaaaaacctagaggaaatggataaattcctggacacatacaacctatcaagattgaaccaagaagaaatttttttaaaacctgaacagaccaataacaagtaatgagattgaatcaataatataatctgccaacaaagaaaagtccaggactgaatggctttcatactgaattctaccaaacctttaaagaaaaatgcataccaattcttctcaaactattccaaaaaattgaagtgagggtattctacctaactcatgctaagaggccagaataaccctgatatcaaaagcagacaagaatacaacagaaaaagaaaagttcaggccaatatccctgataaatatacacacaaaaatcctcaatactagcaaatgaaatccaacaatacatcaaaaagataatataccatgatcaagtggaatttatccaatgaatgcaggaatggttcaacatacacaaatcaataaatgtgatatatcacatcaactataaaggacaaaacccacatgataatctgaatagatgcagaaaaaaatttgataaaattcaacatctcaattaaaaactctcaataaactaggtatagaaggaaagtacctcaacacaataaaggccatatatgacaaacccacagctaacatcatacagaaaaggtgaaagctttgcctctgagaactagaagacaaggatgcccactctcatcactcttactcaacacagtactggaagtcttagccatggtaatcagacaagagaaagtaataaatggcattaaaattggaaaggagaaagtcaaattgtttctgtttgcagaaaacatgatcttatagagagaaaagcctaaagactaccaaaaaaaaacctctcagaactgataaacaaatttagtaaagttgcagaatacaaaatcaacatacaaaaatcagtaagtggtgtttctataaataatgaactagttgaaaaagaaatcaagaagacaatctcatttacaatagcaatccccccgccaaaattacctaggaataaatttaaccaaggaggtgaaagatctctaaaagaaaaactacaaaacactgatgaaagaaattgaagaggatacagacaaaggcaaagttatttcatgctcatggattggaagaattaatattgttaaaatgactatactacccaaagcaatctacagattcaatgcaatctctatcaaaataccaataacattcttcacagcaatagaaaaaaatcttaaaaatctgcatggaaccacaaaagaccctgaagagacaagcgatcctaagcaaaaagaacaaagctggaggcatcacactaccagacttcaaaatataccacaaagctgtagtaatgtactacaatgctgtttttatgatactgacataaaaacaaacacacagaccaatggaacagaatagagaacccagaaattaatccatgtatctagagccaactgatctttttttttttttccgaggcagagtctcactctataacccagctggagtgcagtgatgcaatcttgagtcactgcaacctgtgcctcccaggctcaagtgagcctcccacctcagtctcctgagtagttgggattacaggcacacgccaccacactcagataatttttgtagagacggggtttcaccatgttgcccaggctggcctcaaactccaatctgcccacctcagcctcccaaaatgctgggatcacagatgtgaacccagccaagcctactcatttttaacagaggtgccaagaatactcactgggggaagacagtctcttcaataaatggtgttgggaaactgaatatgcacatgcataagaatgaacctggacacccatctatcaccctaaggaaaaaatcaactcaaaatgattcaaagacctaaatgtaaaacccaaaaccataaaagtaccaggcaaaaacaaggaaaacacttcaggatgttgatctgggaaaagattttatgagtcagacctcacaagcacaggcaacaaaagcaaaaagaaacgaatgagattacaacaaactaaaaagcttctgcacagcaaaggaaacagtcaatagagtgaaaagacaatctataggagaaaatatttgcaaactgtttatccaacagaggattaatatgcaaaatatgtaaggaactcaaaatatctcaatggcaaaaatcataataataattggatggaaaaatgggcaaatgagctaggcatggtggcatgcacctatagtcccagctactcaggctgaggtgggaggattacttaagcctggataacatagtgagactctatttccaaaaaaaaaaaaaaaaaaaaagatacacaaaatatgtgaaagacagacaaatgatctgaccagacatttctcaaaaaatgacacacaaatgcgccaacaaatatatacaaattgctcagcattactaatcgtcagggaactgcaaatccaaatcacaatgaggtatcatctcattccacttagaatggctatcatcaaaaacacaaaataaatgcttgtgaggatgttgtgaaacaggaactcttatacacagatggtggaaatgtaaactagtacagccactatggagagcagtatgggggttccccaaaaaactataactagagctaccatatgatccagcaatccccctactgggcacttatccaaaggaaagaaaatcagtattttgaagagatatccacacccacatgtttactgcagcactattcacagtaggcaaaatatggaatcaacctatccaacaacagatgaatggataaagaaagtgtggtatacatacacaacggaatacaatttagccataaaaaagaataaaatcctgccattcacagcaacatggatggagctggaggacgttattatattaagtaaaataagccaggaacagaaagctaaacactgcatgttcttactcatacgcagaagctaaaaacaaaagttgatctcatagaagtaaaaagtagaacagagcacaccagaaactggggagagtagggagaagggggagagcaagagatttgttaagggacacacaattatagttggacaggaggaataagtttgagtgttctattcaccactgtaggatgactacagttaacaataaagtctccagtagctagaaggacgatatagaatgttcccaacacaaagaaatgaaaaatgtttgagattatgaatgtgctaattatcctgactggctcattatatattacatgtatgaaaacatcactatgtaccccataaatatgtataattattatatgtcaattaaaacaaaatgataggctgggtgcggtggctcacacctgtaatcccagcactttgggaggccaacgcaggtggatcacctgaggtcaggagttccagaccagcccggccaacatggtaaaaccctgtctctactaaaaacacaaaaattagctaggcatggtggcgggcgcctgtaatcccagctacttgggaggctgaggcaggaagaattgcttgaactcaggaggcggatgttgcagtgagccaagattgcgccactgcactccaacctgggcaacaaagtgaggctccatctcaaaaacaaaacaaaaacaaacaaaaaacaaaatgatgacaatgatgttacaatagcaataacaacagttaacatgcagtaagcatttgccctgtacagacacggctccaggtgatttatatatattcactcatatctccattatttataattcttctagccttgttcacatctcccatatcatccagaaacaattgctaccctattatttaaccttttatatagataaggtgcatatccactagacagaaggcagaaactgaaaatcacccttcgctgtacacacgctgtcccacaatatggagtgaacagctaatagcatatcacctactggcaacatatgaacagaaagtagctggaggattcaataatttttcattccaaaaacatttacttcgtagttattatatagtcggcattgctctcattaatgggcatgaagaaaaaatagaatatagacaaatggaccaaaatctccacccatacaaagcatagattcttgttatcggtgctgtttgcattctggtgggatgaaacaatgtgtaaaatgtgtgcaaactgtctaatgtcgtacttggaagatgttaactactatcataataccaattattgcatttttttacacagaaggcactaaaaaattttaaataaatctgtatatcacaaaagctatattaatttcacttttagtttagaactttaaagcctttggaagactatttcatgtagcaagagacaaacccaggcaaaactggaagaaaatttttgattccttagactaagattttaagcacagagttggtctcaagtatactaattagcatgccaaacagaagtatgactttcttccactttactaaaacgacaggtgtgtttctttgaagtctttctctctctctctctctctcattcattcattcatccattcatttatttgaaacagggtctcactctgtcacccaggcgggagtgcagtggtacaatcatctctcaccacacccttgacctccagagctcaagggatcctcccacctcagcctcctgagtagctgggactacaggtgcgtgcctctgcacctggctaattatttttattatttgtagagatggggtctcgctatgttgcccaagttagtcttgaactccagggctcaaacaagcctcccaccttggcctcccaaaatgctgggattacaggcatgagccactgtgcccagctggaagccttactttatgccattggcaccaaatagccaagatgtcaagattttggatttcttctctataataattattcaatttcacgtaccttcgaagaagggggaagaatgcaataggaaagggaaggaaagaagaaaattcacattcaaagcctatcccaactctcatatcatcttgcaagagccacttttcaaatcaggaattacacaggatttgtccatggtttactgcaaatgcaagtgggtcagaggtatgtaaagatactttgaaagtgcattagtaaccagctatgaccatcaaaatgagtatattgcccctgaggtgttattgctcctctgaacttaatgttggaaccagtcactggtagctcctgtgagccctagtgcatgcttttaaaaagctgttattcaaggggaaaaaatgtaaaaatatttttttcacaatctcaaaaatgacacattagaaccacagtcatatatatatatatatatatatatatatatatatatatatatatagacacctgttagaaaataaacacctgttagaaaataaaagtgacaatatgggcacaatttaatactaatatcaaacatacatcaccacagacatatatagaaaggatttcccagggttatctgattcccaaggctgaactgtctaactccacttctctctggtttgtttggtgtttctactttcctgatgccccaaacctatgaggaaatccagcaatttcactcactgaccttcactcagaaaagcaggtaagatcatgagatcataggtatccctggatgtacacccgattctcttttcatttggttttatgttcaatttaacatttggggtggtgcctattattactgttctaggtactaggaaaatacgaaaaataatatgaaaacataattcttgctttcaaggagtttataatcaaattgaaatgagaaactcaccaacatgaagcacactagttaaaataagagagcatctagctttgtatccctcctgggcaattccaaaaacctcttcagctctggttttctcacccataaaacaagcaaactaagtgggccaatggttttcaaccttctttctggcccaacacttgaggatatgatacccttgttattagtgacattggggagtaagtggggaagactcatcttggtgggagaaagcagatattctttttaatcctgcaaaagatgatttcctattgttgcaaattgtgaattagattttttcaatctcctctcaaatgttgtctcctcagagaggtttccctgactcctccatctaaaataacatctgtctctgtcactccttcaccccactcctccttatcttgcttaatttttctttatagcactgaagtcaccagccattatgcatttgtttgttttctgtctcccacgctagactataagctccacaagggcagggactaggtcttatcactccatcctttatcacattatggctggcataatggacactgaaagaaaaacatggaattaattattttttcagcaaaacccataaataaatgaatgaaatcaataaggagagttgtcaggaaattacagtatcacacattggtgctataatatgttttgtgatttcaaaggcatttcacaaacattatctcatgtgaatcgcacacagccctgtgtgtaagtcagcacaggtattactgacaagaaaactaaggcagagacatccagtggcttcctcagggccacccacctagtggcagagctaagggttcagcccacatcttgtgattcttaacccaaggcatttcctttctaccacttcagaggtttcataaaggtaaggaggttgagcacagtagttcacacctgtaatcccagcactttggaaggccaaggcaggaggactgtttgagcccaagagttcaagaccagcctgggcaacaaagcaagacccctattgtaaaaaaaaaaaaaaaaaaaaaaaggcaaagagacttaaggcagccttgaagaatgcgtgaggtttagtgaagaaaggaagagatggtaaggcattccaagaaaaggcaaaaacacgaatgagtctccaggaccaggaatgtgtaccacataaacatgtgtgatgtaagagtggagagtgggcaaaatttgggggggctagatttagaattaattccgaggtaggtagctacagtgaccctccatttgttctaataacttatcctcctattatcccaggatctcataattttaactttctactagttcttctccatcctataaatcctcaagcaatgactttctctcctatttgcagccaaacttccatgaagaataacctatgctcaccaactccacttcctgacccccgttcactcctcaacccactgcaagccaacttctacccctgcacgaccaaaatcttctcactcacagcctcctcactgccaaacactcttcccaggtcttaccagacccctcctccaggccttaccagacccctcttccaggcctcatgtgtcacagctaagcttattatccccctttccatgaatcctctcctctcttggcttcctccacaccactctctcccactgacagctccttctctataatttgcaggtacctcttcccccatctgcctctgaaatgtgggttccttgggaattcgacttagatctgctcctctcacggtattgtgtttctctgggcaagtctatctgtgctaggggcttcaggctgtaggaacagatgctagcagccaggcgtggtggctcatgcctgtaatcccagcactttgggaggccgaggcgggtagatcacgaggttaggagttcaagaccagcctggccaacatggtgaaaccccgtctctactaaaaatacaaaaaattagctgggcgtagtggtgggcgcctgcaatcccagctactcgggaggctgaggcaggagaatcgcctgaacccggaaggcagaggttacagtggagccgagatcgtgccactgcactccagcctgggcggcagagcgagactccgtctcaaaaaaaaaaaaaaaagaataaatgctagcaatgcttaaagacattcattctatgcccagcacatatgaaatcagacacattcccttgagtcattatggtggtgaattctgaactaggggtggggagggacgtgctctccttcctagcaggacaataccagaatctggagggtttggggggagtagcacacaaatagttaaaaagaaaccccacatataaaaacattcaggcaaagcacgtcctcccaccccttacctgattgaaaatcacggtgctaaacagacttacaaatttgtctctacccataatatctccctacaggttctttatctgcatttgtgtcttttcatttaaaaatctccaactgggtattcctccccaaactcaacatatccaaaatcaaattcatgactctcaccccataagctgcttcttctcgtacgctctctattttggtgagcagcatcactgtattcccaagtcatccaagccatttttttttttttggtctcccttctaaccacatctcatcaacaaacaaggcctccctcagagatggttctcacatccaagccctgactgccctccccattggtactgccttggctcagacacccatcacctctcatgtacaacatggttacagccttctgatcggtctccttgtccccagttaccctcattcaaatcatcctacactctgctgcaagaattattgttcttaaaacagagatctcaccctatcacttccctattcaaaaacttccctgactccccagaagctacaacatggctacgatctctctacgacatcatctcctcaacatccccgcttccacaccctacttcggccctccagactgctccccaccgctcagacaaaggcaaaactttcacactctcatgtttttgcatgagtctggagtgtccccacccccaccccctttgtccatctggcaaaattctattcattcccctaaggttcaactcaaatgtcaattctgctgcttaggctttcctgatccctagccccatcccccttcccttgaatcaatcactcgctggtattcccatggtgctatgttcacaacctctaacgtggcatttatcaagcgggattgtagttagttatttactcatctgtctcccttcctaaattatgagctctgtgagggaagaggccacatgacagttatgtttatatccccaggaccaaaacacagagcctcggaatatgccagagcataagcattcagtaaatgtttatgaaccagaactaggaaaaccattgaggtttttaagctctctttcttaaaaacaaaatgagagaagcatttaacatttttatcttgaaatgttttttaaaaatcaagcaaagcaaaacttaatcaactgctacctgccttcaagacttcagcagcaaagactgatactgtttgagcagatggagagaattacttgaaagggaatttggtcagtaaaacaccttgtagctcagcctcacttttggaaatgacaagtaagaggcatttttcctctgcaaaggaaattaaagaaaggaaatgctaaatactatgcttctgagcttagaacagacttgaatttttttaataaatgatttctatccatattatttcaagatgaaacttttcaaataaatgaaacttatcaaataaatgccacatcagtaaatacgttagatatcttgtcttatcaagatttaaccaaaaagtttcacaatcacttctaaagacataaaatgatttcattttcatcccccaaagaaaatgatgtacattatttaaattatgataatatcgggggggtgcacagacaatccatgtctttctacagacaaatgaagttgaagcttgttagagttcataggaagggcgttcttatcaactgaatacagaattgaaatagcagtgaattccaagaagtagctttctttagcctttcttagcgtttcaaaaagatgtcaaagtgactatataaaatgtttgttttgtctggaaaaaatatcagtgtttgggcattcacagaccacagggaggtttgcagttaggatgagggaagatatttctggggtgtgagtgagctgagtctgcaaagcttcgtaactagacttgcctatagatttgaaaacactcctatgatataaaagggtaattcctttttcagaactttttttggtagttcctttctgtgaatataaagatgcacagaggctcaaatttcaattagaaatagattctttgacagaaattctttagagacgaagtctggcaacaatacgcagactggattacacggaagagaggctgcagtcagagaggcaggccaaaaggccagtgtggtaatttaggtgggaggtaacaggagtctggacaagggaagtgacaagagggaacagagagaaagggacaattaacatagtggctcaagggaaattccacaagtgttgatgaatagactggatatagggaataaagattgccaaacctatgtgacttgaagaaattgacacgacttcaggaaaaggaaattttttcattacctttcaattttcaacacagcacttaataacaatcccagagttaaactggtccttcaagagatcatgattatgtaggaatatctgtagccatatttactaaactgttaacatctttcagtccaatactctgtcctactcttttctgtatcccatccacccttccatccatccatccatctgacaaacactgaatatcttctatgtatcaggcactaatctagtgacttgtaagtgaacaagagagacataaatacctgacctcatggagctaatactcaagggacaataaatgcctaacattgtgccgactgcaaagttgatactcaaaatattttttgttcaaattgaataatctccattgagtattagtccagaacaaataagaatcagaacaaggaaaatatcttccttacataatatccaaggaaatttcactatagcacctttaaaatctattacaatcaaatattgttctaatttaaaagcaatcctattttttcctattcattgcttgccaaatttaccaataaaaagttttaacactaaatgaaaaccttgatgaaacagttcacagaagaatagaaatacagggtagaaaaggccatcatttttttgggtctccaactcaaatttcaaaaccccagggcactgctcctgagagtcacacaggccatcttaagcaaaaaacaaaaccaaaaggaacacttctgtaccttaaatgtttgcaaatcatggtaccttaaaagtagaagaggggcaaaaaggggtgatacacaaaaaacaagaattccaagtaaaagatgaatgagctgctctaccatatttatggtgactgagagccatctgctggttacagtttagttacaacagtccaggagggccaactattgcaggcagcttctctattacatgatgcatgcaacatgcttagaaacacaatgcactggttctcactcctgtgaggaagcttaaaaaagtttcctatcggccgggcacggtggctcacgcctataatcccagcactttgggaggctgaggcaggtggatcacgaggtcaggagatagagaccatccaggctaacacggtgaaactccgtctctactaaaaatccaaaaaaaaaaaaaaaaaaaaaattatctgggcatgtggcgggtgcctgtagtcccagctactcaggaggctgaggcaggagaatggcgtgaacccaggaggcggagcttgcagtgagccgagatcgcgccactgcactccagcctgggcgaaagagcgagactccatctcaaaaaaaaaaagttgatatcatacaagcagtgagtaggatagtggttaccagaggctgggaagggcaagaggttgggggaaggaaaggttggttaagggagacagggaacagctggatggcagaagtgagttctggtgttctgtggcatactaaggtgaatacagcaaatgataatttacagttttttgaatagctagaagagaggattatgaatgttatcaacacaaagaaatgatacaggtttgaggttatgggtatgctaattaccctgatttgatcattacacattatatacatgtatcaaaatatcacactgtaagccaggctcggtggctctcacctgtaatcccagcactttgggaggccgaggcaggtggatcacaaggtcaagagatcgagaccatcctggctaacacagtgaaaccccatctctactaaaaatacaaaaaattagccaggcatggtggcatgtgcctgtagtcccagctacttgggaggctgaggcaggagaatcactcgaacccaggaggcagaggttgcagtgagccgagattgcaccactgcactccagcctgggcaacagagcgagactccatctcaaaaaaaaaaaaaaaaatcacactgtaccccataaatatgtacacttatatgtcaattaaatatatatgtacatatatatatacacacacacacatatatatatttaaagagaaacaaatgcgcaaaagtcaacagaacttatataatatgagggagttggtgttcctagagccatgcctttttgacaccatctgcaataacaactctccatcttcttccagttggttcttcacaaccaaacacagttatgataaatccgttgagtgtccagtcaagatgagcaatctacatttgctttaggcattcggcatacctaatgatttccatctttgtctcaacattactgttttcactttactgtacttgtttccattctcactcattttataaagtaaaggtaaaatgcaataaaatattcaaccaattgtgcaaatcaatactgttctatgaacaaagatgtgagttcagtgaaacaaaattatcagctggcaagcagtgccaccatcaataatattaatagaaatgtgtgtttggcagctgatatacaaaaatccaaattaggcattaaaaggccatttaagagtgtcaatgaataatgcttatgcattcaagatgcacaaaagccaaggaccacctacatcgtccatttttcacctcagtgaccttactgtttattataccaattcatctaactcatgtctaaagacaacaaattttgagatggacacccacattttcaattctggcatcttttccctctggaatgtgtaagctccctcgggtaacttttatgcaaccagttgggtgccaatgtgcggactgatatggaaattactgttctaaaaagacaggattcaagaagatacacaaggaggaaaaacaacacatgatgtacaaatttctacccacttgcggtatcaatttctgtctcagtcctttcaggctgctataaccaaatacctcagactgggcaatttataaacaacagaaatttactgctcacagttctggaggccaggaagtccaagagcatggcataagcagatacggtgtctggtgaggactttttctctgctccatgggtggtgccttctacatgttctcatatgtccaaaggggcaaggaagctcccttcaatcttttttttataagggcactaatcccattcttgagggcagagtcctcatgacttacttccccgaaggtcccacctcttaatactatcacactggagattaggttctaacatatgaatcttgggaggacactactattcagaccatggcaaagggtgtcaatgaataatgcataccattcaagacatacaaaagtcaaggactgcctacatagccatcacttccacctcaataaccttgatttgctattattacaccaattcatctacttcatatctaagaaagcaaattatcaagatggacacctattttgatttgttttgttttgttttgtttttgtttgtttgagatggggtctcactctgttttttttttttgagatggggtgtcactctgtcacccaggctggagtgcagtggcacaatcttgacttactgcaacctcggcctcctgggctcaagcaattctcccacctcagcctccctagtagctaggactacaggcatgcaccaccatgtctggctaattttttgtattttgggtagagatggggtttcaccatgttgcccaagctggtttcgaactcctgacctcaagtgatccacccaccttgacctcccaaagcactgggattacaggcgtgagccactgcgcctggccaacacccacgcttttaactatgtcatcctttccctctgtgagcagggcccaggaatgtataagctccctcaggtgacttttatgcaatcagctgggcaccaatgtgcagactggtatagaaactaccacccttgaaaaagcaggattcaagaaagtacgcaagacagaaaacacatggtataaatacatggtcttctcagcctccccccactgcccacattgatttctccattttctcttttctttttttttttttgagacggagtctcactccgttgcccaggctggagtgcaatggcatgatctcggctcactgcaagctccacctcctgggttcacaccattctcctgcctcagcctcctgagtagctgggactacaggcgcccgccaccacacccagctaattttttgtatttttagtagagacggggtttcaccgtgttagccaggatggtctcgatctcctgacctcatgatctacccgcctcagcctcccaaagtgctgggattacaagcgtgagccaccgtgcccggcccagatttctccattttctaatctcccagatcatttatggctcatatcacacaaagtggcatttcactatacactatcatgtatggtccagagttgttttgtgcaagatagaaagacatccccacatggcctgctatctctgtactcccttctgctaagacggtgagtgctatcgttcattaatgtctatagaacactttccagtttacaaagagcctccacatagatttatctcatttgaacttcacaacagtttgaggaatcatggttaccttcattttcctgacaatgatgtgtagttaaaactcaaaccctggttgtctaataccaaatcctttgctccttccacagaatgacacaaggcaaacttagcaatatgccacacttgaacacctggtggaatactgtccctacgaacagggtaatactgtccctgcaagtgtgaaagacgaagtattcaaagccagtgggaaaggaatacatgagggcccctgaaagggaatcatggtaagatttcaaaagtacgagagacaaagcccaagggacaaaacccagggcaaaggatgagaggacctgggttctagttctctctcttccattgattcaccatgggcacaacgacttctctaagaatcagtctcctcatttgtaaaccaaaaaagtaatcgcttgagttataacaccgtatcagaaagaaaaaagtcaaacacacatgggagcgttgaggcctaagaccgcccccacccgccactccacatgcatcctacatgcacgtcctggaaccaacactcatgtatgcttaggggtgactgtaatatatcaaaaattgctcggtaaacagagaagagaaagagggagaaataacttttattttcaacaaacaagaacaggctttttaatttcttaaaaatttttacttaaagaaaacacaagttggaaacattttttaaaattaacaggctcacgcctgtaatcccagcactttggggggccgatatgggctgatcaagaggtcaggaaatcaagaacagcctggccaacatggtgaaaccctgtctctactaaaaatacaaaaattagccaggtgtggtggtgcgtgcctgtaatcccagctactcgggaggctgaggcaggagaatcgctgggaggtggaggttgcggtgagctgacatcacgccattgtactctgccctgggcaacaagagcaaaactccatctcaaaaaaacaaaaacaaaaaaaaagtaacgtaatgaggccaagcatagttcacacatctgtaatcccagcattttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcgagactccgtctcaaaaaaaaaaaaaaaaaagaggctgaggcaggaggattgcttgagcccaggagttagaatccagcctgggcaacagagagagaccctgtctctacaaaataaaaatatattagccaggcatggtggcatgtgcctgtggtcccagctacttgagaggctgagttgtgaggatcacttgagcccaggagttgcaggctgcagtgagctgtgatctcaccactgcactccagcctgggtgacagagcgagaccctgtctcaaaaaaattaaaattaaaattaacataatgaactaaaatacagcgtgattaggtaattctactttcttcttcccgtttattcagaaactggagttttccttctttttcaattctcaaatgatttttttaaagacttaaaattaatacatgcaggggcaaagaatgtttttattttccataccaaaagtcacaactataccagtagttaagggctgcaattcaaaagaagataccattttttacccatcagagcaacaaaacaaaatccatcaagttctgtaacgcccactgacagctaaggtttaaggaaaggggccctcacacagattgctgaagggaatgtaaatgccacaacttttaagaaaaagacatggtggtacctattacatctttaacactcataccttttgtcccagtaaccccactttgaggactctattgctaaagaaatagaagccatggtctttaagaatatttactgcagcactcgttgtaatggcaaaaaactaaacaacccaacgtccatcaaatggggagtggctggaaaaatgcctgcatatttatattgtggaatacaactgacgaatttgtcagacacatcaacttggaggaatgtccaaatttaagtgaagaaaagtaaaattacagaggaaaatgtatagtacagttctgttttctttaaaaataggaaaggaaaactttttttaggtatgtatgtttgtaaatttatagttgtataagcatagataaatgtggggaagggaaactccaaacagccaatcctggttacttgaggagaaaggcactggaggggcagaaagggagagagagtatgaacttttgagttacacattggtatgttttgacttttttgacacggactctcgctctgtcgccaggctggagtgcagtggcgcaatcttggctcacagcaacctccgcctcccgagttcaagcgattctccggccttagcctcctgagtagctgggattacaggcgcgtgccaccatgcccggctaatttttgtatttttagtagagatgtatttagtagagagtagagaccatgttgtccaggctggtctcgatctcctgacctcgtgatccgcctgcctcaacctcccaaagtgctgggattacaggcgtgagccactgcgcctggcttttttgacttgttataatgtgcatgtatcatgtggattgcctattttaaacccaattacagggtcatttccccatgatggaagcagggagggaatacggaaagggaagaaaataggaaaacaaagatctacaaaataaatgacaacttaagtagaaactattagaaagaggtattaaaagcatccctcttcgttaaaaaaaaaattaagaataggagataaaaactaaaatcaagaaatgccaaaatcatgcatatttttccagagggaaagagaaatacaagagaaaaatatgaaagaaaaaggcaagaaaagaaggcgaaagagagagaaagaaacaagaataaatgaagtggggatcgggcagaacctacagagtcattacgggggaaatataaaaatgacaaactggcttacagggacatggagggaagagggaaaccgttacagaaagaactggagggtgatataattcctttcctaaagttaagcagtattaataccagcaatcttaacattctgtcttaactttatagggagaaaaaccctaacttttcaaaatctagcaactgggatgggctaagtttgcccttctgttgacttacatctccatcttgtggtctgttcaggacatagctcttagagagagagagagagagagagagagtgtgtgggtgcgcacacgcatgtgtgtgtatctgtatgcatatgcatgcaaatatatgcaaatatgtatgtatataaatataaccatatctactcacatgtgtaatacatgtacatgtagtatataaatgcacatatttgcacttattctttaattcaagtagaacttacaaacagaaaaatccccagtgtacagctcaaagatgattcacaaagtgaatacccacagttaaccactacccacagcaagaaaaagagtattaccagaaccccaggagccctgtcatatacccttctagtcactacttcccccaaagggaaccgctttcgtgatttataacactgtaagtctcacctttataggagtggcatcatatagcatgaactgtgtaaactcttctgtctgacatgatgtctgagatccatccatagtgtggtgtacagttgtagattgttaattctcatttgctgtgtgacatcattgtatgaatatgccatcatgtatttattcattatactatagatgttcattggattatttccaggtgagactactaagaaaagcactgtaaacagagacgcctgtagtctcaactactctggagactgaggtgggagaatcgcgtgagcccaggaccttgaggttacagtgtactatgattccatcagtgaatagccactctactccagcctgggcaacgtagcaagaccctgtctctaaaaaacaaaacaaaacaaaaaatagcactgctaggccgggcgcagtggctcacgcctgtaatcccagcactttgggaggctaaggcgggcggttcatgaggtcaggagatcgagaccatcctggctaacacagtgaaaccccgtttctactaaaaaaatacaaaaaaaattagccaggtgcagtgacgggcgcctgtagtcccagcaactcgggaggctgaggcaggagaatggtgggaacccgggaggtggggcttgcagtgagccgagatcgcgccactgcaccccagcctgggagacagagtgagactccgtctcaaaaaaaaaaaaaaaaaacagcactgctataaacattcttgtacgtgccttttgtatagttccatttcagcaaatacagttttccatttcagcaaatatggttttccaaagagattgtacaatttacagtcccagcagtagtatatgagaactatagctgctccacatcctagcaacacttgacatgtctgtcattttaattttagccattcttgtagtataatgacattgtgacttgactttgcatttacttgatgactagtgaagttgaacaccttttcttacattcatcaaccattgaatatcctcttgtgaaattcaagtcttttgcctatgtttttctaacaggttgcttgcctttttcttgacttatagggattcttcatatatccaagatacatttcctatgtcaaatattaatatatgccctgcaaatacagattttcattctgtgacttgtctttcaatcattgtggtatcttttgataaaaagaattttttgttttaatgaaatccaacttatcacttgtttcctttatggttagtatgttttgtggcctgtttaagaaatctttggctatcccaagatcataaaaatgttctcctgttttcttctaaaagctctctggttcaacccttcacatttagatctataatccttttggaattatttcttatgtagggtgatagcagaggccaagattcatttttttccatgtggatatccagttgacataatgccatttattgaaaagattacctctgtcataaatcaggtgacaatatatgtgttagactgcttctgaaccctctcttttgttccacgggtttatctgcctatccttgtgctaacaccacactacagctttgtggtgagtctggataactggtcatgtgagtcctctggcctttttgttcttaaaaattgtctcagcttttcttatctctttgcattaaccatataaacagtggctgtaatcagcttctcaagtggcaaaacggaaacaaaaatctggctggggactgtaagtgggtttgctctaaatctataaatcaatcttgagggaactgatgactttacaatattgagtctcccaatctctgaacaaggcacagagactgaagagatctgagcatggtaagaccccaccccgacttactcaaagtttcactttccagagtttcagttacccacactccgaaaatattatagacaataagatattttgagagagagagagagagaccacattctcataacttccattacagtattaaactttaccatgggtatatattcacaagtaaaaatatagcatatacagggctcagtactacccaagctttcaggaatccactgagggtcttagaatgtgtcctctgcccttaagcaggggactactctttatttatctcttcagctttacttaatttccctaaataatgttttatagttttcagtgtagaagtctcatacatctttcattttacttatttctacagatttcatgtttttttttttaaagtactatgacagcagccttaaaattttttcatttgatttttctttgttgtctagcttttaaaaccttctgaggagagaaactaccaggttgctactgctaaccacgtgtggacaggctgtgcttcattttctttcacatggtaatggctggatacctttcttgacttgatcaatgacatggagttgcaatgaccatttgttcagatctcaaggtctctggttttctttgctccatcagtcatccaaagagataatctttctttacatttagtctctatttggaagtcaggctgttaatagagcttcctttcctatcccatggtgagggaaaaaaaaaaaaatccggactaagtagctacagagatctcttctggcgataatcagtcttgtgagaacatacataacctaaaaacttcgaatagctactctgtcaagttcgaaggtagtttcaagatacttaagagtattactttaagccttctacttcgtcatctccaagatacactgttaagtaaaaaagatgacgtgcagtaaagaatgcatattatattataattcctgtttttttaaaaaacacaaacaagttggaatagagactggggatatgggcccgtgcatgtatccttggatacgtgtagaatccttctggaagggcacacacacagaaaactgttaaaagtggctgcttctggggaagaaaatgggaaactgtaggtgagaagtagaaagagcctgaattttcattgattacaattttgtacagtttaacaatgtaacaaattactttaaaaataaatttatatttaaaaaacattcttcaaaaacaaatattcattcccataaaccactggaatggtcaacattttgacctaacactatcaaccaaaccgactcttccaccaagaagagtcccaaaaaatacctcatcatatgacatatctagtttctctctccaagaaaaacatggtcactgtacacattatatggctggtatcagaccattagttaagcgtattaccctaaacattctgcttcatcgtcttcaatatatactgtgaagcaaaaaaaagatgatgcagcataaagactggaaaaaaatgtgctaaggcaacatatattccaaattttttttatcagttcctacttcaaatactccctttgtcattctatcagtccttgcaccaaattatctattaacatttcaccagaatgtgtagaaaaagtcagaagctactacttctcaaaatagaattaaacaagaattaacaaaatatatacaagattatctgtctgcagaagaaaccagctctatgaaactgtatcaatgtgtcacgttaaaattgcttgcaggctggtcacgatggctcacgccttgtaatgccacggctttcggtggccgaggcaggtggatcaccggagttcaggagttcaagaccagcctggccaacatggtcaaaccccgtctctaataaaaatacaaaaatgagctgggcagggtgatatgtgcctgtagtcccagctacttgggagctgaggcaggagaatcactggaacctcggaggcagaggctgcagtgagccaagatcgtgccactgctccagcctgggtgacagagtgagactccatctcgaaacaaaacaaaacaaaaaaaccgcttgcacttcaaaagtacttctcctaagcctcttcaggaagacaagtgataggtgtaaacatcccagcttctttaaaaagtgaattgaagacttaaagtaatgactaaggttcacttgagcctaaataaaacaacccaaaaggccagcgagtgactaactctctgggatttcaataaaaggagaagtgacaagaaagaaggttcttaatgaggtcaaagaattgaaccttgagtctctggttcttcaagaaacttcaagaacagcgttgctattgcttagggagttgcagagaagggttgatacagacactacaacttgcctacccaacatcagtatgtctcatcttccttgttatcagaacctcaattttgttcagggctccactgctcagagaccataacctcatcctcattttcagctcaagaatatctccctcctgaactaacctagtcaaccacagcaaccccattctcccatcgtttttggtataacatgatcatgtgatacaatagtctatttctattttgagccagagtcaattaggcagcttccaggaagcatttcattgctctttaaaaagaaataactgaaaaatacaaaaaaagccaagataaaaaaatgctaaaagctattagagaattaagaaaatggctttaatattaataacggacattaattattgatagttttcatataaacaacaacaatagaaaagtacaatttaaaaaacctggatttaaaacagcaaccaaaaagattaaaaaaaaaacaaataaatttgaccaaaaacatgttagacttttgtgaagaagacgttactgaaagacctgaaaaatgccttggagaaacaaacaaacaaacaaacaaacaaacaaatcccacaatcttggatgagaaaattcaacattgtaaaggatttcaagatttaacacaatcccaattgtttttaaaagttgttctctcttttggaattacattagctgattctagaattcatgttaaaaaataagcaaaactcggccaggcgtggtggctcacacctataatcccagcactttgggaggccgagctaggcggatcatgaggtcaagagattgagaccatcctgccaacatggtgaaactccgtctcttctaaaaatacaaaaattagctgggcatggtggtgcgcacctgtaatcccagctacttgggaggctgaggcaggaaaattgcttgaacccaggaggcggaggttgcagtcagccgagattgcgccactgcactccagcctggcgacacagtgagattctgtctcaaaaaaaaaaggcaaaactcttaaaaagaagtttaatggcagatttgtcctatcacatattaaaacttaaagtatccatattttagaaaatgtggtactagcacataagtagacagaaggaccaatggaacacattacaaagtccagaaatagatcaaaatacatatgggaacgtattctatgataatgcagcatcttacatctgaagatgagaagatgaactactaagtaaaaaatatcgtcagtcacaaaaatagaatagagccaagtaggaaaaacgtaggattcatactcttcaccaattaaattccaaatggatcaaagatttaacagttataaaaccacagaagtaccagaaaaaagcacaggagaatttctttataaccttggttcactatagttatatataataattacataaaactctactaagatattactatataaaactctctttatatgttagtctggagtaggatacaaaagtttaacaactttctttgggaaagactgttggaaaacaggcactcacctaaattgctggcacaagtctagaggggttctaccccgctagaaaataacttgtgaaatgctattgaaattacaaacgcacataccctctgacccagccatcctacttttttttttttttttttttttttttgagacggagtcttgctctgtcacccaggctggagtgcagtggcgcaatctcggctcactgcaagctccaccttccgggttcacaccattctcctgcctcagcctcctgagtagctgggactacaggcacccgccaccacgcctggctaattttttgtatttttagtagagacggggtttcaccgtgttagccaggatggtctcaatctcctgacctcatgatctgcccgccttggcctcccaaagtgctgggattacaggcgtgagccatcgtgcccatcctccagccatcctacttctaagaactcacctagagatatactttcacatatgcaaaatccctctactatatttttgtaatagaaaaagactgaaaacaatactcgcatatatataagagcctagttaaatgacagtaaatgcatacaatgaaatattataaggctacaaaaactaatgacaaaaccttacgtcacgattgggaaaatctccaagatattcgatcaggtgacaaaagaatgttgcagaatgctatgtatgatatgttaccatgtgtgtaaaagatggagggagataatatattcctatttgctggtatgtgcttaagagaaccctagaaggatatgccaaaaattattgagagtaattacttatgttgaggagaaggagacatagtgggaagatttttcactgaatcctgttcaatgctttgcagatttcttagccatatgaattatattacttatgcaaaacacattctcctttctcttctattgttatgcttggagtgtggctgggaactgctgtagctattctgagaccacgagaggagtcactcggaagggaaagccgacatcgagtatcgggagatgaagggaaatgaagagacagcaactacccgaagccctgacggcatcactgggctgtcaatcaaccctctcacttctctaacttgcaacttacttcacgggatgtttttccctatttaagccattttgagcagggtaatctgttatatgtggttgagagcagccaactgctatactagtctagagagctaaacccaggcacccccttaacaatcgtcagtcagagtgggtcaggacaataagcacaacctgcttttccagactcctttgtcctcctccctgaatgctgaagaaacaaccttcccttctggtgttcatcacacttctacacacccatctgcactaattccactgtgctgtgatctgtctttgtatacatttccccttcctgagtaaactctgaactctgcaagaatgggcttattattatttttttttttttgagatggggtttcactcttgttgcccaagctggagtgcagtggcacgatctcagctcactgcaacctccaccttctggtttcaagagattctcctgcctcagcctcccgaatagctgggattacaagcgcccgccaccatgcccggctaattttttttattatttttagtagagacggggtttcaccatgttggccaggctggtctcaaacccctgacctcgtgatccacccccgccctggcctcccaaagcgctgggattacaggcatgagccaccgcatccagccaagaacgggcattataaatgacaaactaatccccccatgggcacctcttagcccaccttgcgtggcttcagtaacttctgattctaatcgttgctcaagaagaaagcagcaaggctgcaccaaagctatttgtctttccatcaaactacccaaaataattagcgaggcagagacaaagctgcatgcttcaccaggccctcctcttgagtatacagaaagactacatcccccagccgccctcagagctaggttggagccacgtgactagttatggccaaggggctgagtgtgtgaaacttgcaggccaaggcatagaagacagatgtgagttctccacaccctcattcttctccagtcacagggaacacgcacgccttgtgtcatgagagcacagcccagagatggaagcaacctgaagctcggagtcacctttacgtgacagactttacacgaggcaggcaaaaaagctttcatgtattaaaagtgtgacattcgcaggtttgttaacacagtctatcacgtcctggctcaatctttctgtcaacaaacatgtgctgaatcaacaacacacctgctgtatacccaactctgggctggatgttacggaagatacagaaaagtgcatgaagacgctcattcattgagcaattacttattaaaaattgtgctaggctttggtctctgtccttgaggtatttaaaatatagatcaagagacaaaatatacacttgcaaaagagaaaagcagttaagtattaaccatacagtctccctagctaaatcagcttcctattaatatgctctcaaaatacaatctatttttttgaacttattttactgattgtatgattctttatttcatgtctgtctctctccctggactgtacatggctcaactgcaaaaagtaggtgcttttgtagttttggttttaccactacactcccagtatcagtgtatagcacatagtaggcactcaataaagatctacttaatgaaggaaggtttgctttaccacatttttacttccttacctatttttcattaaactagcaggaaactgtaatattcttgactgtacttagtaactccttggggttcaactgcccctacactcacgtagaggacaaagcaaatctgtactgatttcagcacacccttgcacatcagaaaagctaggacgtcactgtatttcagggacatacataaaagagagaagggggtttatgatatggatgtatattccttagcaacttccttcttctagaagagtaggttggtcacgtggtaacaacattaagcaatgtgaagtataaatcaatgattctttaggaaatctaagtactatgggacataaatcatccttcttgtaaatcaacatttaaattgaaataaaacattcaacggtttcaaatggggaggagcatttttaatgttagaatttaatgtaaatttttcttttgcccatcttggctaccgatatactgatatgaaatacacattggaaatatcatgttttgtcagtagtgcaagagaaaagcctatctctaaaattaaatttaaaaatctgcactctgagaaaacgtagacgtttcattatcatcttcttttgattttagcaattggtctgcttgttaatatatccttcttgacatacaactaccacctcaaactctaaacaacttcctattccctataatcctctacagagttggtggtgtgaagattaaagcttagccaattagccacccactgcagctgagttaatcacataatctttgagatggtcacagagcagtggagtatgcaatggttttggtttttttttttctctttacaggcaaagatttaactaattgtgagatttagcaatgctctcgaatataaagggcgggagggttttaaatcagaagctgtgtcactgctttatgagacagggcttatcttcttctaagagacactgttgcacagagacttctttaacaagtttccaaataccctaaattagtcaaccattgcttatttagaccaaggcttactgctttagaataatgaccagtaatccgtaaggtaaaactaagattctgtcacatgacagctatacattcaattatgtgattgccacattaatgtctgtttaaaggaaatgctaatccaaactgaagtttgaccattcttgactctccttaataaggccacatatgaggaagaagagaaaagagggaaaagagggatggaaaggccctcgggaatgagggatggggaagaaagagaggaaaagagcgttgtgcaaagtaaatgaaaaagagggaaacagaggtaggggctctaggaagggaggctcaccaggttccaagcgagtcctggtagggtaaacagatcttgtggcattgctgccagttactagggaaatgttgattagcagattaaccccagttctctaacagtaaatgtgttgtggtcatggtctagcattcctgacaaaatgtgccatagtgagcacgtctataacatttcaaagttctgacaaggctttctggccaccatgcttctggaagtcatgaattaagggaaagacacctaccctccactcacaaagtgacaaagcaacccaactgaccccccccaccccaaaaccaagaactacagaagcaaagaaaaatgctggaggaatccagagattagagaagcaaacgaaaatgttggaggagcctagaactaggaattaactgtagagaggactaaggaaatctctgcaagtcattggagatactacagaaaccaactggcagagaaaggaatgagtttctccaaagatagatagagctgagcgttccctaagagttggtattagaaatgactaggcaactgacaatcaggagggaaggggatacaatcgaattgtaattgaacatgtcatataatgaacaagtcatgtttacaactgaattaaagtccttggaaggctaggtccaacaagagaactattaggtatgagaagttggggaaagaaggggaggtctcaaggatggggattaggagtaaagaaggcaaaaataatactcttacataggcaggtgaaggaaatcaaacaacagcaactctgacctcaaatctaagaaaatccacttccagcagtccacttcagctttagcattcactcctccatacacttcttgctggtcctcgataggtccacatggtgccatcttccctgactagttggagcaacgctagctagctgggtatttgttctcatggcccttgagcagatttcccggggacttttctacatagcttatgagagtgcttttgtctagtatgaattttcttattgatcagacttctctggaatgtctacaggacttgcactttttggacaagcatatgcggacatgttcccgttacggtgttgggtctaaagcaatcctagcccaacaaggaatcaccaatggaagtgaatgagaaattcaccttccaggccaccgacatcattctccttcctctctgtatctgcaatgattttctttcttcatggtgctcaatgtccagtcgccacattggtttcccgctcttggccagactccatgtcatccagaacggaccatcattgtgtgttatgtccacgtctaccttctccaaatcactccacaggagtcatttctccttgacagtacttacattatttttaaacagaattcttctagaaccttattctgaaccatcctagacttctggtcctgaacagaaaagatacaccaatctctatgttgcccttggtttcatcttgagagcatgtaaataagtctggccagtaactttatttcaaccctcagggattcagttacctttgcttgacagtgtctccccagtatgatctctgtccccatgccactcagccattcaccaacacaccaacaagcaacagctttagtccaccacatggatcagccttatgggcatgaagagcagaaggcagtcccagtggcaggacccaagaggtcctcagaaggcctccatccaaaaaaaccacctgacactaacctgccaaattccctaaacattcccatcaactaattcactgtggtttcaatcctagggtttaaggaggtttcggtgaaaatacctccagaagacaagacattggcagccgttgattccactgctagaattaacatgagattgttcactaataagacaataggcagcaagctgggcacggagggaagcagacacggaacaaatgagatgtggaagaggagaatggagggcagaggaccaggtgcagcgtatgatggggtcagacagaccacgtccttctagagcaatcagggggcagggcacgagggacagaagatctccgaagcaatgaggcagcctgagttccctcctagccggatggagacacaatgctccagtaataacatcttgtatttataaaggtcttagagtttacaaagcctgtctcatagcaatcacttcatctggtcctaacaacaacgaaaaatgggcagcacatgtatccccagtctaaggtcaatgacttcaaagcccacatgactgacagactagaaagctacagaactgggtccttctaacacctcatccagctctttttatggtgcaatggttacaagttcagagctaaaatccaagttctatgactgattagctttagaatcttgaaccctctgagcctgtttctcttctgcaaaatggggcattataaagagctcctgagcaaatgcacataaagagcttagcacagtgcctaccatataaaaaacaaatagcagacataagctataggtctcatgactagtacactgtgacatagagcagtcgttctaaccctgccacctactaaaaccacccggtagtctccccagccttactgctgcccaggcctcacccaagactatgaatcagactctgcaagtacatggtctaaacatttgtatttttttttttttttccattctctcttgggtgattctgatgcaaagtgccacgattaagaataaatgacacaggccaggtgtagtggctcatggctgtaatcccagcgttttgggaggctgaggcaggcagatcacctgaggtcaggagttcaagaccagcctggccaacatggtaaaacctcatctctaccaaacatacaaaattagccaggcgtggtagtgcgtgcctgtgatcccagctactcgggaggctgaggcaggagaatcacttgaactcgggaggcggaggttgcagcgagctgaaattgtgccactgcactcaagcctgggtgacacagcaaaactccgtctcaaaaacaaaacaaacaaaaacaacaacaaaaaaacaagggccgggagctgtggctcacgcctgtaatcccagcactttgggaggccgaggcaggcagatcacgaggtcaggaaatcgagaccatcctagctaacatggtgaaaccctgtctctactaaaaatacaaaaaattagccgggcatggtggcgggcgcctgtagtcccagctactcgggaggctgaggcaggagagtggtgtgaacctgggaggcggagcttgcagtgagccaagattgcgccactgcactccagcctgggcgacagagcaagactccatctcaaaaaataaataaataaataaataaataaataaataaggaataaatgatacaaagcagttatttcttaaattgtaatgtgcattcaaatcacctgatgatcttgttagaatgcaagttttaattctgtagtttggggttcgggttggaaaattctgagtttgtaacacactgccaggtgatgctgatgctgcttatcagcaagtcacactgtaaaggacacagagatgatcagagaagaggggtgacaaaggcaggcaagcggggaccaaaaactaacaaaacaaacaaggacctggtgggaagacttcagaggtcctcagcctaaattcctaggttggccccttcagcatcattaagtggcacaattaatgagaagcaaagagcagagtctggtgcaaaacatgctcttctcaaatgggaaccatgactattcatcacgactgcctcatcactaccaagcagaatagtctgaatgttttgtcctctttctgaccatcatctgtctacatgaccactattcctccatgaaacaagctccccgtcctacctatgtccttattaatttcttgactaaaaagactctgccttcagtgtaaagccccttctagaagacagttttttggtttttttttttgagacggagtcttgctctgtcgcccaggctggagtgcagtggcgtgatctcggctcactgcaacctccacctcccaggttcaagcaattctcctgcctcagcctcctgagtagctgggactacaggtgcccgccaccacaacggctacttttttgttgttgttgttgtattttagtagagatggcatttcaccttgttgcccaggctggtctcaaactcctgagctcaggcaatccacccaccttggcctcccaaagtgctaggcttacaggcgtgagccactgcacccaggcgacagtactttcttttcacctttgattcctttgctcacctgttctctttgaccaacctggaccaccaccttcatccacatacttcacccctgtaccctgggactgaatatgccagggaaatattgggaaccacagtagattggcccagcacaggcttctatcttcatttaaaccctgcccaggagactgccaacagagtatcacccctccctaactgactcttaggttcatttcttcacagaagcaacttaacatttcatctaccttcctgtatttcacagtttcttcatggaaccttggatcgccgctcctgagaagactggaacccacaggaaaatcagtttcattttcttcagcttgttctaggcagttgtttgcaatctgggttgtatattagaatcacctgagacctccctgcccctctgcccctccaccgcaatcccactctggttcacctgtcagaggtggagtctgacaatgcacggctagggtccaaaaccactgcccttgggaagccacactattcctaactggaaaccaactagaaacaagctcctctccacgataaatgcatcaaccctagcgtggaagatgaggagaggcgggtttccacccaagctcattgccttctgtgatggttcccacgatgaagctaaggaagttctagaaacagggggaggccaattctaaagaggtagcaatttacggttcatcaacctcagccttggaaagcccgacccgtcctccaggtcttccagcagaaccgggctcagagcagctgtcagctctttgaagtgtgaatcactcactggcgaagaatggggaggaggatccaactcctttgcctctgtgagccccggaccagtcttattaggactcatgttctcaatatgccaattaaaaaaaaaaacaaaaaactgctttgcccacacagagaagtagtgacctcaggagtttagaaggcagttaacaaagcagaaaactcaaccaaagaatgccaaagaaatgttctgacttcacccacagtctcccttagtatgttccacccaagatgggattcagctgaacatacctggtttactaaacccagaaaattaacgaaaactggccgggcgcagtggctcacacctgtaatcccagcactttgggaggccaaggcgggcggatcacgaggtcaggagatcgagaccatcctgactaatacggtgaaaccccatctctactaaaaatacaaaaaattagtcgggcacggtggcggtgggcgcctgtaatcccaactacttgggaggctgaggcagtagaatggtggaaacctgggaggtggagcttgcagagagccaagatcacgccactgcactccagcctgggtgacagagcgagactctgtctcaaacaaacaaacaaaaattaacgaaaactaaattgagtagaaaattatagtcaaacaccataaatgaatagaatagattttgattaattcctaaagtaagccattcaggaaacagctgtagtatctgcaaagaagtcttcgcccaccaagtaatccctgtaaataaaaacatcctacctgattagatctggttcggcaccctcattcttaaaggatgccagaagtagtctctctcgagttacaagatcatccaagaggttctgtcttcggtccccttcaagctgtgttctgcagatatcttgttaaggttcaatggtgaataaatgacctcgttttaactattacattattaagttagctcttcaagtcagttgtggcttttacagactgtaatcactactacccagaagggatgcgcaccactcttgcgtttttcctgctctgaccttcaccttcaccaggccgtcaggtaaaggaccttggcaggaccatcgcagaggcacttataaacactgacgtggatcatgacacaagtttttcattgagaaatataccaggtaaatattactttcctccccgtgaccaaacttatttacttatttttgagacagagtctcgctctgtcgcccaggctggagtgcaatggcgcgatctcggcccactgcaacctctgcctcccgggttcaagcagttctcctgcctcagcctcccgagtagctgggcttacagacgtgcaccaccacaaccggctaagttttgtatttttattagagacgggtttttgccatgctggccaggctggtctcgaactcatgacctcaggtgatctgcctgccttggcctcccaaagtgctggaattacaaggcgtgagtcaccacgcccagccccagtgaccaaatttaaatgacttctcctgccaatggtgcaacctggctcagtgattccttaggttttgagttatatgtgtgtgtcagtgttccagggcattttcctacatattaataccctaagatgctctgtttaaaaaagtgggggcgctgggggagagaagttctctatattgctctctttcttccatgttaatatctattaacacacctaggatatttataaagtgctactttatgcaacagatttgctctataaattgttaccatcagttcactatttaaatacattgcatgatttgtaaagaaaattacaaagagaatcattttaatgtgtgaatctagcaaacacgctagactaggagccccagaggcagagttgtagccctattccactatctatgctcttgaaccagttatttcaccttttgggatctctctttctttatatgtaacactaaatagtctctaacatcttttccacaacaattcataagtgatggttaaaaaaaaaaaaccaaacaaccatccttctgggaaatgtagtctttggaaagaaacctacaattcaccaataggtggacgagaatgcggcgcgtgcgcatgaagcaaaaagggaagtggcgtctgtcaacaaccggcgccacttcccttggactaagtacaaagttttatatactagctttcttgatgcaaactacaaaagtggttttttttttttttttttttttttggagacggagccttgttctgtctacaggctggagtgcagtggcgcgatctcggctcactgcaacctccgccacccgggttcaagcgattctcctgcctcagcctcctgagtagctgggactacaggcacgtgccaccacgcgcagctaattttttgtatttttggtagagacaggttttcaccatgttggccaggatggtctcgatctcttgacctcatgatccgttcacctcagcctcccaaagtgctgggattacaggtgtgagccagtgcgcccagacacaagtttttgtttgtttgtttttaggctgaactgtgtctatgtgtgtggtatgttaagaaacacagaagggctggacgcggtggctcaacgcctgtaatcccagcactctgggaggctgaagtgggcggatcacaaggtcaagagatggaaaccatcctggcaaacacggtaaaaccccgtctctactaaaaatataaaaactagccaggcgtggtggcgtgcgcctgtagtcccagctactcgggaggctgaggcaggaaaatcgcttgaacccgggaggcggaggttgcagtgagccgagatcgcgccactgcgctccagcctggtgaaagagcgagactctgtctcaaaaaaaaaaaaaaaaaaaagaaaaaagaaacacagtaaaggatatgtttggaaacaacttctgccataaaatgaatgagtggagaaagctaacaaacacttttaaaatatatctggccaggtgtggtggcttacgcctgtaatcccagcaggtcaaggcaggtggatcacgaggtcaggagttcgagaccagcctgaccaatatggtgaaaccccatctctactaaaaacacaaaaattagctgggcatggtggcgcacaatcgcagctacgcaggaggctgaggcaggagaatcacttgaacccgggaggcggaggttgcagtgagccgagactgtgccactgcactccagcctgggtgacagagcaagactccgtctcaaaaaaaaaaaagaaaaaagaaaagaaaagaaaagaaatacacactaaaacaagataccacttccacctatcagattaggaaactgagaagacagttttggaaagggacaaggaaccagacactctcatacattctttccttttcttttcttttcttttttttttttttgttttgttttgttaagatggagtcttgctctatcatcccaggctgaaatgcagtgttgcaaccttggctcactgcaacctccactacctgggttcaagcaattctcctctcagctccccaagtagcagggattacaggtgtccaccaccacacccagctaatttttgtgggtttttttgagagacaggatttcaccatgttggccaggctggtctcaaactcctaatctaaagtgaccctcctgcctcccaaagtgctgggattacaagcatgagccacttcacctgaccttatacattctttctttattattattattattttttgagacagtgtctccctctgtcgcccagcctggagtgcagtggcatgatcttggctcactgcaacctccagctccagagtttaagcaattctcctgcctcagcctcccaagtagctgggattacatgcacatgccaccatgcccagctaatttttgtgttttcagtagagatggggtttcaccatgttgtccaggctggtctcgaactcctgacctcaagtgatccacccacctcggcctcccaaagtgctgggattacaggcatgagccaccatacccggccacctcatacattcttgataggaatgcaaacaggttcaaccaactgctagactgccttctaaatacctaacaaaatataaaaggtacagtctttcaacagacatttcttcctcagatacagtcctacaaggacttagaagcaaggatgtccactgaaccattatttataatagccacattggaaatatcaataagtaactagtgtatgtaaacaatggaatgttttgcagccttaaaaaaagaataggaaagctgtttagggggctgataatgataattaacatttttgagcacttactaagtgtttacatgaattatttgacatggaataatctacaaaatataacattaaaccaaaggaggggaaaaaaacagcagcagcaaggagctaaacagtgagtagtgtgctcccactttgttaaaaaaaaatcctaactatatatgtgtgtatatacacacagaaaatttctgatatataaacattgcctctaaggaaggacaactgaggattaagggtataagagagactgatgtttcactgaatattgtttcctaatgtttgtctctatcatctgctaattaataaaaacacaagcttcagaaccatatgtataatataatccctttatagtcaaaggaattttatgtttacatatgcatatatttcaagcctagaaaagtctgagatactagctaccaaccattaacacttaactataaagaatgagatgagacaggatagaataaggaagagaaagaggagtcattggtaataactaatgagaaatgtatcagtagaaagtataatattttttgtaataaaaacaataaaggtacattttaaaatcagcagatactagttacagatttaaacttacgtcaagaaggagctaacaaagaacatcagtttcagaaacagtaaaacttgatgactatgttttgtagatgagtaaccaaagaacagaaacccacacagttgatgctagaagaggccttaaagatcccagttctcttgttttgctgaccagaaattaagggtgagcatggctaagtcacttgcctgggttaacagccatgctaggtgacagctctttcaaccctagctcatggcttttccaccaaacattctgcagacttctccaccttgagatgctgacttaactttgccacttcttagaatcctgataaaaacaatactgggagtacgaattcagaatattcccagagactctgtaaatctggaaaacaatccaattaggaacatgctgcctctttgttttatattttaatctacggagagaacagagcataaggagatggggaggagggagatggaatgagaataaattgattaatgaaccatctgcatagcacccttgctatgtaagggttgttattagtaagaggtcaaaggatcatccaggaaacaatctatacagcatgtatgtggacaggtgcgtagcagttgggtaaagtagggtagtggggaaacagtgtgcctgagtgatgctaaggacaagtagaaagtaggacacacaggccaagcgcggtggctcaagcctgtaatcccagcactttggaaggctgaggcaggcggatcatgaggtcaggagttcgagaccagcctggacaacacggtgaaaccccatctgtactaaaaaaatacaaaaattagctgggtgtggtggcacacgcctgtagtcccagctactcaggaggctgaggcaggagaatcgctggaacccgggaggcagaggttgcagtgagccaagatcgtgccactgcactccagcctgggcaacaaagtgagactccatctcaaaaaaaaaaaaaagtagtacagcacacagtcagtggccagtgctggggaacctcctcttccaccaacctggtgaatagccaaggaagaagataagagaacagacagataaagaaaaggaagagaagagctaactatcatagtactttgtccttggctatgctgattgtacatgtaattatagccaattcatggatatgtaaggttgtaaataaaactggatcccctgtagtcccagctactcgggaggctaaggcaggagaatggcgtgaacccgggaggtggagcttgcagtgagccaagatcgtgccactgcactcgagcctgggtgacacagcgagactccatctcaaaaaataaataaataaaaataaaaataaaactggatcctgatttcatattactgatacctactaccagcatgcataagtccagcttctctgctgtagcctggtgagcatttgaaccacagatggagcggggtaaatatgcaactggatccacaggtcacccaatcccactccagctcctggattttctcttatatttggtagaaggcttaagaatttaggctgggcacagtcgctcacacctgtaatcccagcactttgggatgttgaggtgggtgaatcacctgaggtcaggagtttgagaccagcctggccaacatggcaaaaccccatctctaccaaaaacacaaaaattagccaggtgtagtggtgcacacctgtaatcccaggtacttgggaggctggggtaggagaatcgcttgaacctgtgaggcggtggttgcagtgagctgagatcgcaccattgtgctccagactgggcaacaagagtgaaactccgtctcaaaaaaaaatagaatttaggtaagccttattttgtgaaagagctgctctggcgaaggaagaagtttgcagataattaattctccatgccaaaaaagaagaactgcaagggaacagtttaaggttctagaggtcaaaagacttttctggctttctttttttaagtcaacaaactctaataaatatttatgatgtaccaggccaagtccttaccttcctcaaagcactgatcacattttgcaagtactattttaataccatcattgtttgtgagttttgacataaccatcatgcatgattaaaaactccacaaagaaaggatgacctgtaaattctcaatggtagctgaaatctttacaataatgataaaataatcaatagcagctaatcctcaaggaggacttagtatatgtgaagcaccctgtatgcatataatctcatccttacacaacaatcctttacgccaggtggacttctagcatcccattccacaaatgaggcacaaagaggttaagtaacttccccaggggtgttggtaaccaccttttattcaacacccaccattatggggggctagtcctgtgaagaaaaaagattttcttcaacttgtacaataacctggcaaagtatgattattcctacattacagataatgaaactaaggtccagaaaagctgaactgctgtttggccttggtaagtggcagagctggtcttcaatctcagttctgtctgctttcagagccgatgttgttcccacgataccaatggcacctagacattcaggtttcgtggaccagtaatatgtccaaaaaaactaggggggggtgtaacttatatagaattaccaattatacattttgccaggtatggatgttcaagaaaaaaaaaaagaaacaaaactatctacttttactatcatggtgaaaaagcaaggagattttaacaccaaaaactagaaagaaccatgtaacagttctgtataaatcagaaaacaggcttgatatggtggctcacaccagtaatccaaacattttgcaggccaaggtggaggatcgcttgagactagaagttcgagaccagcctgggcaacatggcgagaccccatctctacaaaaaattagctgggcatggtggcatacacctggacccctagctacttgggaggctgaggcaggaggatctcttgaggccaggaatttgaggctgcactgagctaggattttgccactgccccccatcctaggcaacacagtgagatcctgtctttaaaaagtcagaaaaaaagttcttataaatcaaaaaacttctgctacacaaacactatcttcttcttatttttctcatgttaccaagtatcagtgaaaaccaatagacagggacagtgtttgaaaaccacttcacctccactgtagctaccaggggttacctgtaaaatctgttcagtcagcctctccacaaccacatccattggggtttgttatgtagtaatcaccacatctgtctatgcacttatctatctacttacctatctttgtttttccaaaaaatagagtagagaaaatttatttatagatttttcttttttttttttttttgagacggagtctcgctcttttgcccagactggagtgcagtggcgcgatctcggctcactgcaagctccgcatcccgggttcacgccattctcctgcctcagcctcccgagtagctgggactacaggcgcccgccaccacgcccggctaattttttttgtatttttagtagagacggggtttcaccatgttagccaggatggtctcgatctcctgacctcgtgatccgcacgcctcggcctcccaaagtgcctgggatgagaaaatttatttatagatttttaaaacttatttccaaaggccttctcccaagacaccaaagtactttttgacatcaaacccctctgtaaagagattttctttattctctttaaaataagtaaaggtgctgcctcctgtgaaatgccaacaaaaggataagtttcatgtgaagccaactctaagaagatggtactaagtatctttagtactatctggaatttcatatgcagcctcccacagcataaccctcttctcagctggtaagacaattatagttcctatctcaaagaaacactgtgaacagatgttaaggtctttcagaaatttaaactctctgactgcaagacttcggtttattaattgcacgctaatggattcaaaagcacagaacttccattttaacttgacttttattcttgccaggagaaaaatactttttcaggagagagcataacatctcatgccttaattccatgaatttcattgtttagaaagcatttgcacaggacttttctggcaactcctagtgttctttggacaagttcacaagtgtagaaaggcatcaatttattaagtatcataaattctcaactatccagcacagtaaggaaatgtggtattcaaatattcacattaaaaaagtcaccaaacattaattatgcctcaaaaaaaggattaaaaagtcactccattggtgatttatgaacaaacatttttctcaacatcataaagtatacctaataaaccacaatgaacactgtttaatcttcggatggttaagacggttcttgaagatttgtattataaacaagatttgtcttggcagtccagtaacacaacaattcatagagaattctagttgaagacatgccaggtgacagctgactgtattatttctactaaagtataattcagcttttaaacaattcacgttggggccacacagcctgtgtttgaacctggctcttccatttcctagttgtggggtcctgggtaatgactaaagctctccaagaatcctctcctcagtgtagaaaactcctctgctggggccgggcacagtggctcatgcctgtaatctcagcactttgggagaccaaagcgggtgcatcatgaggtcaggagttcgagaccagcttagacaacatgatgaaaccccgtctctactaaaaatataaaaattagccgggcatggtggcacatgcctgtaatcccagctactcgggaggctgaggcaggagaatcgcttgaacttgggaagcggaggttgcggtgagccgagattgtgccactgaactctagcctgggtgacagagcgagactctgtctaaaacaaacaaacaaacaaaaacaaaaaacaaacaaaccaacaaacctcctctgctggaattccgggttatctctccaacttcatcagtgactttcggtgtaaagtttaacttggcctcagtatctttctttgtaaagaagagaaggaagcaccaaaaaaatctaataatatgagattattaggactcatagattgctatctatcttaaatctggaagataactgccagagaattattttaaatgtttgggaagaagaaggaggttaggggaagggaagatgggaggaacagaaggagaattaaaaagaggccttcataatatacaagctacctcctttcccttacatcaaaagtggcctccgtggccaggcgcagtggctcacgcctgtaatcccagcactttgggaggctgaggagggtggatcacctgaggtcaggagttcaagaccagcctggccaacatagtgaaaccttgtctctactaaaaatacaaaaattatctgggcgcagtggcgtgtgcctgtaatcccagctactcaggaggttgaggcaggaaaatcgcttgaacccaggaggtggaggttgcagtgagctgagatcgtgccactgcactccagtctgggcgacagagcaagactccatctcaaaaaaaaaaaaaaaaaaaaagttggcctccctgaaaataaacaggtttatgagcgccctcatggggtggattagctaaatgccatccctagtactggctgcaggttgttacagtagaaatagatcaattatttgaaaaaataaatagaattttaaagaaagttgttgtattccagttgaatttttgatgtctcctggtaaattctaaattatccacattaagacccctaaatatttttgtaatgttttaaataactcttgttcagtgtttttgatgcttactgcttaattcagtaatttgggaagtaattctgggacgaccacaaaaccaaaaatctgcaagatttcaacagatggtcagactgtaagcatttaggagaacaaagtcaattataactgtggtattcttagtactctctaataactagcagaaattattattaatagaaaaaagtaaaagctcttaatttgtatatttttcttgccctatagggttagcacataaataaggtgactaataatgttaccttaatggaagcaaatgcatattatatcatgaaacaatatgtagttacctttctaatatatgtgttttaggtaacactaacatgaatttacacaccttgccatgtgtagacttcccagtgcttagtaccgaaagcagaggaaacagtcctgcccatctgaaactactaaaaatacaaaaattgggccgggcgcggtggctcacgcctgtaatcccaccactttgggaggctgaggcgggcggattacgaggtcaggagttcgagaccatcctagctaacatggtgaaaccccgtctctactaaaaatacaaaaaattagccaggcgaggtggcaggcacctgtagtcccagctacttgggaggtggaggcaggagaatggcatgaacccgggaggcagagcttgcagtgagctgagatcgcaccgctgcactccagcctgggcaacagagcaagactccgtctcaaaaaaaaaaaaaaaaattagctgggcacaatggtgcagtgagtatattaggacttgttgatttgggtaaaataaaaaccctttatatgatagaccaactgtgctgtaacaaattacaccagatggaaggtaaagtatctcagaatattccaattgcgttaaaaataaggctgtaattgtttgaaattaaacttttatttgaaaccttagtggatccgtaattgaatgtctagaaaaccatgcaactaagccaactttcctggtgatataaaggtgttacaatgggggaaaatattttttagaacactttccatttttttatctaaaaagctgtattcctgtatttccttatatttaaaatctggcaatatccattccctgaaataccaaaaattgggtctttggcatgacctactgacaatttagagaaatgatgagagaagaccagtttcaggtaagttttcaaaccaatatacacttgggtgtaaaaagttagtgtaggtaacaagtcacgtatattttcctaaattgatcagattatgaatttctctttttttattatttgagacagggtcacactctgttgcccaagctggagtgctttggcacgatctcggctcactgcaacctccgcctcccaggttcaagtgattctcctgcctcaacctcctgagtagctgggagtacaggcgtgcaccaccacgcccagctaatttttatattttcagtagagatggggtttcaccatgttgaccaggctggtctcgaactcctggcctcaagtgcttggcctcccaaagtgctgggattataggcgtgaaccattgcacctggcccagattatgaatttctaaaatatatatatatatatatatatatatatatatatatatatatatacacatacatatatatatatatatattttaacacttggtaggaggttaagatgatggcataacttgcttcaagaagtcccatcccaccccttcccctcacactcccatactagaggcagtgtctgtgcctctggaggaaaaataaggcacatctcaaatctacataaacacggggcaggtggtgagaggagagatgtatggtttctactggtattgcccactccgaaaataaatggatcattaaaaactctggaaactcccagaagcggaatcacagcttaggatgatcatggaagttttcctgttggagcagtagctagccatggtcaaggcggtctagacagagagcagtgtggggctccgtaaataccgcactgacggaaaacattagcttcctgaactgtacaggttatacccaaataagttaattccctcggtaggtcttgctttgccagcatattcactgtaaaacatgtaacagacacttaaaatagaaatcaagattacaggcaatattttggaaaccaggtcttcctcaagctgtgggaaaatctgggtggcccagattccttcctttcttaaaatacgactgcttttcctcccactctagaaaagaggtggaaatgtttacatggatacatctgatgtgttgacacagctcttagcaataagtccttcaaaagggcgatcttttccttcaggttctgcaacaaagctctgattgtcacggtaagctgaaaagaaaagaacacatcctaagtattctagtccagaatgtagaatccacaaaattacatcacgtaaacactacttcacgggctatgatgcaaccaagcaagggctggaagagatagatactcagcccctcacgacaaactcagggctggaaggaggctcagtggtgccctggcccagctgccaacctacagcttgtacccgctccacaacctggccaagtggtgagccaagccagactggaaccccgatactgactagaaactgtcagtgtgctctcaccatcagctgaatcctgtcacctgagcttctaccccattgatcctatgtatctaccttggaaccacgcaggaaattgtgttccccgagtcttcatttgagagcaaaaacccacagttctctgaaccaggcttcaaacgacaaagcatggagtcccattaccatccccaccaggctctctgaacaactggtaaaatttataacccaatgaaacgttttacggcaatgtgttctttttatgcaagaggaatgctaaccacacatgactcttttcccaggagggtgcgcattttctccaatcatcctacaggaaatttttgtccgtgactctaacctgttacattaaaggatggagaagagggcgagaagagagtctctcaggaatttggaaatgtgaaaaaactgcctgtgtaagttaaaacatattcaaccacggatgaaatcagacatatgttaaaaacacagaataccacaggtttcctttgctaccttgtcaaaagcagcaattatataactcaagcggactccctccttggatttgcagaatcacaccaaggaaaaccagccagtgtgtcagagactggcccagactgcacacatccagcagccctccaaggcaccagcagccaagaaaagtctaacctgaactatccccatacccctgggaaccaaggaacaatcacctacaatgttgtggggaaacaccaaggaaagcagatctctctacactcaaagagaaaagagcggccgggcgcggtggctcacgcctgtaatcccagcactttgggaggccgaggagggtggatcacaaggtcaggagatccagacgacggtgaaaccccgtctctactaaaaatacaaaaaattagctgggcgcggtggcgggcgcctgtagtcccagctacgcgggaggctgaggcaggagaacggcgtgaaccctggaggcggagcttgcagtgagccgagatcgcgccactgcactccagcctgggcgacagagcgagactccgtctcaaaaaaaaaaaaaagataaaagggcaaaacaagcaaacaaaaaggcgccacacacaccaggcctacgaagaggagtccacaaaatcaaagacaaaagcatttgggagatgaaagacggagtatgtagccattaaaaattatggctcaaatctctatttgttcacatagaaagatatccatcacagcttatgaaaaaaacatcaagtcataaaataaaatatcacccaaacagagaaaaaacaacccaggaactaaatacaaacattgaaaccatgaaagcaccatggttctatctaagtagtgggattttctaatattttataagaaaatgatcacttttgtaatcaggaaaaaatgtcattatcataattaaagacactttctagagcacaaaaaaagatggaaagcctaattcacattttaagctaccataacctgggtaacaagcactgacagagataaccacatgtcaatcttacttaggaattataaatgtaaaaatcttttcaaaaaatattagcaaagcaaattcagaattacattaaaaaggaccatatactatcaacaagtagaaattattctagtaatttaagaacagtttgatgttagaaaaatctagtaataaagctcatggtgttaataattaaaaacagaataaacatatgattagtacagtacaggggaaattataaacaaaagaaacacaaaaaagaaagaaaaactaagaatagaacactactgccttaactacaatattatttaactttgctctagaagttctaaccaatacaataagaaaaattaaagaaaaatacaaggactacaaggaaagatgagattattattatttgcagattgataatagtctacttggaagagttaagagaatcaactgaaagattattattattttatatatatatatatatatatatatattttttttttttttttttttgagacagagtcttgctctgttgcccaggctggagtgcaatggagtgatctcagctcactacaacctccgcctcccgttttaagcgagtctcctgcctcagcctcctgagtagctgggactacaggcacccaccaccatgcccagctaatttttgtatttttagtagagacagagtttcaccatattggtcaggctggtctcgaactcctgacctcaggtgatccacccacctcagcctcccaaaatgctgggattacaggcatgagccaccgcgcccagactgaaagattattaaaaacagtagaggccgggctgaaagactattaaaaacagtagaggccaggtgtggtggctcacacctgtaatcacagcactttgggaggcagaggtgggagaatcacgaggtcaggagttcaaaaccagcctggccaacatggtgaaaccctgtcactactaaaaatacaaaaattagctgggcatggtggtgcgcacctgtaatctcagttactggggaggctgaggcaggagaatggcttgaacccaggaagcggaggttgcagtgagcaaagatgatgccactgtattccagcctgggcgacagagcaagactccatctcaaaaaaaaaaaaaaaaaacggtagaagaattcaatatggtcattagtcataaagtgaaaaaaaatcaagggcattcctaaatttaagtaatacctagggagagttttttaaattgttattttaaaacttcattaacaataccaacaaaatctaaaaaatatctagcacagtgcctggcacatagttaactgtgcaataaatactgctgaagaaacaaaaggaaacgctcaatattgtgaaaatgtaagttttccccaatttaaatctataaacatacatgtctacttgaaattccatttggaattcttttattgcagaagaggtgataattaaggcacagcacagtttggtttttttttttttaaatgaagttttagaaaattactctgacagaaggataaatgaaggaaaataaaaaccatgaatatgtataatgttcataggggccttaatcagatataaagtgattacaaaaaactacaatagctgatgctggcaatcaccaacagcttcagtagtgcaacataacaaatggcccagaaacaatgtagctgtataaaaatccagtgaattaaatatgaactatttcatatgagggaaagaaattcataatttaacaaatggggaaaaaataaaattagatagctatgacacaccaaagtaaacaccaagtatttcaaagatttacacacacaaaacaaaataacagaaaaaaagcttaaggaaaatttacataattaagtatttataaaacctctgcatgtaaaaggcctttttaagcatgatatcccctcccccgttagaaaagatcaccaacaaacatgctgataatttcaaataaaatttaaaaaccggtacatgttttacaatgtcacttacaaaatcaagttaatagagaaagcatttatactaaatataccagatcaaagcttaatatagttaacatatataaaaagaaaactttgaaattaagaaacaaggctgagcacggtgggtcacgcttgtaatcccagcactttgggaggccaaggcaggaggatctcttgagaccaagagtttgagaccagcctagccaacatggtgaaacctcatctctactaaaaatacaataattagccaggcgtggtggcgggtgcctgtaatcccagctacttgggacgctgtggcaggagaatcgcttgaacctgggaggctcggaggttgcagtgagccgagattgtgccattgcactccagcctaggcaacaaaagcaaaactccatctggccaaaaaaaaaaaaaaaaaaaaaagaatagatattcaagacttaataaaaaatgcatattaaactactgtaacatagtatttttacctagtagagatttttttaaaagataatcaaaattggtgtagaaatgtcattctgcaatatatgtgttcaaaaggcttaaaatgttatacaacccaaatccagaaagtctacattgaagaatttatttcaacatgggcaataatttggctatactgaaaaatcatttgtaattagaaagaatctaactgtccaagaagatgacactagttaaatagatagcagcccttcgtgtaaaagatgaaaccatatatttaatagaagaaagcaggaataaattttttataacctgcaaacagcaaaaacttagatatgactaaatatatggaagcaattagattgacagccaacttcatttaaaaaaaaaaaaactttcggccgggcgcagtggctcacgcctgtaatcccagcactttgggaggctgaggcaggcggatcacaaggtcaggagatcgagatcatcctggctaatacggtgaaaccccgtctctactaaaaatacaaaaaaaaattagccgggcatggtggcgggcgcctgtagccccagctacttgggaggctgaggcaggagaatggcgtgaacccgggaggcggagcttgaagtgagccgagatcgcgccaccgcactccagcctgggcgacagagcgagactccgtctcaggaaaaaaaaaaaaaaactttcacacgacaaaactaccacaagcaagtcaaatgtcaaatgataaaggaaaggaaataactacaatttatcacgaggagctaatctccataatacgtgaggagctcttaaaagatcaagactaaaaaggctaataatccagtagaaaaatgggcaaaagacaagacagttcacagaaaaaaaaaaaaatatatatatatatatatggcccttaagcatatgaaaacacactccacttgactcattatatgagaaatacaaatttaaaacgacactgaaacaccatttctcacttatgaggttaacaaaaattcagaagattcacacaccctctgttggccaggctgtgaagaaacagaagtgctcacacattgctggtggggtggcaagagtgacaacccctttgaggggggatttcacatcaggttaaaaaaaaaattacatatgccctggttctgagaactcacctttaaaagacacctatgcacataatttttttaaaggacaaggttatttactgcggtgttattcacaactcaagactggaagcaatttaactgcctttccttaggagacaggttaaataaagaatgttacatctacgcaatagagtacccatacagcgctaaagaagaacaaggaatatgaaatgaaatgtagaggtttctatattattaagtgaaaagaccaagatacaaaagagtatctgtcattcattcattcatccatttatttatttatttatttatttatttatttatttatttatttattgagacagagtttcattcttgtcacccaggatggagtgcagtggcacgatctcggctcgctgtaacctccgcctcctgagttcaagtgattctcctgcctcagcctcccgagtagctgggattacaggtgctcgccaccacacccggctaatgttttgtatttttagtagagacggggtttcaccatgttggccaggcttgtcccaaactcctgacctcaggtgatccacccgcctaggcctcccaaagtgctgggattacaggcgtgagtcaccgcgcctggcccgaaagagtatcttttatataaaaggaaaaacataacacacagacacacagagacacacacatacacacgcatagaggcttatttctgcataaagtaacacaggaagaataaaccagaaattaatgaaaatggttatttagaagaagtaggttaagaaaaggtagaaaagagaggaatgggaacaagactttgagtgtcacttttatataattttgacttctgaacaatgtaaatgttttacttatttaaaattaaattaaaaagttggaaaaagcaactcctgaaaatgaataaaaacagaaacaaaggataacataagacagaaaaaaaaagaatcaattattgcaaaagtcctcaaaaaaatactggcaaaccgaatccagcagcacatcaaaaagcttatccaccacgatcaagtaggctttatccctgggatgcaaggttggttcaacatatgcaaaacaaaaaatgtgtttcatcacacaaactgaaataagacaaaacttacatgattatctcaatagaagcaggaaaggcttttgataaaattcaacaccacttcacgttaaaaacactcaataaactaggtattcaaggaacatacctcaaaataataagagccatctatgacaaacccacagccaacatcatactgaatgggcaaaatctggcagcattccacttgaaaactggcacaagacaaggatgccctctgctaccactcctattcaacatagtattggaagtcctgaccagggcagttaggcaggagaaaaagaggagaggagaggagaaaagaggtgagaaaggaaaggaaaaaggaaagggaagggagagaaagagagaaaggaaggaaaagaaagaaaagaaagagagagaggaaggaaggaaggaaaagaaaaggcatccaaataggaagagaggaaatcaaactattcctgtttgcagacaacatgatcctatatctaggaaatctcatactcccagtccaaaagctcattaagcttataaacaacttcagcaaagtctcaggatacaaaatcaaagtgcaaaacatcactaacattcctgtacaccaacagtcaagccaagggccaaatcaggaatgcactcctatttacaattgccaacagaaaataaaatacctaggaagacagctaaccatgaggtaaagatctctacaagaagaactacaaaacactgctcaaagaaatcagagatgacacaaacaaatggaaaaacattccatgctcatggacagcaagaagcaatatcgttaaaatggccatactgcccaaagcaatttatagattcaatgccattcctattaaactaccattgacattcttcacagaactagaaaaaagtattttaaaattcatatggaaccaaaaaagagcccaaatagccaaggcaatcctaagcaaaaagaacaaagctgggccgggcgcagtggctcatgcctgtaatcccaggactttgggaagccaaggcgggaggatcatctgaggtcaggagttcgagatcaacctggccaacatgacaagagcccatctctactaaaactacaaaaattagctggaagtggtggctcatgcctgtaatcccagctacctgggaggctgaggcacgggaatcacttgaacccgagaggcagaggttgcagtgagccaggatcgtgccactgcactccagcatgggcgacagagcaagactctgtctcaaaaagaaataataaaataaaaataacatagctggaaacatcatgctacccaacttcaaactatactacagggctacagtaaccaaaacagacatagaccaatggaacagaatagagaactcagttgaccaggcacagtggctcacgcctataatcccagcactttgggaggccgaggcgggcagatcacttgaggtcaggatttcgagaccagcctggccaacatggcgaaaccctctctctaataaaaatacaaaaattagctgggcatggtggcacacacctgtaatcccagctactcgggtagctgagatgcaagaatcacttgaagccagaagggagaggttgcagtgagctgagatcatgtcactgcactccagcctaggtgagaagaaacaccgtctcaaaaaaaaaaaaaaaaaaaaaatagagtacccagaaataaggccacacgtacaactatccgagctttgacaaagctgacaaaaacaagcaatgggggaaggattccctattcaataagtggtgctgggataactggctaccacgtgcagaagatagaaattgaactccttccttacaccacatgcaaaaattaacttcagatggattaaagacttaactgtaaaacctaaatctataaaaaccctggaagacaacctaggcaatactattctggacataagaacaggcaaagatttcaggacaaagacatcaaaagcaattgcaacaaaagcaaaaattgacaaataggatctaatcaactaaagagcttctgcacagaaaaggaaactatccacagagtgaacaaacaacctacacattgtgagaaaatatttgcaagctatccatctgacaaagatctaatagccagtatctataaggaacttaagcaaatttacaagaaaaatccaccccattaaaaagcagacaaaggacacgaatagacacttttcaaaggaagacaggcatgctgccaaaaaaaacaggaaaaaaagctcaacatcactgatcattagagaggtgcaaatcgaaaccacaatgagataccatctcacaccactcagcatggttattactaaaaagtcaaaaaataacagatgctcgggaggttgcagagcaaaaggaacacttatacactgttagtgggagtgtaaatcagttcagtcattgtggaagacggtgtggcaattcctcaacgtactaaaaacagaaatactatttgattcagcaatcccgttattgggtatatccccgaaggaatagaaatcattcttccataaagacacatgcatgtggccaggtggggtggctcacacctgtaatctcagcacttcgggaggccgaggtgggtggatcacctgaggtcaggtgttcgagacaagcctggccaacatggcgaaaccccatctctactaaaaatacaaaaattagccaggcatggtggcaggcacttgtaatcccagctactctggaggctggggcaggagaatggcttgaacctgggaggcagaggatgcagtgagccgagattgcaccactgcactccagcctgggcaacaagagcaaaactccgtctcgaaaaaaaaagagaaaaaaagagacacatgcatgtgtatgttcactgcagcactattcacaataacaaaagacatagaatcaacctgatgcccaccaatggtagaccagacagagaaaatgtggtacatatacactatggaatattatgccgccataaaaaagatcgagatcatgtcctttgcaggaacatgaatggagctgaaggccattatccttagcaaactaatgcaggaacagaaaaccaaataccgcatgttctcacattctgtaggttgtttgttcactctgttgatataagagagagctaactggtgagaacatatggatacatagggggacatgacacacactggggcctagcagagggaggaagctggaaggaggaagaggattaggaaaaatagtaagtgctaggcttcatacctgggtgacaaaataacgtgtacaacaaatccccataacacaagcttacctatacaacaaacccacatatgtacccctgaacttgaaagttaaaaaataattctaataactttggaacataataacctcagcattcttagtagattagtctacacttaaaaagactcaaattttgaactcagtgtttgtcgtggtaccttatagtaattttgaaaccattttctgtaaactgtaaaatagaccaaatgagtaaaaacatactgatgcttttggaaactaggattctcagtgtgagagaaagaaaatacaaatttggaatgtggaaaataaggaagaaaggtgtggtgttagatttgaatcagaggcttctattttcaatcatagtcacaagtataaacttgtgatttcacaaaaatctatttcttagccaaatcccaccactgtttttatacagcccaaaactaaagatggtttttacatttttttcttttttgagacagggtctcactctgttgcccaggcgggagtgcagtggcacgatcttagctcactgcagcctccacctcccaggttcaagcaattctcctgcctcagcctcctgagtagctggactacaggtgtgtgccaccacgcctggctaggttttatatttttagtagagatggggtttccccatgttgcccaggctggtctcgaattcttgacctcaagcaatctgcccgcctcagcctcccaaagtgctgggattacaggtgtgagccactatgcctggcctgtttttacatttttaatgtaaaatgtaaaaactataactattcttgtggtgagaatggaaactcaaagacttgaagacattatctcttggcctgcaaagactaaaagatttattatctgtaggaagtttactaacccctgaactagactataaaattgttagaaatatttaaagtaaaacaggagaacttaaatgtgttatgcctcatttagtctcaatgattacatcactactaactggttgggtgttatgtcaattcaacatatgtaagcagatagatcatcatacacacatgtgcacagacagcctcaaagaaagataggagggttttcaggcctcaaaactcaaacaaatcattgggtactaattccttcatggtattacctttggtgccttttcaccttttctttcatattgatttcgttgttgaattttctcagcaatttcttgggcaatttgacaagtagaatcgtatgtggagaacctgcaccaaagtcgtaaaaagagaaaatgtttaaggttctttttttttgagacggagtctcgctctgtcgcccaggctggagtgcagtggcacgatctcagctcactgcaagctctgcctcctgggttcgcaccattctcctgcctcagcctccccagtagctgggactacaggcgcccgctatcatgcctggctaattttttgtatttttagtagagatgaggtttcaccgtgttagccaagatggtctcgatctcctgacctcgtgatccgccccctcggcctcccaaagtgctgggattacaggcgtgagcccctgcacctggccttaaggttctttaaaagaaatttttgcattgtctaagtttgacattttcattctagccaaagaattcaaacagaggggaagaataataacatgaccagtaaaagcaacatggactgagcgttatttaccatgtgccaggcactattttgaaggcttcgttagtaataactcacttaatcaaaacaggaacgctatgaagtgggtaccattaccatctccaactcacacatgagaaaaggaggcacaaagagttagagtgacttgcccaagtggttctgcctgctgcaaaccaaggccgtctggccccagagccggggctcttaacaactgtgctgttctgccaatgagaaagcatgtggggggtctccgctgcactgggcactgttctgggcactggagaagacggcagtaaacagaatgaacacagtccctctttcaaggagctcatattttaaggaaagaaagtcataaaacaattaaatacatagtatgtcaggtgttgataggtgctaagaagaaaaacgcagcaggataaagggacagagagtgataaggagctgctacttaggatcaggtgacaccgaggcaaggtgaagaagctgggcttgcagatgcctgggggcggctctagggtgcaggaacagcaagtattgtctagcctaaaaccaaatgctccggggacaaaggccacacacccacctgacatctgagcttgccagaattctctcaaaacatttaataagcttctagttgtcattcagcagcgttggaggctttgaagggttcacggtgaactcccaatagccccttatgttttgcttctctcagagcatttttactttctatcatatagaaaatacttaagcagaccggatgcggtggctcacgcttgtaatcccagcactttgggaggccgaggcgggcagatcatgaggtcagaagttcgagaccagcctggccaacatagtgaaaccccgtctcaactaaaaatacaaaaaattagccaggcatggtggcgggtgcctgtaatcccagctacttgggaggctgaggcaggagaatcgcttgaacccaggaggcgaaggttgcagtgagctgagatcacaccattgcactccagcccggcgacactgtgagactccatctcaaaaaaacaaacgaacaaaaaaacgaaaatacttaagcatgcatacacatttcatttctcctatcagacagtctgctcctaaaaagcagagactctgtggactaacatgaccagcattatcttccaggaccagtccatcacaaaatatcagaaactcctgttgcccctaatgtcctaatttttgcttgagtaaacaatatattttttaaaacctttcaattcccacatatcatttgaacactgagggaacttgataagtgtttttttttaaatgaaggaaaatgcgcccatcaattcccttaggaatcttactagaataattatagcaatagtaacagctgagtacctgacctgagccaggtcctatactaagagctttacactgtaaacttcataaggatcctgagagaggatcctgaaccactaaccactatactgtaaagcagcaccattcatgtatatatcatatatatatcacacacattcacatatatcatatatatcactgatacatatattcatatatatcacatacctatcgtttatatcatatatactatatattcgtatatgtcacatgtatatcattcatatatatatattcatgtatttgtgtgtgtagggaaaaatagcagtgatacaagaaaacacagaattaagaaaacaggaggctaataaggaaaattgggtcctggtccaaactttgccacatttcacttttttttcctccatattatcatgaaaagaggagcctaggtctggctctggggtccagaccatacatataaaaatcatccacatatggtaagttttgcctcctgccaaatgtgggatctaagtggtaagtacgtctggagttcagaggtggaagagattactgctgaccaaggcactcagatggagagggtccatgaggttacatctggatgaccacgaagttaaagcaggtctcttattcagacaggagggaggagcacattctagacttagtgaaagacagggcgagcaaagatgaatggaaggaaacgtgcccggcacatttggctgcgtggtggccctggaagcctgttaagtataaaatggtagagatgagtagaagctagtttctgcagagccttgaacaccagtctaacaaggttagacttaaaggagaatttcagagccatagagaacacttttacacacagagagtggccctaaagaggttatgagaaatgcacacagctagcacaaactcccaggtgtcctgactccagtccttgtgttgttattttagccctaaagagcaatagttctgaaacaagttggaatcactggggaatctttaaaaaaataacaatgcctggtcccaacctcagcattctgactcaactggtatggggtttgtcctgggcgtgcgtggggagctttaaaagctctccaagtgattccaatctgcggtaaagtccgggcgggaacccttggcctggggcaatagacaacctcattacactatcaagcacacaggtgcctgaagtactagtttagaaaaagtaattgggtcggggggtggctgaggcaggagaatcgctggaacccgggaggcagaggttgcagtttgccgagattgtgccatcgcactccagcctgggggacaagagcaagactttgtctcaaaaaaaaaaaaaaaaaaaagtaatctgggccgggcataggcgtagtggctcacacctgtaatcccagcactttgggaggccaagacgggtgatcacctgaggtcaggagttcaagaccagcctggccaacatggcaaaaccccatctctactaaaaatacaaaaattagccgggcatggtggcgggtgcttgtaatcccagctactcgggaggctgagataggagaatcacttgaactcaggaggcagaggttgcagtgagccaagatcatgccactgcactccagcctgggcgacggagcaagactccatctcaaaattaaaaaaaaaaaaggtgtggagggtagagatgaaacaagaatggcagaatattgataatcacagaaattgggtggtgagtatgaaaggggcccattatactattctagtttgtgtatcttttaccttccaaaataaagtttttaaaaagcaattcaacacaaagaagaccatgctaccaacataaaaagtccaatcaggatataaaactattaaggtttaactgtaatttttctggaaatggtacatcatcaacaaattagttaccctggaggtaaagctaattaacattagcaaagagccagttcagagacagtgatcatgggctccttctgttaaacagcgagcttaccacttgctttgataggccattaaaatagtaactgctatattccattgctagacactgagggaggtgccaatgacctatgattttagcaacacaaaggtaaagctgtagttgaatctgtttttataggttgtttttgtttgtttgttttgttttgttttgacatggagtctcgctctgtcgcccaggctgaagtgcagtggcgcaatctcggctcactgcaacctccacctcctgggttcaagtgattctcctgcctcagcctcctgagtagctgggattacaggtacacaccaacatgcccagctaatttttgcgtttttagtagagacggggtttcaccatgttggtcaggctggtctcgaactcctgaccttatgatccgcctgcctcagcctcccaaagtgctaggattacaggtgtgagccaccacacctggccttttataggtttttcaagtcccttcccatactcctttctacccccctaatcagcgacccattttgtgctttgggagcacagctgagtgtctcactgtttcactctcaatagtccaatgagaaagccacttcatcaaactaatgaagtataacagaaaaagtctcaatgctttatcaacattaactgcggaagaagcttggggtccagtgatagcttccaccaatctaaatagataactgggggcctgtcccttatctttgacctttatttcctacttgatttgtaaactgagggatttaggttccagaaggtggagggcaacttaggaatatgtattgtaaaccaaaataaaattctaagcccacccccaacacccccccccacccccgcaaccatctgaacggacccctactctaaggcaagggcattccaaagttaacctgaaacactggttcaggccatgatgggaagaggggatcagacatgcctcattatatatcctctcctcctttttggaattcaggaaaagccaaccagcattaacgtcaatacagaccttaagtctgataagaaacacttacaatgtattctctctaaagcctgctacccagaggcttcatttgcataataaaatcttggtctccactaccccttatcataacccagacattcgtttctattgataataactcaaccaattgccaatcagaaaatttttcaatctacttatgacctggaagccccccacgcccttcgaggtgtccctcccttctggattgagccatcataaatcttacatgtattaattcatgtattattctccctaaattgtataaaagcaagctgttccccaaccaccttgggcacaggtcttcagaacctcctgaggctgtgtcatgggtgcattcttaaccttggcaaaataaactttctaaattgactgagacctgtctcagatactttggggttcacagtatcaagggccttaaaaatgtttatacccttgagcccaacagttctatttcactttcaacagtctaatgagaaagccacttagtcaaactgattgagaataacaaaaaaagtataaatgcttcactttcaacagttctaattcctacttctagacagggagcccaaggaaataagagatagaacaaagggactccctttgcaatgataaaacaaaacaaaacatcagaaaaacaaaaaactaataggagaaaaataaattatggtcattcatgtgatgcattattttgcaacataagacaattatgaggccaggtgcggtggctcacacctgtaatcccagcactttgggaggccaaggcgggcagattgcctgagctcaggagttcaagatcagcctaggcaacacggtaaaaccctgtctctactaaaatacaaaaaattagctgggcgtggctgcgtgcgcctgtagtcccagctactccagaggctgaggcaggagagttgcttaagcccaggaggtggaggttgcagtgagccatgatcgcgccattgcactccagcctgggtgacagacagagcaagactccgtctcaaaaaaaaaaaaaagaagaaaagaaagttatgctttcaaagaatgtccaatgacatagagaaatgctgtttatattatatatatatataaaaatatagattaaaataacaaattcattgtaaaaaaatcattaatggctatttccaaattatagagttaaagatgctatttattttcctttttgcaaattttcaatattctctaaattgaatattctctatcaaggggtgtatataactgttaaaattagggattttggggttttttatttttttttgagacggagtttcgctcgtgttgcccaggctggagtgcaatggcacgatctcagctcaccacaacctacacctcccgggttcaagcgattctcctgcctcagtctcccgagtagctgggattacaggcatgtactaccatgcccggctaattttgtatttttagtagagacggggtttctccatgttggtcaggctggtctcgacctcccgacctcaggtgatctgcctgcctcggcctcccaaagtactgggattacaggcgtgagccaccaccgcgtccggcctaaaattaggtttaaaaaagtaaatgctaaattaaataattggcccaaataacctagattccaggtaactcaactttgttcttggaatccattcttctaatatccaggatgtgggcaacttaaacaattataaactatattagaaataacaacataagacacatattccaacaagaacgttatagagctgtaatatgtttttaattattaagcagaaaggtcaagtctatgttcaataacaatacgttccttgggatcaaacaatatgttccttgggatcaaaagttgcatctttcatcatgcagtccttgggattaactgctaaataaatcacccttatcagctattgttttactgcagaagctactgctaaaggaaaagacttcatgatattaactcaagaaagtgcaaaatgccttataaacaagtgcacaatttccctcccaggttcctgtatctggaagggcccccaagatctaggtcttagccccagctggttactaactggctggtggccatggattctgaacctcggtttctccacctgtgaaataagggggtttaccgggatggactgacatgctacaaaaacgttatttcgacttcacttttataggagtccagggaagcctgcaccagccagctagctccaaaaccaggatgggcgggaaatccccgcaacgagatgcagcccagaaaagctaaaggaatattcagagatttggcgtaagtcctcagctctccagcggaccacctggtctccttcccgggccacccttgcaaggaccaagtgtggcgggatgtggctgagccccctcagtaaaggaaaggtctcgctgcccctcccctcatcccgaaaggccaccagcggcaatgcgaagtgattgcctgctctccggaagcccggcctccccgaaggtccctccacgcaccgccgccctcacccgggactcaccaggggtccggtgccatcctgcagactccgcccgccgctcggactcttcctgctcttagcagctgactacggcggcccgcgcggctcactccccgcagttcgtcccgtgcgcgaccggagcctggagtttgcaaagtgagtagctagggcctcagaactataatcag

SEQ ID NO: 804 - DNA, 325489 bp, Homo sapiens; identical to SEQ ID NO: 803

SEQ ID NO: 805 - DNA, 588017 bp, Homo sapiens
catctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctgggcatgctcagtatcagggtaggttttgattgagagtaaaaaaaaaaaaaaaaaagctttgtattatgctctctttctcctgtgcatactgcttgctgaacagcttgtggggcattcctgagtctacctagaggttttatcagacgcccttgattgtgtctccttgggatctgttcccctcttacttcaccccctcccccaacccgcctccaccccgcttcccaggtccctgtccgctgtggggatggagagacactaacagaactgggatgggcgatgttggctgaacggatccacctattattagtgcgcggggattggctccttggcgcagcgtacccgaggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcctggagttgatgttgggcatcccccatcttcttgcttcctctttccttctcttgttctctctcctccgtcccccacccccaatctcaatcttttctctctttctctcccacacctcccctctcgccctcctcccaccctaagcacgcacagcgtttctttctcctcctggagaggattgcctttcttagaggaaagagggggagtgaagaaaggagaaagatttctttctgttggggagagggatatgggggggggggggaacgtaaacaagatagaatacaagctctgcgaaaatcagagcacataaagcaattaaactgaataaggggagtagacaaccagtccagcttgggctgtcagagagaggaagcgtcaagtttgacttgatttcctccttgcaagagtctatgtctctcacttgattcgttcaaatggaacaaaaataaaccgacaatccaacccactttcaactgcttaattgcttttgcttttgagtgccaaccatctgacttttcctgtttccatctgtcctgtggggctaacaatttggtattgcacatcagtgttaatatctgaactttgaaagctttcttgagtaacaaaaaaaaaaaaacaattaaaatagattattactttcctgaggtttcttggtatggcctgttgttgggggatcaaaaaatgtaaagtttcaaaacatttgcaagggacaacaattttatagggaggcttggatttctactttgagaaagctaatcttctagttagctttgtgtacatgttgatattcactttctccagtattaaccctttcgtgaaataaagcaactgtttaacttttgtatggaagctacatttgtgtagaattttcactttattctacctttgtactatttgcattttattgtctggataccaaacttatgcctggctttattttcttttaataggacaatatttaatggatgtaaacatgatgtttatacaatttcagcactccctttagaaggcacatggaggctcagttggacaagaatcctcctgtactggaactaagtttagaaagtaatgctagaaagataccctaaattttaaaaatcctgaaggggaaaacatttttgtaacgtcttgttaaaagaaagaaaaatatatcaaaacaccaacatgcccctggctgcctgcataataggtcaagtaaatggtacttgttggacagagcctttacagcagcttcagcagtctctaattccatcattggggatataagctttcttttcttattattcttcagggacagctaagcgatagtactgtcagatggaaggaggtatagagaaatgcctcgtttgatgtaataggaaagcattccaagtgggtcttacctgaacacagagaaatccacagatgttagtatacaaaacacttctttttatttatcaggggaaatgcagagtcttacttttttttgtctagaactccacttgatataagaaaagagaatcttctatcttaactgtgtctgaccttccacactaattttgtatctcagagagtattttttcactacgtacgtttaatatataagtttacacaccaacttagagaagagctgaattcatttgccatcagtgtaatgtgtactattttccaaaccattttgcatttgaggcaatgatctctccctaaatagaattaccaagtcacgaaaaacgattttctttctagggctttgacatttaaatgaaaaaaaaaaaaaaatagtgtctctgttgaaagctaactctggtttttagaggtgccaccttttggttacaaggacaaagggacaatcacttaattacctcacatgtatgtacaactgaattaacaagtttagacatgaaaagatgtacaaaaaggaagccagctgccttcatgtgagaaaattaagattttgttttctcatttctccactgtcttaggaatatgtgaaaatttaggcttggtttgtgacatttattttcatgactctttacaaatgttaattatagaaataacatctaaaaatatggatatgagtagtttttcaaatacttctaaaaaattcaatatctgtgtattggaaatcagaactaattccaatatatagtgagtggattggggagagaccttacatgatatattataggaaattcttactttgttatcccacaaaatagtctaatgtcacaatttcatacaatctttgttttttctccctttgacaggatattttagtaaatctcattaatgtttcagagtaaatatgataattatgcctcgaggtatttttgtcagaattgaagactgctaatatatagggaaaatcctaaaatactaatttcacaaaaataccacatgattgagagttgttgctgagtagttttgaacttcatttcataatggagaatattagttatttcatctggtcaaattatcagatagttctaatcaacaaatatgaaaatgaataacattgtatttatacgatttgcatattagactgaaattgaaactaaaaaatagtattaattatatgcttgtattaattatatgcaagatgagctggaagattaataaaataaaatgtagaatatgttagaaatctgaaagttaatttgaacttcctgttagcctaataacaccattaacataatatcagttcatcacttttgatgtcagtatattaagttgattttgagaaaattcccaaaacagttagagccatctaatcttaaagaacacacacttaatgcagacaattatacgagcctgaaatatagttcttatgatttccagtttgtgcaacaaccaagaagagctatcactaattccaaattgaaacataatatttattttcctaatggtaataattaagtaatttggggggaacaagaaataaaaacagtttgattatataatggaacaaatctttgtctaatattaccaaaaacccataccaaagttagactttctgccattgtgtaatgtaggtatgcgtcttgcatgcattctgcagaaaatataatatttttaaaaagtaaatatctgatgtagttgtgatattttaaaattcttaaataatttatttatcataaatatatctgtaccaaaagttcaatacatgacgtggctgattttagctgaaattttttcactgaaattgaccaaagccatttaaaaagagacaaagtatatggcaatatacataataatttcagctagaatttaaggatatgtgtgtgtatatacatatgcatatatttgtgtgtatatatattccgaaattatctaaatttttcaaaaaggtttagaaactcatggacagtagactataatttgctgaaactaggggctattcatgtacaaagtaccatttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacaggtaacaaataagttgaaatcatatttttacatgatttagatatgatggctgataaaacttctgtctttctaaggcttttggcagatgtttctttcaatatttgcattaaggtaaacattcttaattttttatgtaattgaatggcatgattatcattgcattgggtgggagaatgtgggttgatatgttttcattaaattcctcaagaaatgatcaacattttttcagtctttttgcaaacttgacttaaacttctccactaagtgtttccatttccttaaggagaaatttaacatttccaaaaaaaaagataaccagcatttttctttcagctggtcattttaagagtgttcttgaggagctagttttatatggactgtaagataaactgtggtagccgggtatgtgaacatcactccattcatatgtactagcaatacaaaataaacttatttaaaattatagtgcaaatgtatgctacctattagaagagagcatgccatcatttactgtctacatcaataaaattaacttttgttttattaaaaaaggaaaacttttctttaaagtggacaataaatatattgctatgttgtagaaatggtaaacactagagatgctatttctgcaatttaaaatataatattagagattctattgcaaagaatcctagttttaaaatggcatctacattacattattttaaaaaagcaatatttaagagagtttcaaaagaaattaaaacctacattaaagtaaaataacacctttatggtagtgttagaaatgaattttctagcatgtctttgacacatgcaaaacaaatattttaaagaattatttctgtaattgctctaatttttatatttatttaagccttaagttctgattgctgatttccatactttactaataatgcaaatgagaggtcaaagtttatcttttttggttactgctattgcggaaatacaaagaaagcatactggtcactcctataaatgtctcacacatagtatgttttatgtttaacattattacttatgcacataaaaaggcattttgttaaagaggagctctagaaaatcataaagcagatgaagatataaaacacgccttctatttctagctgtttgtacaaaatgagagctggggaatttccatgtagaacgggaatggcctataaactagtgtaagaattcggtgaaactacttggttaagatataatttaagatattatttccaagagttcatacagccctgttggacaacatttcatcacagatactagcttgcaaccatgctacggcaatcataaatactgttaaaaagacatttagctaagtgcctcagttagaaattaatttctgattgaaatatccacttaattaaattcaggtatggtactgaaacttggtcatatcttacctcaaagaacctatttctgtacttgtgaaatatagctttattaataattttaaagtgcttagagttccgatatttttttatcaaagggtattatataagtaaaagtaattgtgtcttatttcctgtgatagataaatgttttctttctcttttgaaatcaaagataaaatgcacatatgcactcaaatgcaaacatatttgaagagtttgaaatgtaaacattcttattttgcaattgcttacatgagaagtatatagtctcctgtcctcttccatcatgctccctgacagcagccatcatttcagtcccttgagaatagaaaggaaagcagacaaaccacctgaaaactctggtgaaagttctcatgatgtggcctccagggaacagcctcttgttttacttgaggctcatttccgctgggccatcctccttgcatgtcactccatgcctactgtgggtaggaaacaggtacttggattgactgattgctgctttgagattccttgacatattttttcatcaacatgaaggcaaaaggacatgaatactcagtcaaaacatgcagagctgtacttacgtgaacacttttaaaatgcgatactgaatcttatataattttaggataatttatgaaaaagcttttctttcttggaatttcttttgtttactcacaagtgatccaagcaaaagatgaagctgttaaaccatgagtcagtatagtatttttttaacttaacacctgagaataaagctgaaaggattgtttaaaaagtgtttcaaatcatactttcaaaatccatctgtgtctggagacccttaaataagcacatgcttcatggtcattatcccagataactgacaatttgtttttctacaaaatctctggatattatgaaacatcacacacgagcttgcttttaggatagattattaataatgtatttttcagacacaattgtatgtgagagtttctgcaagtataaacaataagataacattacagcagcaggcaacactcactaaaatatcaattttgaattgtctgctctctctttgagaaggagaaagagctaactgagtatctttttccctcatgatgtacttactggtctccaatatcctatgccatacaaacagtggacatggtccttgcttagctcctatgaaatacggaaactgcctacctgcttatttttgagggaaaaaaaacttttctagaaagatttttagacaaatgatttattggcctttgaagcaaggacaagtgctataacaactcattaagggacagttgagctctagcaatcaggttttgagttatcaagattattaggaagaaaagttgacacagtttctcaggaaaaagacaaggaagcaaagcattgaaatctgtttctgacttggagtgtctgccagatcctagtttacaaggctggctttctgcctaatccctagcattttcatcagatttgaagactgaataaagtgaactattgggcattagagcatatttctagagcaccgagacctcttctataaatagcataacatcactcttctattttaaccaatgttcagaatccgaggccacaagtttttatatttaaatatgtataaaccagatcattctatgcctgaaagtactagggttttatctgtctgtgtacaggaaattcttctgttaaaagcttagttaacaatatgacattacaaataatgtacctatttttagtggttttattaaattataatgttaaatttaaaaagccaagcattcaccttgagctacatctgagcctgataattcaaaaagtgacatttcagtacaaagccaacatacccttaaattgacaaaactgccctgcttttaaattgttttgtaaaaaagtacttgatatgcaagtttccaacgacttgttttttttctggagaatcttagatactttctgaaccactcttagacaacacagaatgaatattaatgacaggagagagctgactccttcaggcaaaagtggatgagacaagttcttttatgcctttgagaatctgtttcatcatttatatattgaacacatagcaacagttttatttctcttgatttctggacttttagacctgtatgcatcgaagcatattacacctcacagcctgaataggaaagatttgttcagttctctggttataagaatgatataggaattcctttgtgttctcttcctttctgtacattttattcctttctcatgtcttctcttcctactctgcccttcttccttcttttcttcattcttttgtctttcctttctttttttgtatcttaattaaatattttcctatagaatcactaaatgaaggtttagtacttttgacccatagtaatcttcaccagctgaattaatttgtgtcaacaactaagaaatgtaattcttagtttgtatacattttaggttagcttcacaaaatatatgtatagataaataaaggagcagccttttaatttgtttatgtaattggcacacttaaatggaatgtgtcatcatatgaatgtttttaaaattttgcatgtaaagggcttgcggataatttttaaaccgtaactttttgcagagagacagaataatgttttagagtccaaaaaactggcatgtactatttggcatgtttttctttattttctattttgccattgcaatggtaacaagttactgtgttcatgacaggcgtgcagcactgtatttttatttgtttatttattttattgccttgtttgatgttgataatgaagaggttctctctcttaaagatgcaatgaaggagactcaagtgttgttacttgcctgcaattacacatttagaaagcctcttatattttttgtctgttggaacttactgcctcagcacttaataaagcaggaaaaagcatgttttgtaattctcttactatgtaagaactagtttgcttttgcttatctaacatcattattgagtataagatacatagtctttatttatcccactgaaaaaataagaaagatttgatataccattatttcttctgtgactctaattgcaaaataaattgagtttgtgttttaaaattattcaagggacatttttgtaatctacaagaaaagtcactaagcttgagtcactaggctaagttggcctttagtcattgctatatcactgtgatgttagataagtcaccttatttgttttcttatttgtaaactccatagttccaagccaccaagtagggtgcaatgagaagtgattgtaatcataagtgttgtagctttatcactaactctccaaacttatctcttattattctcctcattgatattcatacacaccttcttgctgttccttcacataacattagtggaagttgttgaatctattgatactttttatcttctattccaaggtagaatggttaaacattctgctctaagtgaacatatccaaaccacaattattattcaattcaaatatgaagtctatcagttggcaattctttgtgttaagaaacacatttgcgagcaatagctaatagccataccattgcaatgtggaataatataagtgtgtttgtagctaatctgatttaagaaaacaggaattttagttgggaagggcctatagaaagaatacaaaattatatgaaacataggataggtattaagggagatatttgaatgaatacaggtattcatattgtttcttacaatatgtcaggcacttttctatgtactttccatgcttcatcccatttaatattctcaataactccttgggatttgtgctaatttgtttataatttttaagtgagaaagtagtggaaaaagaataactgagcaacttcccagggtcacattatgtagtaagatgtagaattaaacccaagctacctatttacagagccaatactcaatcataggtagtcacacaatcaataaactcataaatgtcagaagaagagaatagatggtggcaaagaggtagaggtacccaaaagagattaaatagtgataggcaaattgatccactttataggttaggtcaatatgagcatgatggcaataggataaaagtatgaaacttagagagctggattcagatagccaactctggaatggtgaacttcaataagatagttccccaggaatgaaaatgcaataatgtttgcaaattgtctggtgccctgttactatatggtagatttgaccacctttgctcctctttctctttttttattttcagaaattctttcacttgtaaaaatgccacctgactcaaaatgcttaagcaagaaaagggattttggtgctcatgtgaccataaagttcatgaatattctggcttcagtcataggtggaaatgggagctcacaccatgtggtcagaaccaagcctattctccttcctaccactgtaccactagtactcaataatttaacgactggtatgattataccagtgtgaaaagtctacctataagaggatattggctgagttgattgttatttaattctagttatgtccttgccttactctgtttggcttcctcactttttaatgcagaagggtagatagtctttattcatctcattgcaaagataagaagaaagtcctttacaagacttgaagaaattaagcttagtagaaccaagaacagcaaattgcagagccacttgcgtgtaaatgagaatttcaaacttttattagttttgtaaggaaggaggggttatttcaaggagtttataaagttttaacctacatatgctacagattaaacgttatcaatttgtacaaatatattatacatttttatctttgttgtactctgaattgaagaggaaatatttgggaataatatatttcttcggtaagtatgatgatgttcctattatatgccaggcaccatttggatgctggggatacagaaataaaaatagtagacaggtttcctgcatgtaggagcttacattctaaggaagaagagagaccattaaaaacaacaacaaaacattgctatggtacttatataataaatactataaaattgtaaaataggctaataaataaaacagagcaatagtggggaatgtgatcaaccaaaaggaaaaggagccagccctgtaactatcaggggaaagcactggggtcaaatgaagcaaccagtacagaagctctacaatgggaacagtttggtctatttaggtataaagacactggttttatgtgtttcccgtgccttaatattttaattaaaaataatctgcaaacattattaagaagttttcaaaacagtgtaatcatgtataatctcaccatgctttaaatatatgctgtctcatttctgtgtaatatgtttccagtgtgtgttcatatgcttacattttttatggcgacaatcatagaatatacactgtttttactttgacttttaaaatgtattctcagatgtcttgtagacatgtatttttatactccagttttatcttcggaagagtagctgcttttcttttattctgtatattcctcagacactttctacatatcttccgtttcttaaatcttaataattctttccctttcccctcatttctaaagaaattaaatacatggcctaactccagttttattgttcctataaatttaagtcaacaccttaactttttatcacattcatgacacttgtcaatgcaatttccttttgagtatatttttgattatatcctacaaaactctaatttagattttgaaacaaaagtaaataaacacagaaaacataatgaaacaaatcattttgtgtcgattatcacttagacaacacagttcttgtagcattaaccggaaattatttttcctctatctagtctcatatcctggtttcaagaactcaataacctaagtctacctaggttgctatatgatagtaaaccagttgcctacaaaggcatattaacttttgtgagactgcattaccacgcaatctgctacacagtaatgaagtaataattaaagcctcaatcataaatgttcctcttttattttctgctaatgctctctatagacattatattctgataataacatgttttgaaaatggaggtgttttttttttttttttttttgccaaactactctgctccatcaggctcttttgtatcctaaatattttatgttatactatatatatgagtgtgtgtatatatatacacacatatacacacacacgtatacatatacacatgtaaatatatacacatatgtatatacacacgtgtacacatatgtatatacacacgtgtgcacatgtgtacatgtgtgtatatatacacacatgtagtatattatataatatattatataatataattatatattatatattatatattgtatattatatatattatatatttatatattatataatacatataatatattatatgtaatacatatcatatattatatgtattatatataatatatattatatataatatatataatatattatatgtattatatataatatatattatatattatatgtattatatataatatatattatatattatatatagtgtattttgattttttaaatgcacctggctcctctagtaaatgccagtttttcagaattttgcgatgacatttttatcatctctgactcttcagtacctgaaagatattaaggagtgaatattttatagaatatttattgaatgagtgtattagtctgttctcacgctgctaataaagacatacccgagactgggcaacttataaaggaaagaggtttaatggattcacagttccacatgggtggggaggcctcaaaatcatggcagaagatgaaggaacagcaaagggatgtcctatgtggcggtaggcaaagagagagcatgtataggggaactcccctttataaaaccacaggatctcgtgagacttattcactatcatgagaacagcatgggaaaaaccttcccccatgattccgttacctcccactctgtccctcccacaacatgtgggaattttgggagctacaattcaagatgatatctgggtggggacacagctaaaccatatcaatgagtaaatccagtaactctatattttctaacatttttaactggcatccaaatttagtgtatgcatacacacactattagcaaaagttctatgaaatattacttgttatgctttctgatacttttcaattatccttttctatttcattaaataagtactggtcatgatcaactaagtttatattacaatctaacaatgtataacagcctgtattttttttcctttttgagacagattctggctctgtcattcaggttggagagcaagcacatgatcctcccaactcagctacctgagtaactgagactacaggtgcataccaccacgcctggctaatttttgtattttttgtagagacagggtctcactatgttgcccaggctggtcctgaactcctgggttgaagagatctccctgattcagcttctcaaggtactaggattacaggcatgagccaccacacctgtcctcaaaagtataatcttcttgctatattcacatacaggtaattttgtgtgaatttataatccattatttttaagtccacaatgaatctagcaccaatgctgttattggccactcttaagcagattcacgtcagttggctaccttctaagggattcagctaatagctcttaagcttccttttggttgtcatggggttgatatattgcactcttttttgtgtgtgtgtgtgtggataaactttcttgtagatcggaagaggatacacgaaaggaataagggattacctcttttcctttaaaatagtgagtggagaactagtctatggaaaaaatagacaatgaagattgagcataggtatttagagttttgtattcaaattaagaaacaaacaaataacataaaatctgtcaatccttcaccaagtacataatgtgggaattttactaaatgatttctctgacacctttcagtgctaacatgtgaaggtctgtaattgactatggcattttgctgcaagaaaattagacatatgagtaacgcagcacataaagcctttggcttcccttctaacatttgtttactctcatagtggtgaataagtttgaagagtatgtctttcatctttcagtcattcattaatctactcaaaaatagttaaagtacacaaacaaactccaagacaccattagccacccataaaagaattgagtaccatctagttaagagtgaaaccataaggaagtaatgattcattcacatgtgagctgtgaaatagcattgtgtaggatattctgtggtagcaaacagtacaaaagcctcaagggcttcagcacgaaagctttattccttggacataccacatagccattgcggatcagagtgtttggagagtacataggggagagtgtcctctgatttacatagtcattcaaaaatctagactctgagagctccagtgccccagtgtcttataagactgtcatctcaatgtaaagtttaaggattcattgcagtagggcaaagaacatcagaatttcttaccagcaattatctactctcaccctgtaaaagatacataaaatttctgctcacagtccattagccagacccagtcacgtggctcctaattacaaggatataggaagtataacacacccattcccaccccaggcttggaagaagaggatattggcaagtatttgaagagataagctgcatcaggaaaatgcaaagctttctgcaaacacatgagagtgaatgacagctgaaacagcaatggctttatataggaggtgatgcataagatactctgagtgactttggggttatgttaggtgttcagttcattcattaatgaaagcatctctttttaaaaatctaagtctccaacaatgatatgtgtttggttcagaaggccagcactcctggcaaatttggaagctgaacaaaatcattcccgtcttactaggattcctgacacgtagtgcaaccacctacatggcagatctatttagaagcctgaaagacatctcaaactcaccacattcaaactgaactcatcttcatcaacatatgtagtccttccctagtgtcttcaatcttggtgaatgattgcaccattcatctaattttgttatctagaaacctgggagttatacttgtttcatatgtctctcatttttaatctcaaattcagaatatatgtcttaataaaatttttaactcataaatatcttttgaatatgtttacttttctctgtctacattgcagcaccatagttcaaatcaacttgccttctcaaatctattatccttaacttgactttcaagtccatgcattatctggccctacgtattcaccagcctcatttatcatattgttcctttgttctgatactctggccatattggccttttttcaggtttttaatattccagatttttttctgcctcaggatcttaacacatgctggttatgatgttggagtgctttcttttctcttttatctggttaaattctatgcagccttcagatctcaatataggtatcaactattcagggaagatatttttgactcttcagaatcactcagaactttgcattgtacctcctcatagtgacctgtattttccctttacagaatttatcaatttatcattatatatgattatgtatttatttgggtggttatttgattagtaacttcttccccaaccagatttggagtttcaacaaaacaggcatgatttttcctcatccatgtggaccagagcctcacaaatagtaattagtcattacattgcattcctgcctcagatcctttgttcttccccttcccactggatggaatgcacttcctctgtattctcttttgattacttcttcaaaccttttgtgtgtttactcaatttttgtgtggtctttcctgaccagtcttgtagtacatttatatctcctcccacttccctaacatctttcttcttatcacttatcactctttgaatacagtttttaaataaataaatttatttatttattgcctccctttgatcattagactgtaaattccatgataacagagatttttatattttttacttcctgatctccgaatgcctaaaacaacacatatttgttgttccataaatatttgttgagtcaatgaataaatgaactgtgaattgtctctccattaattagaacagctctatgcatctcatccaatgaaaaaaatattaatttaccagtcttaacaatttgcatagagatgacaagcttatacctttaaagtgcatgtaggaaattttctttttttttgtagactaagttataatttacaataagaaggccaaaatgactaatttgtctattataccatacttggaaacttaaactttctagtgaaagggttatatttattataaaaataattttcagcttagctattttctgtcatcatccaatcaccttcatcctactgaattttcctcctaactattgctaatttgtttctctaatctcacactaattattgtaagaaaaaaaacaaacctttttccaactggcttttctaccttacagtcctgctttcttccaactcatcttcctcacagtcacctaagtcactgaacacaaatgtgatcagattattcttctgattgacatacacatgcagcttcctcaaaattagaaaacaaaaggaaatgcctctcattcctatatacccattataattgactttgcttggctcgtcacagtacttgtcacccccaaatacttccctcctgtccctctccatgaacaactgctacccttaactacatcaattttatatcgctcccttcacttctaatttattttttaggtctgtttctcaaagaaatttttcccaacccatctctgtagttcaaagcttatgtaatactctcagcatatttccagcattacatttgtcatgttgttttaggattattgttcatagagccacccccttttggttttgaactcgctgggtttaaagattgtgtcttattctttgtattcccatttactggaggaatgtctggcacataacagacattatcgaaccttgttgaataaaaagagaatgagtatatttagccttgatgggggaaaacttctaaaatatgcacagaaatcaggcattttctaactgtgtttgtaaagctaaacttgattatatcactagccatttatgctttggggagagtaagcttcatgcagtctagggaaaccaagtaaccttcgcttggtaattttcctttcaaaagaagaaaagaggagaggagatgaggagaggacagaggaagggaaaagatagaaaaaaaaagaggagataaaagaagaagagtaccagctctctttgagaagctgattctagggctcatctttgacaagagaaatgttaagatgatttttttggcttgctaaacttgactcatccctcaggcatctgcttaaatcagagaggatacttctgatctctcaatgacaattttgtctcccattatatttcccatagcaccctgtattttttttataacatttgcacaatttgcaattatatatttatttattatactattcattaaatgccaggagaagccactaagaacataaaccataagaggtcgggggccatgtatgctctatggaagcagccacaatgccagttacactcaacacctgacacatagtagatgttcaaaaaacgtttgctgaatgaatggggagatgataagatgcataggcgattgactgaactttaaatagatgctttctttatcccctaatctttaaagaagtatgaagttttctgtattggggaggaaacagaaaataatattgtagtctggtatatttgagggaggatgagcaggcttggttaaaatagaaagctgagctttccacagtgattggatccaatctgaatacaaatttaatcactctatgagtgtatctactatcattagacactaaaattgtaaattcagcaatgtaatatggctgactctttaaaaataaatttttattatttatatctgagagtaaatattcagttttttcatattatagtagtatgaataatttgctttccaaaattcctccagaactgccaagaattggcaaactctgcgtggtagagagatttgaacaaataattgcaacaaaatgaaaatatttcggtaaaccctaagtagacattaagtttgaaaatattgaaaacttaaacgattttaaagaagaaatatatttataaattcatatctcataggtgagggtactgatgagactaaatttagttgacagaaatctgaagtgaatgtagagaagtgctttaaatatatattgctaaaattttaaccttgagtttttatccaattgttttgataatctcttttctctgaatcatggcatcatagatttttttttcttgtttgcttcttttctttgtaatgggaacagtctgtgatcttacatcctctgggtgtgaaaactcattttcagaaactacctaaaaaagtgcagtgaaaaataaatcttctagctaaagataaagtagagattgttactgaaatacaaggtcatatgattttttaaaaaaatatcttattacttgattacccagttgagaataactatgtcaaaaaatctctgagattctatgtgtgtatttctgtaatttcttcgaacagtaatacactaaattataatgttataacagtgaacaattgatgtttattgacacaatgcaaaaaataagattgagttaagtcctctatgattgcaggaaccatttctatattgtttgcaattttttccccagtaccgacctagcaatacatggcacatactaagtagtacttaaaaatctttggtggatatcactgaagtatcatccttcttgattttttcattcgtttctcactcacttatatatttcttttgaataagtgtaatactttaatgtgtggttttggtaataagccttcatgaactgatattagatgtagtcaagtcttctcttccaaggtgaaatatgactttctttcttttctcagtctttgtttccctagattaaatcaccaggtagctcactgttaagtttcaaataaaatatggtaatttaaatgctcattttgtcatggacaattaagagtgaagagatgatgtataataatatattccaatttctctttaatgggaccaactaatgttttggattatttgagccaatgttacctatctctgaaacagataatcattcttgactttctcttttccctttcactttctctccaccttttcttctttctctatttttaaccacttcttcagttatattataaatctctatggcatccaaagtgcgaaggggttctgtcactgaaaaagttattccttctgtaaatatattcaatgtatacttaatactatacacatgaaagtgatatttttaagaaaattatgattcatttctagtaaagagaaatattttaaaggaaatattttagcttgttttttaaataaaaataattttctaaataaaaaattattccataaaattatttaaaatactcaatctaataatatataaatggaaaaattagtcttttttcagacactgttttctttcagtcagccactgttaccaatctcttatattctctaacagaaatatttaaagcccctaacagaaatattgcatttgcaaacatcacatttaaaatcaacattccatgatatacacaacggtctatacattttcagttagattattttatttatgttggattagatattactttatacaatctacagtgatttttaaatgtatagttatatattttatatattaggaatagctatatctactgcttttggttaatgcagcattaagtaattgtgtgaaacatgttaatttgaagtgattttttactctaagctaattcagtttgataatttagtttttttctagtaaaatttgtgatgacagtaacaatgaacataaggtgtactaaaggattttatagattgatcatgtctaaagatttttgtaaatgttccacttctttcatactgcaaagtatccttgtgttaacatattttataacatcttgtttgtttaatattttcattaataattgattctctttatcataatcttagaatattttaatgtttgcatttctatatacattcagacattataaataaaattttataattatatttaatatatctttggtttggggctgcaattgttgagtttaagaatattaaagcttttcaaaatgtaaacttgttaagaatgagcttgcacatgttagctacatgtaaaatctttttaaaacaaaaagaaaaaatatggaatctgtctgaagaaatatgaagttttaaaagtgtttataaaatttggcaaatttaataataatagtttatatgtatagagttttcattacataccaggtgctattttaactgtttttgtatattgcttatttaatacttacttcaaaacctctgtgaactattataatgcttattttggaaataagaaaattgaggcacagagaaatgatactatttgcttttaggtcatagctgttaaatgttcggggatttggatttcaatccactagtatctagatgatttattacttcattaattcaaaaatctctgagcattagttcaaaatgtttcagtattaataagttatttaccctcaaataacttacctttcagtgggggcagaaaaataagtggagaaaggaaggaaggcaggaagggaagagtgagaagaaagggggaaggagggaagggaaggaaggagggaaggaaggagagaagaaaggagagagggagggaagaaggaaggagggaaggaagaaaggaaggaaggaacgaaggaaggaaggaagggagggagggaggaagggaaggaagggagagagaaggaggacaggtgctattaataagctttattttcatgattgctatcaaaaaaataaaaataaaaaacaaggaaagagagtagagagtgccaagttgggaatatgaagacagaatacatttttaaataagattgtcactgaaaatcacatttcaccacagatctggaagaggtgaggaattaagctagggttaaagatcaggccatgcctggtgatttcaaagaaagcaaggcgtccacgtgggccaggtgctgcaggctgagggagcactgaaagctttttttctgagagggaacacagggccagatggtgtaaggccctggggtgactatggtttttatttggaatgagaggtgaaaccagtaaaggattttgagcatatgagtaacacatccaactttgatatttttaaggatcattgagaataaaatattcttgctagaatagactgaatagggccaagggtggaaacaagaagggaatttggactttgttggcctatgatggaagcaaaatacatatctattttatgtatttcctagattttgtgacctctaagtacattaagatagcagtggaaagctcagaaatacattcctatccattttttataagaaatggagtttaacttccctcatacttggtagggcttatcataacactaatttttttaacatgttatatgtacttcctcagccactttgccagctaatttattatcctggggcaagtaaataaaagttgggctaacttcaaggcatctaggaaaatagcagaaaaatatctttttatttttttctatgattgaaagactaatgcattcacaaacgtcagagaatgagaagcattaagggttcatgaatatagagtgagtgcaattggttctaaaagctatcctcctcaaaattcctggattggtattgcttttcaagtaagttattttgagacaaaatggttttgcttttcaatatttacatttaatttcattttaaacaaaaacagattgataccaacattcacagggatacctactgtgctgaaggctgattttgacagttgtaagataatacatgcaattctttgaaattaatcatcacctaaatgttgcttattatagacaaatacatagcaacaaatttagaattaaaagatgtttgtaaccatatgcctgtgatgatctatattttaatcagtacatactcctgatgtttttaatacacagtcagcaagtatttacctattgcctgctctgagatgagcattcagccacatttgaataatgttttgaaaggtttgggttgttttcagggagaatataaagtaaacagccaagaaagacccacaaaatgcttttggagaaaagtgtatgatagtgcgttatttattgctcaaataaagacaatggatatttaaataaaagccatgggaaataagctgatacaagctatatggggttaagtcattcaacacattttcatgatctatatttaggcatgagattaaactggaagccccaccagtcagtgtaggatagagtgccagtttatgtatgaagttttagaaggaatatttttctttgagattaaggaaataatggtatcccatgatacttgcactttctaccttttacagtagtcctccttacccacgatttcactttctgtggtttcagttacccatggccaaccatggtctgaaaatattaaatggaaaaattccagaaataaactatttgtatgttttaaaatgcatgttgttttgagtagcatgatgaaatctcacgccatcctactccatcctgcccaggacatgagtcatctctttgtccagtatctcgatgctgtgttatccacccgttagtcacttagtagtcctggcagttgtcacactgactatcggtattacagtgattgtgttcaagtaacccttattttacttaataatggcccaaatgcacatgagtgtggatgctggcaattcggatatgccaaagagaagccataaagtgcttcttctaagtgacaaggtgaaagttcttgacttagtaaggaaagaagaaagaatcatatgctgagatcattaacagcgatagtaagaataaatctattcatgaaactgtgaagaaggaaagagaaatccatgcatggtacacataattattggtactaggcatagtttcaggaatacagtaggggagctggaacatatcccctacggataagggaggatttctgtaacgtaattgcttttgtatattatcttccctattaggacaagagctcctcataagtaaagaggatatctcaatcatctttatatccaaaattatatatcataaagttactattcagtaaatatttattgattgaagtaggtgatgacatactaaaatataatttcaatatctagccctttctttagaagaaattgattattcatacttgttttaaaaacctgattgtatttctcaagtataatattgttaacttattgaagacaggtttacactgttaagatttaaataattaaaaccaactaactgaattttatttctaaagaggactgctcaaattttgtgcccaaaaaactatgatagacaatttaaagtaagagattttcaagttataattagtagtggaactcattacatgagaaaattaagatgtgtcattggtaatagtaataaggaatataattttgtagaatcacagatattataatatttttaaatcctttcttaagaaattgatagtttttttcaaaatctatgattttggaggatgaggtattgtaggtattggctttgtttgtagaagattacacatataattgtataaagttagtgtaaatggattgctcatatttcaattcttagacctcatcttcatttcctctcctggaaatccttgtgtacaattaccctggtaaatggatggacccatttcaatattttatatttaatttcattttaaataaaaatagattgacatcaacatccccaatgataccactctgctgaaggatgattttgaaagttgtaagacattttatgcaatcatttaaaattaatcatcacctaaatgttccttattatagtcaaatgcatagcaacatatttagaattaaaaagatgtttagcaccgtgctggacacttagaaatgtccaataaatatttctatgatagttattatcatcttttctaatcttgttggagttgttcacttttaggagtgcttcaaagatcacttcttctagtcaccttctgaactcctctttactttttatagttcagcataccactacctgctgattggttaatatctttggtagcttctgagtcatggttcatcaggaaaccaagggtgcgatttgcattcaagcaaatcctcctccttcctcctgctcactgtcacttctatttttactttggagcgcaaggttctttaaggcgtctggtattctgaggcttcctgcatttacagatttactacctgcttctctataagaaatgtgaattggtgacaaatctttaccagaaaaaggcaattgtaattagattaatacctaaggccaaagcttttctttgctccgaaacccgtattctttcccctttttagactactatcaatttttatctcagttccttcagagctcctggttaattttttttttaagaaaaaatcaagacttatttgagaaccttatagttaatgcattgacaaacatgtatagaattcctgctttgtctgggaatgtttgttaagaactagttcaggatttcttatcctggcatccatgtttcttcaagggtttcagagaattttctctgaaattttatacaaaatgtggtgtatacatttgcatatgcatttttctggggaatgagcttatagctccaatcacgttaccaaagggttgagactccaaaaaagttaagattcactcactacactggcagaaatacaaaaaacacatttccttggttgaggaacttgtaatataaatgaagctgacaccataaatgacagtataaaaataaaggtgaaatgctctacaataggtaaaaagagaaaaatcacttaataatcattttggagaggaataactgagactttgtctggatttagaaatgttatttatgaaagttttatgggacttctatcctgtgtgggaaagagtgtgagcaaagccttggaattagtattgattagagtgcatgggaacataacgaagagcccatgtcttgaataatattgatttataaagaaagaaaggttattgaacatgtgagatattaataattctcatggtttaaaatgttgactaatacaatgatacattgtagttgatattttagctaattacccttagatttaaacacttttggattttgaaaaccttaaatattcttcaaggatgttttgtaaaatgcctcagtcacaatgatcatcatgatatataattaataaagacactggtccatttcccaaaggggctaaacacagttttccaataacaaatcacattatagcagtttacactgacacagactgccccaaacttatgtatatttgagttttattaagtacattcagtacagtttgcatctgggcctctgttttatttgattaaaagaaaaaagttcaaattttatggctaaagagagcagacatatccatttgaatattccactgtcacctcaaaaataatatttttttcttttcaagcagtgcttttatttcttacaatctgtacaataaggtgacttgccttgaaagcatttcactttttctatccaaaaaagttataaaaatttgcaaagttaacttttataaattgatagtgttgtctctgactcacatcatcatattagagatgaatttccatagtgggagggaaagaaccttagatccaacatacccacaatagtattttagatcaagaaacaacagggtggggaacatcacacactggggcctgtcgtggggtgacgggagcggggaaggatagcattagtagatatacctaatgtaaatgacgagttaatgggtgcagcacaccaacaaggcacttgtatacatatgtaacaaacctgcacgttgtgcacatgtaccctagaacttgaagtataataaaataataataataataataatgtatcttaaactagactgttcaggatgctctcctcccttctacttttatcatcttcctcctcgctcctttttcttccaagcttcacagtttctgtccattgtaaccagtctttcattctccaactccctcatctttcccaaaatggactcattttccccagaaaattactttcttcatctccttacactgtctttcttattttcactcctcgctataactgcatttctgttacctccaatctacaatccggagtctatcttttcctttcaccattttaaatattgctctaaattcaaggcttggctgaagagtaaccatctgctagaaagtttctgaattacaactatgcaataattatgccatagaactatgctcctaacatgcacctctccagattttaggtacatagctcactattttatttagaattaattctactgattcctcatgtatatgtgtattacctatcttctcacccaaactataatattcttgggtcagatataagtctattttattattggtttattgtttgttttattttgttttgttttcatctatcagatcattaggcacaaaatgagctcttgatatgtagttattaagacactggcaagattttaggaggggaatgacacatagttgctagccgccaacatataatttatggtgtacaaagcacttttacatgctttttctcatttactaatcatagcaacactattatatattatcatccacattttgcagataagaaaacagtacatttagagaaagtcatcgatttggttaggaataggaaactagtaaattgctaaactgagcattaaactcaacatttttactccatacccaggtttccatgttaccatagctgtcttccaaggctgcattttgtacaagagagttaaaaatgaaattgtttctaatatctgtttgattaaaggaaaatatctggaacaaatttgtcaagatagttaacagaatttctaggtgttactgaattttaaagtctccacggtgaaatgatggttaactaacatttatttacatatggaagaaggtatttttggcagctttttaaggtgtaaaacttaagacacctcagaacatgtaggataaaaggaaactttgtcagggatgtcttgagaaacctgtggcaatttgaactgtgctcaggaggaaggacacaaatcatggctgtagtgagatctgtgaagtagtcttccctctacagcttctctttaaaagctaagtaatgggtggcaaaataaaccaaactgaaactgagatgcatgtcatctcattagtgtcttcttagatccacagtgctagcactgataagctcaagtgctgagaattgttcaaataaattctatgtgcaatcaatagaagacctaagaaaactgtgaataagttaatcactataattttatatattaacaatttttcattctctttctcctgatataaatatttttgtcttaattcttatgaattgagggtcaagttatgtctggttttccttccatatcatgtatggtctgcctgaactatagatctggcaagtccttgaactatgctaagtggtttaaatgggataatacttaacatactttgataaaaaccaggtggcttcactcattaacctcttggattcactaatatggaaaacatcatcttatcacgtttttaacatgaaaacaacctacctactacctaccactaatttttaaaataataatcttatcattcaaattatagtacattttaggttctgcacataatactactcagaaattagcttagtcacatacacccaggggatcagtcactgctattataaaaatcaaaaaagttataaaccattcttcagtaatataaaatagagaaaatattttagcaataggaaaaatgaccagtatagacctaaacaatcagttgtttccctttccccacctctctaaacacacattttaaaataggagccgccccgatcaaattttaaattttggcaaataaatagaagacttcaatcttccatagaaaataacattcattttattttactggaggtctgatttagaattcaaaaggaagtcaaaatttaaaaggaagtcaaaaggaagtcaagattaatttggaaataatgggacacaaatatatatggatatttaatttagcaatacattaatcacccaaaataatctcaagggaaaaagtttaatgacaaataacggtaaagaggagaattatttttttcagaattacacaatattgttgaaataactagatatgaatcctaatttgagtaaactcactttcacagagaacttaagagaaacataagtcatattcttgaattgaaaaattaggatgtataagtagcattataatattctcataatggtttggactcactcctaactaaattgcccaaataagttgatctactgctggcctttgccatcaaaaatatttaccaatctccactaggattgtgcagataaatgcaatggctgccatcattacaatcagtatgcatgtacttactgaggaggagtctacaaatgaaaaccaattcctgggaatttgtgggcaatttcaatattaagagcaaccatgactaacagtaaatgacaggctacatttttcaatttgctaataatgattcttgctttaatttttttaaaatttccactgctgatttatcaaaatatatggattagcactgactgtaaagttataatctagatggatcattattaattcttagtactaaaatacatatttttgaattaaacttgtcaaaaattcaattctgtctccaaaatttgaatcaatgttaagcataactttcaaagccaactcacctagcaacattcttctacatctgtattaaagaggaggaaagtcttagtgccaataatcactgaatactaaaaaaataaaatgctcacaaacttagatactcatgaagtctgaactataagagaatatcctggaaaagttgaggcaaagatgtcaagtcttctatttgaataaaatttgttatcctataatttctgcttacactaggccagtagatgacaatatgttatgaaaacaaacttctctgaagagaaactaagactttaactaaaaagataggtttaaggctagaatttatctcatgttttatagataagcaaaaaataaaaaccatggtgcagtgttaataaattagaagtgagtttaatgtttattttatacggatgattctgccataaccaaggcaattataaaaaataataataataataaagttgccctctgcatttctcctgaagacctcaactttcagtctctcatgcgcaaagatgcttccaggggcttggaatgaggaggctagcaatggatatgttttatttttggaaaatctgcaaaaataagctgttttaaccaatattggtgagagcactgtgttctttctacctaactttgtattcatattgcttttataatttttctttttttttccaaaaagattctgataattgtacaagtgtcaagaaacttaacacctggaaccactcctacattctttttctctgcttcaatatctctccccatcagtcctgctcactgaaatccttcctagcagtcaaggactaccctaaatacctcctctctaggcagttgttacagtatgtttatagtacttcgattgtatccattttcagttttaattttactcggtcttaatttatgattgtgttttttaatctgtttttttttttttttttttttttttttttttttttgtgatcaccataatgtagtagcaaatgtctacagcctaaaataaggctggcagagacttgtacccaagccttatgactttctagctgtgtaacatacacaaaaaaaagtcacttattcttttactctgattgagcctcagttcccttacattttgatacgcatcaaaataataggattctcttcataaactcctcacgattaaatgaaacaatgcatattaagtgcttatcagagatcttggacaaggatgacaactcattatgagctagttcttacaattacggctatttaaagccaggcacagaaagccaaatatctgacgatctcaccaatatgtggaatctaaaaaagtcaaactcatagaaacagagagtcaaatgctggttaccagagactgggaggtggggatggggagctgttggttaacggacacaaaatttcagttagacaagaagagtaagtttaagagacctattgtacatcatgatgactgtggttaatagcagtatattgtatacttgaaaattgctaaaaagtagattttaagtgttctcaccacaaaaaaataattcagtgaggtaatgcatatgtttattagcttgatttagccattccacaatatatacatatatcaaaacatattatacaatataaacatacacaatttttatttgttaattaaaaattagataagctaaaattaaaaactaaaaaaaattgtgaccaagccactatttttgatgtattctccgttgaggttttccataccatcctgcaaaatacttagaaaataaatatttattgaaatgagtaactcatgagaatattacttttttgagatataaaattattttgaatacaaaatgagcaaagataaaaaagtgttttttcataaaactaatttgtgacatttaggattataggattaagtaatcagcatattaaataaaacaaccaaaaattcttcaactataatgtttattctgtcaaatgcataatgtaaaataatatttgttttggcaattactgaagactaagcatttgtttgcctcccacataataagcagactaaagaaaaacacatttggtagcttgaaaaatggcatcttcatatgaaaaattaaatatttctatagacacattttcatttatttgtgataaagatttaattttaagtatttttaaaagtattccataacacaattccatttgttgttgttgatctatatacttacccatatgtaaaatattttaaataataacatatttgaagccaccgggcacaaaaatgaatgattgtgaaatgtgcaaagtatttgaatagtgagagctaattctatactattaaggacaataaaaagtgcaaaagtaattgtaactgctaaaatattatttcaagttttagtccatattttgatctatggtctaaattgaagtttattgattctgtaactcattggagtttcaacctagagaaaccagtcactgtattatgctgggggccttataaaaagtataattgtgtagaagaaagaaaaatgggtaagagaaacgtaaggacaggagacaagtcagctatttagttaccatgcaatgcagttatttgggagctttttctcaaatgtaaactgagaataattatacctaatttaaagctgggtggtgcatagagcacttggatcaatttctggcatatagtctgtgacagagctatgtaaataaattaatgaatttatatctagaaatccaactctgtataccaccaaatccctttattattttcttttctctaagcatttaatgtaaagtttgaactgtattattctttcctactaatttaaattgctgcttgccctatttgaataaaaaattgcctatttctatggttttgctaaatagtgaataactagtgcccttacaggaatcacaagaaaaacacactgaaaaatgtacttggaagaaagaatatatggaaatatatgataaagaaataactgggaagatgccttaggataaattatgaaagaaaatattttagctacccttttctgttgaacaaatgagaaaatgtggtcaaaaaacaaggataaatctattgggaaaaaaaatttatctcctattacccaaaattttacctgaaacatgtttttaaggaaagagagaacaaacatattctgaaacatagaagaggtgagtttaacttgaaattaagagcaaccaccctccccaaggggaaaaatatctccaaacctctctcctcatgtaaacagagactttagagtattagcagtcaacaatattttcattaattatttataatgtagaaagccatgcccatttaattccattttcatttaaaacactacaaaatatgatatatcttcattttaaaaattatgtgaaaagaaaatatctgaattatcttcatttctttttgatgaatacaaaaagagaaaaaggaagtagtttttactttacgatttctatatctttaggaagataataaggaatcttaaaatccaacatataaaatatcactttctacagcaaaattactttcaataaatggaaacctataattaaataatttaccttccttaagtctgagaacctcacaatcatgctcttcagttcttttgacttaacaaaatatctatataagtgtatgacaatgtcaatagtcaactgaaggcaatatattcgaggtaaattttattttaaacttttcttctatttcatacatatagactacaaaatagcaaacctggcatttaaatatataattccttcaaattaattaaactaaaacatgtcataagtagcttttatacatgttttattaaaaataacacttagaaaatattcagcctaatttatctttaaaaatgtcaaataccaggatacttttaatgatttttgagcataaaagaaaagcaacttttctttctctgtggttcaaagatacagacatgggaatattacccagtaaactatccttgtaggattaaattttcagtgaccagaagctagattgttttgttttgttttgttttgtttaacaaattaggctcaaatactgtccaaacctaaaagtggatcttcatcattacataaattctgcaagcctaaacaatgacagcccgagactgttgtacagagacatatgtgagactttatcctgatcctttaaaatgaatagtcagatgatggtttcacactgatacaaattagatttcatatgctgatatgctcaataatgctaacaaggatctatatataacttattaagtgctacaggcagagcctatgctagggctttacatctaccatttcaaatgctcatcaaaatcacaattaacctattgataagtttgtactggtaatttaaaatttggaggcattctttttccagtggttttgaaatattatgttcattagagaatatagtgccaagcctctgatgcctttgttggtttttatttcatgaagttagtgtacacagcacctctgcctgagcagagctgaaactcccaagttaggacatgaaccaaatataagggccacccagagcttgggtttaggcagccttcctcacctttagctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttgaagatggttgttttgtaatcttgactcatattgaatttaaggttgacgagaattgggccttggacagaactaaagcctacgttgttggatagcctaaaacacaaaatttgttaactcttaagaattaatgttttatatggaacaaagtctttcaggaattctaaaagtcatacatcaataaagagatttttatgtctttggtaaggcttttaagtactgtcatattaaatcctccctaaaataatttagctcagaaatgtacaagcaatattaacacaggtttttttgcttaaatagttcattagcctctgtaacttcttgaatataaaaaataatgccaggatttttttaaggtgtctttaaatctgctagcaagttaaagaaaaggttaaactttttcagacgctatgctttaatgaaaacaacagaagacacatgttttattgtaaataagtagataacttttctattaagatttggagcaaggctatgcaccatacatgctctgagtgggcttgattcctccagggaagaggccaggaaagcattgatgtgaaaacagcctttcccttgccattctctccattccaggcaggttatctgccaagaagctcatccctatctgtaaaactgccagcatcagttcatgcagcattcatgtgtaatttgctttttctggagagccataccagggcagagttgactgattgagggaattaaaagctacagactctgggacaggagggctgccctgtgggtatatgagctggttacattttggccccttttcaaaccagggatatgcaactcttgatatgtatgggaaaggcagaactgccaatactgacagcgctcctgagcagcgcaaatgctccacatggcaaatgcatcattcacagaggactcatcagagcagcacccagaaaaaaaccaaacagagcaatacacagagagaccaactggggccagattttgtatataaaacattcctcgtagagtgacttataatgggtagaaaaaggatacgtcctgaatggcaaactattatagtactgattatagtacatccatacaaagaaatatcatgcatttatgtatgatgatggtaaagaaaaacctttaagatcttcaggagaaatgtttatgacatactaaattaaatattaaatttcagtgcagtatgtatattgttacctcatttttaaattcttaactaatttatttggaaagaaaaatggtaattaagatcaagatgtggagacaggacaaatgaaagattataacgaaaattttaaaagaggccaggaaagcattgatgtgaaaacaacctttgagatgacagagttattgatgacttttcatgattattaattcctgtctttgtgctcctatgtgttatgcaaatattccacagacaataaagttactccttttgtaatgaaagtctgtgtaattaaattttttttaaaaaaagttgtgacaggtataaaagtttctggtttatgaacaataaaaactacctctggggaccttgagcaaaataatgatgggttagaaggctattaaagaactcctagaatctgctgggtggctagatccaagcttctgaaggatgtcaagggaagctccataccaggtgagaccagggagctgaacacaaagctggatcaggcagaccaagagaatagtctggctacaactcttccacttgacaatcgatctgtgccacagcctttgacccctgggctgtcctgccatgaataatcgttagttccccttacatttttgctttgctttgccaagaaacaaaaacttaaggtggtgtagtatatatgcagtatatattaccaccccatttcccatggcatatgccgatgtctgagcttccagggacttgcatgtatatttactgcttcctttggcttctagtgaaggcatttctcatattttgagatttctgtaactccctgcctccaatagaaaggtgttggatgctaagtagtggcaaatgtcctgcacatgaaatgttggaatagaagataaagtattgtgttagtacgtctctggatatttttaaaatccttaaaataaatttttacctgtccaagaaagtctaattgtgtgtgccacaattcctaagactctagaacatttccataatttgtattatatatgtcaagcataatacaaatacattgtcctagtgatcaatgtgtgatctgatttatgtatgcattgccagcctcagacaccatatattagtagcaatatattgtagagtatcattgggctatttttttttcaaagagctatggaatttagtctttttgaaatactaaggcagaaaaatgtgaagctaactaccgaaatttaaataaaataaattttcagttatgagtgatatatagtaatgtgtctttattaatggacttgaatgaaatgtgcaaactaaattaaaatcttggaaatctataattaggttaataatgtagtgatgacttcttaccagagaaataataacatttgataggatatgcttttttctttcataagatgttttacaagataagaaataaagttatagatataatacctgtgactgggttgtcttatgagctaatagatcgcattcaacaaatgaaaatgaaaagacaaaatatgcatcatagacaaacagatgatgccatcatctatgaatgcacagtatgggttattggaatggctttaacacattgaagttggtctagtaaaaattcaagaagcaatttagtttttaattcacatgttttaatttcttcttttacccacttaggtgcatgcatttttataaacttttataaccaagttctctaaataagcattttttattaaaatgcttacataaccacattgagaatagaaatagctctttaaatattgctattaccttggggtatataaagtaagtctcaaccggcaattcaaaaccttctatgatctattcagttgaaattaatcccctttctttcccttcatgtttccactaaactttgctttaacctttattatctgattcaagtttgtattatatgatgctgctaataatgatgataatgatgaacttttagtgatttgcaaatcaaagattagacagattagcaggtttgttcaaggccatgcagctgacaaataaggtattaatactaagatccagtcctcagcagtcagacttgagtccatagttttcatttctacacgattgatagattatctattttcttctctgcatcatcagttttttgaaggtgaggcattgatttttatttagtattacaactttgaagatacttaggaccaccatgaccaccaaataactaaaattaaaagaaaatacaccaaaaattttagtacagttgtatagtgtgattataagttctctatctcatgtttttaccactttaatttttttaatattctataatgaacagaagttagcataggggaatactttagagtagaaattttggtcaaatacaacggattttaaattacttcttcctcactttacgactataacaggttatctattgcttcatctaatccatgaattgggagctgttggtgaaaccgatactcaagtttgttgtaacaactatatatacacttagagtctctggcagaaagcagtcagtagatgctagttattatttttaaatcaaacaaaatatttaaggagagactttaatattcttaaacataacccttcaaatccttaaaccagattttttttctgtacaagaaagtctggttgtatatgctacaattcctaaaactggaacatttcaataatgttattacacagctcaggtcttgattctaatgctcagggtggatagaacaggcaaaaagtgctaggtaatgaagacatgccccaccaggcttcttcccattggtatgctgccttgacacagtcatatttaacagtgaactctgtttggaagcaatttatatgcatatatagatatgttcacatggcgctgctgagataattacaatgttatttactagttttgtctggtatttctgctatgtctttaatgacaaaatgctgcagagacacgggtgagagagacaaaagatgatgaggatgaggtgattttgtaaataagcaaaaagaggaatatttttgcatacttttgtgctggatgaaaccagtagaagagcaaatttaggtctaagagaaggtaataaattatatgcttaaatcaaatacctttaaagaataaaaaaaaaaacttttgatcatcacaggaaaaatttcaaaatattttatcttgcatcaaaaagttacatctaaatattacttcataaaaattatcctagggtttacttgacttttctccatgcaattccaaataaaataaggttttatgaactctgagattctttgaacagtttgaagaacttgaactggaatatctcttacactaagcacaggagactgttctccatatttaacactattttcacagtgtatactaccatatccagtacatactatgtgctcaataaatatacaatgaatgtgtaactaatagagtcaagaggcataaaggacttggagttgcaagacctcgcttcaaccctaggctttgccagttgttgattattcaactttgggctaataatttatcatataaaatgttgtttattatattaaattttaaatatataatttcttaagaaaacatattataaagtaaatttatttatttggaaaattaaaaaaattctcagactgtattaaggaaatatatgtaaatgatccttgcaaattataaatgctaattgttttaaagtcacttccagggcagaatggcaatgctcttaatattatgaaatcatagagcctctgttgaaagagaccttaaaaggcatcaagttcaaccacatctctggtttttaattatctttctacatagggaccagatggacacatgctgtatatttaactttatctttaaggaaattgttaactgtatccctggtatgcctcagaatgttctctttgaattataaaggagtgttcttttcagtactttatttcattcatttagttctcacacaaccccatgaagtactattactgttcccattaaacagatgagaaacctaaataaaaaatgtggttacttgcccagcaactcaaaactagtaagttgtatagtcaggacgagaacccaggtaatctccagagcccattcccataaccagtacagagtaccctttccatgtgaagtggaatgtgaaaatctcctctgcttcttgcacacgattgtggttgaatgtaaggagcaccccttttaattgcattacagtatatcatccaaaccagcagagtccaatttctatacaaatttcagatgtgaaagaaatattctatatttatgctgtccaatatggtggttagtagccacatttgccttttgagcacttggtatgtggctagtgtgactgaggatccaactttattattttgataattttaatttaaataagcacacatggctgttgcacatgccagcacttattgggcaatgcagtttaagttctatatcaaagctcttcagtgttttctttattggcatgtgttacagctcctatttatatgtgagacactctcccatagctgtaggctgacaagacagagaaagtagtgactaaaagtttagatgctgaagagacaagtttacatcttggctgtggagcttagtatgttactctgagtttagagctgacttacccttaaattgggatgattattgaactacattatagaactatttaaaaaaaatttattttgacataatttcagatttcagacgttcagaatagagacaagaattgtacaaagaataactgcatgaacttcactgagaatctccaaaggtttctgaactctctctccaccccccctttctttctctctctctctctctctgtgtgtgtgtatatgtgtgtgtgtacactttattgttttcatgaacaatgtgagagagtaagttgctggcttactccttttcttttaggtgcatattttctaaaaataaaggcatgatctctcatcaggaaattaacattcactagtcttaatactattatctaatctacagacttaattcagatttcataggtttcccaataatgtcttttatagctaaagaaaatatcatcttatgccttgcattccattttcatgtctttaaacttctttattctgaaacaattcctcaatcttaatttgcgtttcatgacatagacattttctaaataatataagccagttattttgtaaatagtctctcaatttaagtttgtcaaatgtttcctcatgatgaaatttattctatgcacttttggtggcaataccacagaagtgatgatgtgtcttttgcaatgcatcatatcagaaggcccatggtattcactgccccattatggtgatgttaacttcaatcactttattatcgggttaaggtgctgtctatcagaatggtgtttgctagtataggcaatgtctgccaataatttcaatgtagttattactttttccctctgtaatgaaaaatatattggggaaagttacattgagaataactaaatatcctgttgctgcctcgaatttttacacacttctttttgcacttattcatgattcttatgtgaattcttatgatgattgctaaatagagattttctagttccatattttctttacatttattagtcgagtttccacctgaaaaacagcttttttccacctaattatttatttatatcctggtagacatatattattcaatgggttgtcatcctttatgtcattacatataatacatgtgaatatacatatatatgtatatatattctttatatatataaatatatatatttgtatatatttctttatatctttgatgctcaaattgtcctggatttgagttaagggagctccttcaagctagcttctacgtccttttgatgtgtctccataattctttgaatacatccctaatttctggcacaagatgaggtttcataatgattttctactttccctcactagccctggaatcagtaattttcctaaaattcctttattcctttgagtgaaaagtatttagaagcctagatcatgggctaggtcttcttcttgttgctactgggtgtcattgcttctaggccttctcagcagatagcctggaagtaggacttgaaatattcatgaatgtataattatctatatgaataaatacatataaaggcatatatatttatacatgtttatgagtatatgtgtcactacatatctatttctatttttatgcctatctatgtatctagctatccatcttaaaactcttaaattcaaactgacgcctccaaaatcaacaccttggagttcattctatcttctcccttttccatatttgtaattcccttctctaatttagcaaaacttagttaccattggccacaatttattttatttctttgctcaccttagaatatatagaaactagtttccaaactgttaatctaggaatctgagcaaaagctactcactagaattgaatatttgttcagagttgtcttcagactcagagtacatagttctaatagtcaaggttcatatagttcaaaagttaactgaggttccccctaagctgtgtggccatgttattcatttgaaatatgactctgttcatgtttttgttttaggtttttagttctaggagttttttcctcccatgcttgttagttttctattctttttaaagtatgtatgtgaaacattaaaaattcccaaaagtcagaaccataaaatattatactcaagaaggtgtaagtccatcctccctttcttcatagagcagttttgaagagtaaataatattataaatgtttagattttgcattacctggcacatatttaggtctcaaaaaatctaatatagctattcatctaataatcgcgctttttctatgttcaattacacactcactaagtacttcatacctttttctcaatgtatgaaaccaaataagaatgcacatatgtgaacaaaactcttctaaaattttggtattttaactcttactagcaaaatattatttgcaatctttctcacaattaatcacgaaacaaactattgtgtttgatttcctagctaagaaataatggcttatttcattccttaaaaagtagaacatgaatgctgcatgtggcataagcacagtgttattgcaggagtaatatagaaaacatatcagggtcagaactcatttagtggtgccttaaatgtgaagaaaatagctgtaattctgcataaatgttataattgttagattgcagagaaacaaagagtcctgaggcatgtctgaagaaatgagcagattacatgcttaactaattctggaagataaggtttctagattaagtcatgctctgcaagggaaacaaataaagcaagcactacatcattagaatctattttattttaatgtatttctttaaagagaaagctttgattctggaaatgtctgacattgctgcatttttctcatgaagtcttctgtgcatacttaactagtgattctaatacgtatattttactagtgatattcagtaaatatgtcagagaacagatttcttctcttggctaaatgtttgcaataaaatttctggataaaatttgaattattttcctattttgtgaatcatatatccttactaaagcatctttttacttcttttttgatcatgtataaaagttattgagtatcataagaaattttaaaacattttatttttatcacataacaggaatggaataaaccaaaaaaaaagtatacttagaaaactcttaaatgacaatacaactatgaatcttaaacatttttgggaagcaaatagagatgacatatcaagatcaaattgtaaaatccatgtaagtatcaccagcatgacaatctttctaagagatgtttacttttagatatactccctatattctttatagtatatagaaactttctttgtccatatcttaatagcagggtgaacttagaggtaagttacaagttgcatacatttaaatgttaattttaatgcacctttggtacactttatattttgaattgaagggaaattttaattctgtaacataagtatcttaatagatacttaatcatatatccagagatattaatagatatccagttttacccagaattttcttaaagtaatacacagatgcttactgattggttagtacccttctttcacatttctgaggtctcatcttccaaatgaggtagattcaacaacgtttccaagttgtagctcctcaggacccaagtcctctccatgctgtggctagggcttccaaagtccctcatttccccacatcaccactcctctttaagatctccttctttcctgatttctcatacaacttttttatgcccatctctgtccttgatgctggagggggaagtgaaactgccaaacatcatcaccaggatgtgcatgaaatccaaccacacattgaaccccagatttccttgggctcttttgaacacccaatctttgggtaagattatttctatgaaaattttgtttcaactttctaaacaattgaactgtaaattttactgtaagattagtgtgcgtcatttaaaaaattttgtgtcttccgtgcgttatgagatatgtcccattctgtaatctctgaccatggaatcaagcttaaatttcatgaccctttctgaaattacataagtgtcttgagtttgtttttaactgatattcacccgccccgcttgttggtctaaatgaagaggaaattatcctaatgactttattttccttctttagatgaaattgttagcatggcaaggaaaaaatatattagcttttccatgtttattgcaataagatttccagtagatatcaggataatttaaggcttccgttgctacagttgcttgcctttctctcttctggttttgaaattatcattaggaataaagaactcattgctttctcctagctaaccgtctatagcataatactaaataccctttcaaaatgatgcttctatttgcatttatgttacttcattctactaattttccctatgctttcactcaaaaagctatggatacctccacactgtgtttttcggtatttctccccgtgttcttctgctgggatttgaaagtatacacttgaacttgaaataaataatagtaattcatgcaatgtaagaaatatgctgctattataggatagggagagagataacttagaaagacataatttgtaacaataaaagttttgagtatttttccttcttggctgacttcgttagtaactatcatagaagcatttgacacttcattttaaagtacagtagtcccccattattctccagggatatattagaagaccccctagtgatgcctggaactgcagatagtactgaacccaattgctgtcaatcttcctgttcatcttccacctacaaatttaatacttattccaccttaactaagcccttatcatacactctagccataacttttatagtgaagtatgacagcaaagcttgcataatttgttttccttcttcccgatttcatgaatagaagactcattcttaccatagacattagcaacctcaacctcagcatactttttttttctttccttaagtggagaactttcactttttcccttaaaggaagcacttcccagcttctgtttggcatatccaaattctcaccaacattactattgtgctttggggttattctgaagtcaattaagggttccttgaacacatgcactgtgatatcacagacagtcaatccatcacagagacggatactaagtgactcatgagcaaatagcgtggacagcttggatacactggacaaagaaataattcacatcctgggcctgtaggagcaggatggcatgagatttcatcagctactcagaatgatgtgcaactgaaaacttatgagctgtttatttccaaaattttttatttaatattttcaaactgcacggtaactaaagccatgaaaaccaaaccttgaacaagaggggaatgctgtatatatgtctgaatcatattccattgggaataatttacataagatatacagcatagctatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagtctagccaacgtggtgaaactccgcctctactagaaatacaaaaattagctggacgtggcagcacatgcctgtagtcccagctactcatgaggctgaggcaggagaattgcttgaacccgggaggcagaggtttcaatgagtggagattgcgccagtgtactccagctcatcagcctgggtgacagagagagactccgtcccaaaaaaaaaaaaaaaaaaaaaaaaaaaaaaaaaaaaaggttattagcagcaattagttttataaaggtaggaagaatctttactcaataattttactttctaacttcacaatttatgtagtgtttgaatgatttacagttagcagttattacctgtctgagtaggaaaagatagagattttcaaaagacaaattttattttaaaaagccaaatgatgtaatggaaagttgtggagtttacagtcagaaaatgtagcagccatctaatcatatgacttactagacttaatttattccttctgagcctcagtattcttacctgtaaaatatgataataattaccaacctaaaagattgttctgcaagcaacatgtgagaaatgtaagctgcaaatagcaagatacgtcttctggttttgtatgtatgattttatactgacttacagatacttataattgagaaagaatgtggtggggggaagggtggtagtgagtaggaccatttgtaaaatgatgagaacaaaattcaataaagaaagctcatgtttctgtgaagtgggcttttttagattacactaataagtgagatctaagaggacagaggggaggaagagttatggagaaagaggagctgttgatccagggataaaatttcagttaaactggaggaataagttttagtaatctattgcactgcatagtgactacagataataataatgtactatatatttcaaaattgcttataatagattttaatgtcttcaccacaaaaaatcagttgctgaggtgatgaatacattaattagactggttaaaactttctgcaatgtatagatggatgaaaacatcacattgtaccctataaatacacacaattattaattgtcatttaaaaataaaccaatagaaaaagaaagctcatgttgaaaattgaaggcagaaagggaaggaaaatacaatgcaaatatactgtaatacattttcaatcaaagtaaaatagctattcagtgctgaaagtaaggagaaagggaattgaagaaaaagtaacaaagaaaacaaaaagtcaaaagttgggaaaaaaaaatagatggagttaatgactcagagatttttagaaatagcaccaagctgtgaagcccaagaatggtcattcaatttggaaaggatgatcgaagcctcaatcacttttgtagattgataatgacaggattaaaatatttttaaagattttcaccacttcccaacctcctccattgggaggttgggaagtggtgaaaacttaaacataaccaagtgttgcaagcaaaatttgatctactgaatgtaatgcagctcttcatggcttcaggttacgtgagcaacaggtataagctaagctttagagtaatatacagatttgtaatcttgtgccaattgcttttcttccttaagtctcattttcctcatctgttaaatgaggttaaaaataatagctattccataaggctgtcaggaggaaataatgtgttgctatacctaagactgaataaatggtaaatattgttgtagttgttggaaaattctccaggcattgtgcatcgatgatttaagaagttagatattcaagtcaggcgctgtggctcacgcgtgaaatcccagctacttgggaggctgaggcaggagaatcacttgaacccaggaggcggaggatgcagtgagctgagatcgcaccactgcactccagtctgggcagcaagagtgaaagtctgtggaaagaaagaaagaaagaaaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggagagggagggagggagggagggagggagggaaggaaggaaggaaggaaggaaggaaggaaggaaggaaggaaggaaggaaggaaggaagggaggagagaggaaggaaggaaggaaggaaggaaggaaaagaaagaaatagagagagagaaagaaagaaaaagaaagaaagaaagaaagagaaagagttaggtaaatattcagagagcttccatctgcccatagaatgcaggacttcaattcgcatcttgagaactgaaattggttacttagaactgagtgaacaagtgtgtaggcatgatgtagatttatttatttttctctcaggagttattttaacaattttgttttgagacttctaacagactttctggagctctcctaccagctgctattgttctgtgtcccttgctggcaagtactgtctttcaatagagatgagccaatttatttgatgctgcctctggagaagagagaagccctttgggtacaaagtgtgcctgtcatgcagatggcttctctaatctaatgaggtagagagctgagcagtcaggagaggaaggagtgttggtaaaagcagagtctgttctctgcacccacttctcccatctatatatgaatagttagtacaagagccactttctacaagaatctttaaactttgacatgactatcctaaagatgagcacatctgagtctgtgcatggctggtgtatcagtgcagtctgtttggacagccactttcctctgccacaaggtgtgtttcctttttattcttcgtgacagtttggcttataaagtcttcccttattgatgcaattgtgagagaataaatttcattcttcccctgaatctgtaacatctttagaatataatctgaatatcaaaatttaggtttttggtttggttttgtttaattaattcatttaaccataaatacttctgtaatgagaaaccaattgtagcttatagaataacctgatagtggtgatgagggagacataagcctgctgccttaatgctttctgtgcctcagtttcctcatgcatataagtgggaaatatgtcactatcttttactggtttcataggattatattcagtgccagttatatttgttctaaaacacttggatagttatttgtgccttcaaaattatctaatgtcatatgaaaatacaaattttgaaaggatactattgcaatgagctgtcagttttaaatattttgatttgaattttattgaaaaaccaaattccaccttaggttttctatctgaaatgtttaaaatttgtgtaaatattaacatcacatggaaatcatattctatttaaattttttgccatcatttattttttatctgactctccttgtaattttattttcaattgccttcagggaacaatatgcaaactcttcgagaactcatttaactcttgtcaatttgtaccaataaaaatcaaagcttatatagtattatgcaaatattttattcacttggataagagggagtccattctactaagtcagttcttgtattaaaataattattcattttgtttcatcatttcaattataggcgcataaattcttatatcttgtctcaaacacaaaatctcagaacgtcttactttcatgcaaaaaaactaagttctaaaaaagcaaatttatatcaccttaagacgtccaaaagtataaaggttattggacatcactcctggtatccttggaaatatttgtttgattttgaagaaagcctctaagcagtcaagttgagtaatatttttaacttactcttctcgactttgaaagagtgcacctgtgaagaaatatctagggcatagatatttcctcatctctctttatcatcttgctttctaccatgttggtctgcatatggttagatgaatctgtgtgactaataccagggcaatcttgacctcagtgtatcaacttctgtgagcctgtcttgtctaaaatgaatttggctgagttatagagcctctaagaaactcttaccagaggaaggaagacaaaagtttgcggtgggaaagtgaagaggtcaaaaaaggagctagaacttactaaataaacattttagcatatattatcaatataagagtaacccaggaaaatcattgttatggcttctatattcttgaatttagtagtaaaaataatttgattttggcttaaatgtaatgttctatttcttaaggtcctgtttctcaaggtcccatttcttttcactctacttgtcaagttcaagaccatttaaaaaattagtattttgctagtacagtttattaataaccatctcatttaaaagatagagatatatgtcaggtgcactcaactttatgtttcagatcaccttggatactgttttagcattagtttaataatttttgataattcatcataaacttccatcacagatattagcataaattctacaggccaatttttttaataaatccttgttttacctcatcaagagagaaataaagagtgagagaaaagtgaaagagagattgagatggggtagaatccgataacattaaaatttaagggaacatgcctgctttgtgtgtttgtctgtttggttatttccagaaacataggaatctcagtaggagaaattgagtataatgttctgtatttaagggatgcagtttatatgtctttttggtcaatacagttattccctttattcagggggatatgttccaagacccccaatggatgcctgaaccacagatagtagtaaaccctatatacactgtttttacatatatatatgtgtgtatatacatatgtgtgtgtatatatgtgtgtgtgtgtatgtgcgtgtgtacacacacacacatacacacacacacacacaccatacctgttgatatggtctggctgtgtccccatccaaatctcaccttgaataaccgtcatgtgtcaaggacagggccaggtggagataattgaatcacagggtgaatcacttgagtcaaggagttcaagaccagcctgggcaacagggcaaaaacctatctctacaaaaacaaacaaacaaacaaaacaaaacaattagccaggtgtggtggtgcacatctgtagtctcagctacccaggaagctgagatgggaggatcacctgagcctgtggggttgaggctgcagtgagccatgattgtgccattgcactttagcctggataatagagcaagactctgtctcaaaaaacaaacaaataaaacgaaataacaacaacagaaaaaacacttgtcttacatcatgtccggaattgaaaacacctgtcacgcagtcaaaaactagattaattttctatgtggaatatagaaaaagaaagaagttgaagtggaaaatctggagcaaaatatttatattgaaataaaatctgaacatttttttgaaaagatacactgaaatttactacacaaataagtcaaggctctctctaaagaatgtggcatataatttttgtctttagaaagtattagaagcatggtgatggctgcacggcctccacattctctgcgggtagatgaaatcttgaatttaggaattcaagcagatcgtgctttctgcccttagagaaaaggtattacatgttggtaactgaggtataaaataaccaaagcccagatctcgtctcgtgctccacggaaatcatgcctcgcccgagtctataattggctgaattcatttccaatgaatgaaatgcaaaaacatggaaaagactaaaattgaaattttataatttaaaagatttaaactgtgaggatggtacatccttgacctagagaattttgaatctgtctttggacaggtgggcaaccataggaagcaagtaggtgtctggagatggctgcagagacatcccgtcccctcggtagcactgattgcattttccatgaaggttgctcttaacttcaaagcagacactctgctgtgaaggttctgagaggttagttctgggtctcgttgtttcaattaatcatttattcaattaataaattttgagctcctgctgtgaatcaggcagtatgctaggccctgtggctacaatataggcatggttcatgttttcagcaaacgacattttactgctttggtaaaaataacaattcatcagaagaaaggctatatactaagttatagaacagaacagaagtaagaccctccaaaaaggaatgtgaatatacaagaatggatatgaataattttccaaattataggttcagcttgggtaaagaaaactgtgggattagttacccttgctttatgctgagaactaagaaaaaataaaataaataaaataaaataaaaccgttcatgttaatcctttctaagacaaacatgcttttatattctgattttaattttccatttgccaatgaaaggctcttagatagcagttaaaagaagtatataaaaattaaaacaaaaaagaaattattcctaggttactaagtatttaagagctacaaacatatataaaaactaaaaaatttgttgtaaagtcatttgaaaaggagtatacttatctgtagccacctaagctatatcttagggcagagtaagcacagcttgatcatataatctggaaaccagaattatgttagcctcataaagtatttccaagtacaaagagttcattttctttgataaaacaaaggagagatacagtaatcttatagccaaggcaagcctttggatataagatttttaaaagcttggagaaaattattttattataataaaatcaattattgagatccactgtatttatgtcacttcttttagagttacatagaaattttaatctttgtctacaaagaattacactttaaaggaacaatttcagtgtaggaaaggttaaccgatgaaaatatcatatatttgggaatgtttgcttagataaggacatagtattcattgtttcctcatttgtaacatatggtggtttaatcagtattatctctaagtttcctggtaacttgaacactaggattctttaaaccctaaggaattagaattcaaattatgacttgtgtgcttcctactatataattgaaaagttaaaccttgcttatttactgtttcttaaatcattacatatgtgttacgtcttttaagcggcttttagtataattcttgtagattggccttgtaggtatgcctgtttattttctttattctttaaattgggtatttatagataattaggaggtaagattaattacaatttttcctttaaaaacctacttttatgttcactaattaaaaaatgcatattctttatttcttagtatatgtagactatatttttctgactttaaccgagtttggcaattttgcatgaacaagcaagggacactttattcaagactattgcagtaggaaaggaaggccagaattcagtctgagctcaactccactgaaataaaaggcagaaatgttcttaaaagcagtggtgggggaatgttaagccataggtgtttgttaattgtctttaccaaatggaaaggaaaactttctcatatcttccaggcaagggatggctttgcaacttggagcaaggtacccctgaaacttaggcttctaccctccaaaagacaggggaataggagctctatcttccttaatgatgacatttcaaaaggatggctcccaggtccttgagaaagacatttctggttataaaactgacaagaagcttttttaaagatttacatttcaaaggaggaaatattttgcaattacaagttttctaaagcaaatgctctaagaaaaaagagatcaagggcctagaatcaggaagcagcctgtctaaaatttagtcaagctgaggggaatgtttagtccaccttggccaatatattagcctgtaatttaacttttttttcgaggtcctgtgattgtgggccttctgggtatgactcatttggactcttggagataggaggaacagtagggatgatgctttgggtactctcctttactctgctatccactatttatttcttgagaagactttgtggcctttaaattctataagttgagtagaaattaaatatttattctggtaacaaacaatgaaaatgtatcttaaatcagtgagattgcatagaagaggattatcattgaaacacaattattaataatatttttagtactttttttagaccgtaaacatgatggggaataaaaaagagaggttgttatattacaaagataaataaattcaaatgtaagtcaagataagcaactacttaaatagaatagccatattcttctattagctgcttcttaccttccaactgaagttaaaagagaaacggtgtttatgtgtcattttagtaagaagactgtaataattacaaattacttttttccttcagaatcttctcaacaaaaagccacaatttctggaaaattctatagtgtgctataatgctgaaaataattcagaataaatttgctcataaaaatgtcagtaagaaaagctaactggataatttttatttctctgaaagccagagctctctaatatctgcttttgggatgctgcttagggtaattaggtatgattttccagttacttggggacgagcagatgtgactggtattgctgagatcctaattttatactgctaatgcaatgcttaccatacaaaggcatgtgaaggtgagacagttaaaagtcgatgtaaagactggaaactgggagtctttgtactatatttaaaataattacaactagggctaaaaataattttatctttgcatttctcttttttctttgttttcatccaccattcccatagcacctgaattctcagggtccctcctctccctttccacccttttccttctatttctttctcttttaacacagcttttctccaggaaaataggacacagaaagaacatctacctgcaaacagccatcagcgagtaagtccagatcatgccagtattcagtaagccatgtctgacaactcaccctttcctctgagtttaataggataaagctagtagtggaatagaaattgagaaatgtggctctactgataaggaaaccttgtcataaagtatgaattagcagcggttgagcagatttacttcaggagtgtttcactgctattatattgcctgttttatcctttggcttctatggacatatcatctgagataatgaccctccatctatttgcacaggtgcaagtaaaaaggtcctaaaatggacacacaaactcacacacatgcacaagtaagcatgccaagcatactaaattacagaaacgaataactcatcaataaagcaaatgttataaagtcctgtgactcatcattcatgatttactcataacacaaattaaaaaataattttgaaataagttgacagattggaccagaggataaatgtaggctatccaggaagtataactctgtacagtaacactaaaggaacagctgccgtctttgtgtagctcacacacagtctgcttttatagaccctaatgaggacaaaaccgattagcagattagaaattgacagaaatcagagacactctgcttaagaatcactaaagttggatagtatttcaactaatgctattctttgttcatctaaagatttatggaatgagtgtcttatgtataaacatctgcctcttcagggaagcatctgtcatgcagccaccaaataacatgacagaggggtactgtgtgcatctgaagagccttaagatctgtggtattgcccaagttcctactgcagattaaaacttttaatcaggtagtttttaaaaaaaataaaataaacctagctcataaaatgaactgttgaatagtttaatgtaaaagaaagcatttcaaaggatatttcatttaaatgcaaatgtggactatgagttattaaagagaatcgagttttcatattcttgtttttctagactcctgggatcaaagtcaccttttgaacttgcaaagtaagcttcaaaacttctgtcttactgttaggatttaagtttattgttttcgctattaaaagacaaatgctatctgaagctttatctgcagcattaattgtcccttaaagacaagggaactgaattaacaggagaaagggtaggactctagaacatttaggtcatggctttggaatcagagctctcagcagtttcatgctttgtggataattaaaatcaatacaaaataattacagaactagaaggatctccagatacctaatccagtcccttgtctccaggagaaactagatctagtttaaactaacttccacacagatacttgagttgtatgagagaaactgggactctagattcactttctgcacttaccaagaatattgcaaatgtggcttggtaaccagtgttcaaaaagagattatggtttttataagcatgacattggcatcatgaaactatcttctacagtctcagatcagcaatggaaggcaatgatggccaaaataatattcatctttcacactacatttatagagaaattagggtttctgacaatgccctatctgctagcttgtcttctcatttttagtgtatcctgtcttatcttaaaagtttagattgggtgctacatcctccatgaagcttaccaatctcaattcttattggttattttctttttgattcctttatttaataagactttaggatatatacataactctatagtaaaaatatagatgaccatataaagcagcatttgccatctctctacttaaatgaaatgtgcttaaatgctagtccctggagcctaacagaatactctttacttagtcactactcaaaaaatgctggttgatgattttttttttctaaatctggttgaaattaattctctttattattctgttctcatggaagatgaggacaagaatgagatgtattgagtctcctgatttcaattccctattccaacattatatttctctttataccattcttaatgctcctttttgttatgagctcaaacatcagaacagagtgaaacaaatatatccaagctccattaactcatttctttaagtaattttaaagagacagtgacttgcctattgcccagtctacagtgcagtggcccaatcatggcttgctgcagcctcaaactcctgagctcaagtgatcctcctgcctcagcctcctgagtagctgggacaacaggagactgccaccatgcacagctgattttttttttaattttttgtagagatggggctatgttgctcaggctggtcttgaactcttggcctcaagcatcctcctgcctcagcctcccaaagtgctggggttaccagcatgaaacactgcacctagtcactttaagtaaaatttaatgtgacaaaattactttgcaacataaatttctggatgactccttggagtttagttttatttttagatacattttcttcctaaagaaaaggggcatggttatcaaagcattttgtaaatcagtagaattcaacatgcctaaggtaaggtgtcgagttagattagtggactagtacaacaatactttctgtttcagaaaggtcaacattgaaaacgtatgtgtgtctgcattactgaattgaattggcgaagttgaatatttaattgtgtgctctgtgagaataactgcagtgagatacatgtcctttagagcatttctttttttctttttcttttctttactttttttttctttttttttcttttttttttttttttttgagatggagtctcgctctgtcgcccaggtggagtgcagtggcacagtggcgccatctcctctcactgcaagctctgcctccccagttcacgccattcttctgcctcagcctccccagtagctgggattacaggcgcctgccaccacgcctggctaagtttttatatttttagtagagatggggtttcactgtgttagccaggatggtctcgatctcctgacctcgtgatccgcctgcctcagcctcccaaagtgctgggattacaggcgtgagtcaccgcacccagcctagaacatttcttaatagaatctacacacacacacacacacacacacacacacacacacacacattatgtaatactttagaagaaaaagatggatcattttcattgttagagaaagtcttaggaaaattttatattttacatctactgcatgctttgcaaaaatagaagagagcttttaatcaatagtaacattaggcagctatatggaattgcatcctatttcactgaatcttgtcattcttgactactggtcaaaatgaaagactgctattacactattacaggaaatgtttcccattgattgttatttctacaaccaacagtctccaccatacttttctatattctctgatccacatcttacatttctttataaatgcttcttcttcctccttgagctaatagacacctggtcagttcacctgccaaaaacacaaggcatcccaagtgaggctattcatttcattacaccagttgggggtgaaaagagagggaagggctgaaaatagggatgacattctcctcagtttccattgccattcaaggaccatcactttcctcttatgtaaaacctttcctctgcacacacatcccagcactgtcttctaatcattgaggacactggcatctggcttactattttccttttggcctcttttgtacaacttcattgtctttgtggagaacccttcaatatgccaacctcctctactgacattccattcagcaaacatcgtcaaacctgaggtccaaagaaaagaattaaccttcatttgattccttattaaaatctctctctccattcaagctttatgtcctttaactctttatgtcctttaaaattattcattgaatcctccaaaacaacacattactgcagacaatgactgcttcccatgatcacatgttcaatcttcttatccaggcattcaatgaccttcaagattggttcttaacctttgtctctagacattttttaattacttgcacataattataactaatccaacgattctccaaatatgcctaacttttcagactccaaatctttctcatggcctctctccatctttccaattctcttcctccccaacaaccccaaataatcatcccctttaaagcccaaatttccaggcattccatgacctttccatgtcaaagcgtccatgtccttctctgaacttctgcagaattgtgtcccactgtctgaaagcatttactttcttgctctgtggttacctatatatttatctaagtctccttaactacttggaaggtagtaccagcttactgtattagtaaaatagggtattagttcagtctctggttctaattagttcttctgacttatctcgccatccgtatgaacaacagttgtaaaatatattgcctggaaccagcttccacttttcctgtacttccaggctgagccgagggtcgacagaaaggaaagccattcagctctggggtcccgacaagttggttgaccctgcagccatgagcggaactctcaaagtcatgtcacccaagtgagaccatgcaaagataactggttacagtgctttgagttctgtatgtgttctatgaaatcatcagtaaaactgaccagggctttcctatgtttatattttccacatcactctctgtatagtagtctaataatagtaaatattcaatgagtattcattgactaagaagaagatatttactacattcttttgtatagagcacaataatttataaggggtttctaatccattcaagtggctagttcttcggtcatctattacttcttttatcccatctgtggttggaatttctcatggagtctcattgtgttaggctgttcttgcattgctataaagaagaacctgatagtgggtaatttataaagaaaagaatttaataggttcatgggcccgcaggctttataagaagcatggtcttggcatctgcacagcttctggggaggcctcaggaagcttacaatcatggcagattacaaaaggggagcaggcacctcacatggtcagagcaggagcaagaggtgaggggcaagggaggtgccacaagcttctaaacaaatagatttcttatgaactcattcactagcttgaggacaataccaaggacatggtgctaaaccattcataagaaatctgcccccatgatctagtcatctcccaccaggccccctctttaacactggggattataattcaacatgagatttggcagggacatatattcaaactatatcacccatctcacaggccacagctttagcctatgtcgaatactaaaactagtagaaaaagcatggcatgtcagatttggcaaaacagatttttaagtaatagtgacaagtcataccatgttacaatgccatgattgctttgaaaatactttgcaaaacttctcaactacaattcatcatatggttcttgtaccttgacaatatttccctgataaaatgacataaaattggcattgttactcaccattgacaagactgcatcacatgatccatctggcttgaacctcatactaagtcagaagttacaacttcttcctgttgaattagttgcatattatcactaattttgcataattatatgtgtttctttgaatgatgatatctcataaacattgcaatttatatctttcagaaacttataccttttggttgtatatattgataaataatatttaaaattagtttattcttataaagatttcagaattttaaaaatctctgggaaggaatatacgctaaaagatgcttaatgttcagtgtagctgaaacatatacttagaggaaggtttttctttttaaacagttaaataatggtaaattggcaagtaccatgccaatcccccttcttgccatgtgtagtacagcagtggtgataatgttagcgattagagatattaattttatttatcttttttcctggagataaaggcttagtaaaagatgaaaatatttcttataagtaagttactacaaacaacttagtttctatttaaaaagtggaaaaagcttctaactcagcctcaggacattaattttatttgtgtaccatctaatatttgtaagtggacttcattttatcttgggagttcagaatgcaaatacaaaaaaaaactcctggggggaaatgcagttattaaaaactcccttagagaattattcaaaagacaggttactttatttacttcaataaataaagtaaaagaatattgtgatcacaacatgaaagaatgaaattaatctgtatttgttacagaacagaaataaaattaagttgtaattaattcaaaacagaaatatgccttatttgtaattaccttatttgtgacagcatttaattattcctttaaatacaattttggagaaactaaaatttttgactaaattttgattttaatcaacacacacacacacagtgtagtcttatgtcataataactgagattaatatccagtatgcaaaatacttgagattaatgtagaataattttgaagcaaaaatgtttttccctcagatgtgggacatgattcagcatttgatacttaaatttcctttgaaatgttgcagagacaaactgtactcaaactcaaataagagcaatttccattattacataccaatcctggaaatgtgtgtgagaatgacaacttcaatcaccaccacatcagtttgccttccttgtcgatttcttagtaaaaccagtttaaaagaatgtgtagccacaggtgtgtatagacaaaactgaacttataaataacacagcaattcagctgtttttttgtttcagaataaataagtaattatttcatttttacaaattatttctaaactttaaaaatataaatgcaccttaacttgattttttttcttacctgagcatctgtgaatgattaattggatttttagcctaagatattctttcatgtatgattttctttgtaggaacttataaagctatgcacacatatatataatattacacatatgatatgcatatgttatacatatgcatatatgtacataatatattcatacatattttacatttatattatgtgtgtctatatatatatatatatatacacatttctttctttctttctttataaaattacacaattttaggttaaccaatgatgtgattaggcaaatgttttcaagccaaacctccctcctctgttcagaaaatgagattagcagtgcttatatgacacactccttgaatcatcagtctttggtgctaatttagtcaaattagggttatgcttctttactaatgtagattttgacaatgtaatccaaagacatgaatctcgtaatattaatgggaagtcacttccatttgtagagagagtaaagaatggacaattgtgcccggtccacccttattcagtccctgatcctcaaccccatagccaacatgcctcacacatatcctacctataatcgaaggcagcccttcttggttttaccactttttctaagattctttagccttgtagaagaaggtttaagggggaaataaaagaagtctagttcaaaatatccagtttcctcttcaatggcaccactcaacctaatactgttcaaagaaaaattcaggaccttttctttcaagcagtaacatccatgagaaaattttaggctataacacagtgataatattgcagctgattaataacacacaaatagttatatattagagaattcttaaataaaactcctttgtttttatttcaataaaatgtctttttaaaaacatttaaaatctgaagtaaacatttccaaaagatcatctcttccaatgagggaacaggtttattcaggcctcaagaatttgaggggcatctggtgaatgccaggtgtcttctaactgaagatacagcaggaaacaagaaagacaaatgtcttgtctttgagaagcttatgttctagtcatacgtaatggataaaagcttgtatttatggctgggcacagtggctcacacctctaatcccagcactttgggatgcctaggcgggtggatcacttgaggtcaggagttcaagaccagcctggccaacaaggcaaaactgcatctttactaaaaatacagaaattagccaggtgtggtggcacacacctgcaatcccagctactcaggaggctgaggcaggataatcatttgaacccgggaggcagaggcaggagaatcgcttgaacctgggaggcagaggttgctgtgaaccaagatcgtgccactgcacttcagcctaacagcctaagtgacagagtaagactctgtcaaaaaaaagaaaaaaaaagaaaaagaaaagaaaaagcatgtatttataaaacctggagcaattcttaaacccactaaactcagtaaatctatagtgcctataacattatactaaataagtaataaatacttttctgatgatacacgtactcaccaaatgtaatgaccagagaagatatgtttttagctaaaatatcctagctttgggatgaacagtaggagcactggattggatcagaatgcagtatacacatatttatttcttatgagtctgcctcttagtaaaaagtgtattttatacctctctgttttcaaaaacacaccaaaacccaagttttgtttcctcaaatgtttaatgacatttatttattgtatctgaatgatttattatgatattgtgatacagcatcacttaaggttgtttggatttttaaaagctattcccaaaagatttgcaactactttcccctgctatcttggttgcttcctgttctcacagaaatgtgaatgatgtccctcatgtattgcttatttcttgagcttttaggtacaacttggcaaatataccaaatgatagagaggaaaaatgaaggtatttttacattgaaaatttttcactggcaaagctcttttcctgaaggaaacatcactcatgtttaggctagattatgtgcgcatcgtgacctagaattggaaacccagtggctactgaactgggggctcctctaaagccaaaccaaaccatttgagcaagaactatggactattcatacagtttatcaaatttagccagatgacagagacagtgtctgacaaaaggttgaatctagtaaaaaaaaaaaaaaaattcacttaggataaaatgtctaatggagattaaaactttaaaatatgtactaaattggtgttccccaggctgttcatattctcagtgcctacagaatacagaaaagctagaaatagctaatgtagctttggaggataacagaaattttgtttggttttgttcctatgttttcttcaaaatgttgttattctttatataactatttaggttattttaattggtttaaaaaagctcgagtctattccaggagggattgtttaaaaaaaaaagatagaatttaaaaaggttgagtctctacatggatgagaaaaaaaaagccaatataagtcttttatataaaccaatctcttaaaacattttaataaatattttattttaatctattaaaatcccttcatagcccactaacattctaaaataccagctatagatttcaagttcattttttagaactttgaaagaaaaatagatatattgcataagaaaggtgatgaacttaataatagttatggaaaaagatacaaatataacaatgaaaggtcctgcagattaatttaaccatttaattaagaaaaagagagcactattacttaggtaattttttaaagtcaatattactataactcagtatattaaaggctttcaaaatgaaggaattagtcatggaatagtgttttgtataattaatgacatatttaactttttcatttagtcatattgctatctttactcctaatcaaaatgcaatttacagaatgtattatttcatcgagaaattaacagctggcttgtaagaaacatttaagttaggttaattactgccttttaaatttgtataatatactgtgacagaaaattaatgatgctcacactatttagcatagttcataacccatattttaatgaaaatatactattattagtgatatacatgatacagatataatacactctaattgctggtcattttatgtctgttctatataattctataaaatgaagccatattcattctgcttattaatttagacttcacagataaaaatttgcatttaatatattcatgtgtatattggattatgtgaattttattaacctaaggcatgacaagtggggtttgactgacagtttctcaagattctaatctggtcaagaattcattttcctttcatcttatcacagacatatgaaaatcttaaactgaacacgttagcattttaagtagtatccattttcttcctgtgcactgtgccaaaagtgagataactacttgcatagtgtccatggagaggtgtttccataacatgccctgataataaatttgtgacaactccagttctgctgtctcaaatgtaagtttcttacagaagcctaagttaaaatctctttctttttctgtagcaaaaatcaaggcctattatattatattatattatattatattatattatattatattacattatcaactaccaaatttaggtttcttgaattgggtcactgctttctttagtcatactaagttcagtgatcgtctttatgccagttgctagtgattggctataggacttctccaaacaaggactacaattataggaaagaaatggtatacctctgagctaatatgagaacacatattttttgaaccataggcaaaaaatactagaaaaagtgccattgtagttgtaccatagaacataattttagaaatataggactcccgtgaaatacttgaagaaaatttgataaatatattgcatgaatagtcaagatggctatattaaaatgggtgtgaaataaagttttattacttttttaaagtaataccaactaacttctgtgcaggtcaatgataacgagtaaaatatgtctactggtttcaagatatttccaagaaagtttagaagatgtgagttctcacaagacaatatagctcattaaaaaaaaaaaaaccttaaataatatccagtttaagagatttcaaataccattgcatttataattcactttgaagtatctatattccagaaaatcactgacaatggcaaatgtttctgagtcattgctatagaaaatatccaagatgggttattgcagacataaaacttcccctaaaagaagagaattcaaaggaggcaagtaacaaaatttatttttgagtgagaaaatatgacagattttcaaatctctcattttggcttattcagcatattgagaaagaagcatatcagagaaacagagaagccacagaggatagtagggcagttccatcccattagggtgaaaggacaaacaggaaaaatgtgaaactgggcaacctaaattctattggattatctgaactatgaaaacctttaagatatgcatttctaactgaacaggaagagtaaataaataatataataaatgtttgtacatagcagcagaataactttttttcacaagttacaaatattttagcatttttctgttaacccacaattctccaattattttttcaaaaacacaaagaaagtaaaagcctccctggaattattactatatactctaaaagtaactgcaataatcagtttggtgtaaatcccttcagacttttggtagtgcatgaatatgtatttttgcattaatgacattttcctataacattttgctatagactagattttcattcagtcatgaggcataagcattttatatcattacatatgaacctaccttataattttgtcactacagtgtttaattaaataactgcatcataattcaattgaataatcctttttgaagtatctttttaatacagtaatataagccatcatgcaacatatgtaaatgaacaatcatgcaacacacacacttctagtggaatttacatttttacacagtttctaataagcctctgtgatatgaggggaccagtttctgtggaatatataggaactgccagggactttttcatatataatttcataaaatcaaaacatttgtttgtagaaattgtgagcattgttttacagtagaagacaatatgtttcaaagaagttgaaaagtttgttgaaagacacatacataatatacggcaaaacaaatcttcaaaatcagttgtgtttggatgattccttggtcattccaggtcaacaaactgcaggaaaggcactttaaatgtatgtatatttatttgattagatcatgcttttttaatcagatggtttgagtctcaaactgttttccttaaccacaaatctctgatttgcttttctaaacagcacaaaaattgtgctgttctgattttcacctaacatccttaacaggaaacctggctgttcagacaaaaatggagttgccatagtgctctagccaaaagtatcagctcaaaaattgtctcagcaggaatgatgggtttctatatttctacattttaaatacaaattgacatcacccatggacatcaaaaataaaattttcccatctggtgcatattatagtatattggaactaattggtttggttggaaaatgaggcaatcctctacataaatgaacgtatgtattctctccagagtgatagtcaagtccaaactctcagtatatggactaaatcttttttcctaattcagtaatcccattgctttcataataaatccttacttgtaactttttaaacaactattttcttttcttttgagtaaaaagcgttctttacctcctaatacgtcagtctattatgggatcaggaagtcatctatttatttattaaacaaaacttatgaaacaattattatttcctagatttatgctagactctagggatataaaaacaaattacacatagaatcaatatcttcacgtagtagttaccaatatagtaggtaggaaagttatatgggcaaggaattgttataatgtcgactataaggtgaaaatatagtccaaagttcattttgagttataatacagaagacatatgaacaccagtgtaattttggtttccaggacaacattaatatggtatctaataacataaaaatgttaaagtaattggaatactccaaggtgggagaaatgtaccatttaatatgtgatgtcaatgtgtaattatgcaaagaaatacaatgcctggttaacagtaatttaaaactctcctagtctgtattttgagtcagtacagtgaacaagttagtcaacctaccagtgagcatgttaaaagccagatgaatgaccagatttttttgttcacctgagtgggtattttgccattgtctaatcgcaacctccgtgcagctcccagtgatttggctacgtgagtgctttctggagcttatgtgtcattcagggcatctctggcgtctgcacttctgtctgttctaatgaccacactcagcaagctccagctttcgaaggagactccactaattagcttagtcggcatagcatctggtaactggttggtgggataaacagaaaagactcccgaagtgaaggatggaaaaatgaattctccaggccatgaagagcaaaatgaaattatgagcatacaacccaaaaccatgaagaagcttgatcatttacattagccgcatctgtaacattgcctggcacgaaatcctgggccaaaatggagataattggaattatgcaatactcagcgcttcagtttggcatcagtttcataatataataaaacttatcatttgtaagcctgtctgctttttcaaaaaaagacctagaacaatttgatctgtcctgctacagcagacactgatgcaggtggtttaaaaacaaagcatttaatcaggcagggttttacttaaactacttgatgattcatcatccagcctctgctcattgtcaattgtgcctctctgagctattatttatagaatatttaaagagcctggactgcatgtgcctctgtcttgggttctattgtactataaattataggtccagtttgtttcaaattcggcatggactgtcaggataccatgactcatcctctgttcagatgaatactgtatatggctaaagcaaaaagtactgttgttactattaatttataggtaattctggaatattcctagactacagttttgtcatgttttaggtccacagaatcactctattcctacattcccctatgttcttctttccacagggtaaaaataaatgagtggctttatgaccactatgtaaattctggtcttctaaatggccactgctaaaggaggttgttcgggatgacacaaccctttctccatcatgaaaacagaccaacttttcctaagtagagactgcatagatttattgaaatcacattctatatgctgagggatttttgttttgttttgtttttcttaagctgactattaaaaacaaagtaagccagaattagattaaagaaaggaaaaattgacctttaatgagaaaaccaagagggcaaaattttttgtgtctcattttttagcactcaataattgcaattaaatattcagtttacttcatccccataggctccttggaagcagaactgtctattttcttcatcactgtattctagcctttaacacatagtaagggcacaataaaaagagcggtggtaggaatcaatgcatgagtgaatgagtaaaagacaagttgtgtggctagactattgtgagtctggagaaagtggatttttttaacattaaaggatgagaataggaatgaatgatatagggaagagatgaaatggatatgtttgtatctggtctgagagtccacttcaaaatgaacattccctcttcagagcacccatgcattgctcatgtgctgctattgcacccatcacattgatttgttatagctcctaggggttacttagatggattagttcacctttttatttccagcatagagtgtggcacattagaagtatccgaagtgcatttatgtatacactgactcatactggatgaacagtatcatcatcgcccaatcctaaagtcttgccccgtttaaggagctttgaggtattattgtcttgaaaactcatggaaatggaaataatgcacaagaagcaatgtctgaaagagtcaggcattcagcaaacacaattttttgtaaaatttgaaaacccaaaccacagtatgacattaagaaaacacaaatattacttagccaaaagaaaaaccattttgaaatttttcataaaatatttagaaagaaagaacttggagcctggagcagtagagtgagaaataaggaaggaatatgtgggagagaagagaaagggaaaagaaagtgcatcagattttttattgttattagcactaaactggtttgctttgggcccttagccagggttgctttttaaaactatccaaatattttttttaaaaatcctcaatgatatttatatgtctactaacatttcagttgtttttatagggtcagtgatattaaggcaaattattcagattcacatggtgaacaaaggcacttcatagaattcttggactacttagagaatcagagagatactttctctagctgctacttcatttgtggccttagagaaataatgcattaatctccaattagatcatgtcatctttcaggatgtttagctaaggtgaaatgtgtaattaaacattttaaattgcatgtcacctccacccacagggttgacacatgttttctttttggtatagttttgtgtaaggattcactcagtatatccagaagtcaccttgaccatgaaaataaatctgctgcaaattacagcctcacaattaactcaaacattatcatctattatttgtgttctctgacttgaggagcaggtatttgatttttttccactttttacttattaacataacttttatatttgaatatatagtaattttttaaattaccaaaatgatagcaggtattaagtgacagtcttcagaatgatcctatgtggtaccctgtgtagcttttcttataataaaaatatacatggaacatcagagagagagagagaaagagagaaagaaaaatatatgtaaatatctttttaatattgagctaatttaagcttcatcagtttgttgtgcatatgatatttaccctacagatttgttttcaataatggtatactatgatgaataactttaaatagaagtatttttcatttagaactttgttgaatattagcacatgagggaaaaataaaatatgtaactcatctatctgtgtaaaataataaatgctagatctaaaggagccatttgctaaaatgtacttaaacaaatgcatattgcctgcattatatttctctactcttttattgcactattagtcagaaatttaaattctatttttgagcttgtgattatcctgaatactaagtgaaagggaagtgatgatggaatttttattttaatgataacaacagttttcaagggagataatcaaaatctttttctgaagtttgaagatgagaaaactgtgtaaatccatctgctgagttcatgtgccttttgagatttgcttttctgtcttttaatttcacatttctggtttttaaattatttctcctataaaagaattttttgatgtcattaatgccgtttcattttgaaatgacggttaaacagagtttctaataattcaacagttctgtttggttttgtacaacatgttatattcaggtgatatctgaatgatcaactggatcaaaattcagaagacaagaaaagcgttgcttgatcgattttcaaacacacattcaggttttgtccatagatcttgaatgccataacaccagttgtgcctcagggaaaagcatatgcttacttgtcacatagatttttagttggtatgttagaccatttgggtcattataacaaaataccttagaccgggtaatttataaataacagaaatgtattacttacagttctggaagctggaaactcctggatcaaggccctggcagattctgtctggtgagagcccattccttatggtggtaacttctatatgtcttcccaccacagaaggggtaagcaagcttcttggcctcttttataaaggcactaattccattcatgagggcagagcccccccaaaggcccacctcttaatgccatttttggagacacaacattcaaaccacagcaattggttttagtgtcattgaactacaagctttataaggaccagaaagaaacttttttttttgcccttaacctaacagttttctgggtccatgcgttttattttctgccaagatatttgtgtgtgtgtgtgtgtgtgtgtgtgtgtgtgtgtgtgcatgtagagagagagagagagagaagcactcaaatgcaatgtctgcactatcaattgcattttcccctatcttttgaaatttcaagttcaaactcgtagtttaatatttttctttggctgaaaataaatgagttgatctgtgtggaatggggtgataaaagaggtcaaggtgtgtgggtaaggatggaaacttctataatatgaaaaaatactgcaatgaaggtgcagtatgagggtgctttacttctctattgaacacagatactttttgaatggaaatgtggtatgtagtaatttgggagagagtatcttagtaataatggagtaccaacattgacagaatgactggtatgggggggcagaatgtgcatttaataaatatttcacaaaagtgcaataacagtctgagaaatacctggaacattttaacataagatattaatataaaacacagacaaataatctggagacacacttattgagtttgaatcctagctcttctcctttttttttccatgatgggcaatttgtttaacttccctgagcctcagtttcctcatgggtaaaattggggaaacagtagcatctatttcattaaattgtcttgatggttaactgagttaatatctctctccctacccctgctagaaagaaaacttgaggaggttttaacgtgtttcaggaatgtggcccaaacacctgaaacaatgatgaaaatcattttaaacttaaaataggcatcaaaaatgaaaaaaaaaaagtgtttattgtcaaaaataatgacatttgtgcagaggttctgtattttagtagccaattactctgtaatatttattgagatttgactccgtatatataagggagtttcaaaaagcttatggaaaatgtagttaaaagataaaattaaaaatataaactttatttcttgacataagttctatcaagttcaagaaacttttgtacatgaagaactaaagttcctgggaatttaaatgtactctagagcagttaaatggagtctatttttcaaaacccatctaggccataaagcctttcctgacttgaaaaagaaagatcaaataggacaggagccccacatcagtgatttcaaggagaatgcacagcagagtgaatatggactatatcctttgtccattttatcagaggactaaggagataaggtcagaatcagaaaaagatttgctgttgaaagtcacatttgttgattccactggctgtccactgtttgagggagactgatgggcaaacatctgcttagtttttctatcaattgtcaatttaccggaaaatatacccatgtgccttgattattaagaagaacacctaaaaccggtcacagtggctcatgcctgaaatcccagccctttgggaggcccaggcaggaggacagcttgagtccagttgttcaaactatcctgggcaacatggtgagagcctgtctctattttaaataaagaagaagaatacctaagaagtagttactttttttccctactttcattttctccttaaataaaagtgctttctaagtattttaaagaaaactcttctttctcatcctgcctcttgctgaagcacttacgacgttcaaacattaagcataatacttacattatttcaactaatacaaaaactctttgggatgaattttattgactttattttgaagctttaaaatgaactcagaaagattaagtaatttgtctgtgatcacacagctagtaggagagtagagccaaggttggatcctgtttctttttaaaggaaaagcttatattctttgcatttctttgggagtcaaatagcgtgctgaactgaatcactacatggtttttgttattgttactgttgttgttgttattttgggttgttaaggtcctgtgcacatttttttttaaacctggagatcttaatcttgtaaggtgttttcaaataatactcacaaaataagtaaataaagaaatcctacaaaatgtagaaaatcagtaacattataccaaattgtttggttcagaaattgcttaagactttaaaatcagttgacccaatctgtaattttatttgctttccagccttcagataattttcaaacaaaagaaataactaaaaaactttaatttctcttttcctttaaattcttgcatagtttcatgtgagatcatagcctgttataattctgttcaaactaatttttatggaaaaaaaccatttttgagtgtacttttcatctttctttgtgaagaaagttataagataaagatttatctcccttctccaagtgtcctttaataaatggattatgcttctgaagcccaggtagtttcaagcaacagcacaaacactgcacacaagagctgtcacttagaaatgaagtaatcaataaacacttcaaatttctttttaaaatttatttcacaaatccaaacaaaacaagtttgtctataagttccttgccatgtttttttttctttttttcccctgtttatataattcttatttagtccctatcagttatgttcaggaacaggccaaaatcaatcaaaacacaaacaaggccgggagccatggcttacaccagaaatcccagcactttgggaggctgaggtaggtggatcacctgaggtcaagagttggagaccagcctggccaacatggtgaaaccccttctctactaaaaatacaaaaatatgctgggtgtggtggcacacacctgaaatcccagctactcgggaggctaaagcatgagaatcacttgaacctgggaggcagaggttgcagtgagtcaagatcacaccaccacactccagcctgggtgacaaaagcaaaactctttctgaagagaaaaaaaaaaaactatgcattattgtttatggtgattgagttttattacttgcagctgtaatttgaaataaaggaaaccacactatgcttaacctcattttggatcatttacgcaaacgtggaaaactttcaagatctgtatagtatctgagaaaaatatttagagggcttacaagtctactttttttttgatatgtgaaaagatttcctacataaatattcttataatatgctaactcaaacttcattctttcatttttcagcaaattattcagtcaatccatttagttactttgcaaactgatagaaagctgtcaatatctacaaactgataaaaagctataaaactgcagcataagggaagcccatttgcattcagctgagtttaacttgaatacctagataacttctggaaatttgagaagctacctaagctggaatgcgcaaatgtagctacctgcttacctcacagttattgttatgaaataaaagactaaaaccttaaaaaaatacagcatgtatatacgtaatttatatatgcatgctgtattgagggaaactcgggagatgttccaaagtgttgaatcagctagaagaaagatttttttaactaaatatgtatgttcataaatatatttagaataaaattataggtaactgcaaatataatagcttaagatgtttgtttagagttactgagataatcttattttaaaatttgtaatttaaaagctaccttacataaaaatactgattttattttgcttcaaatttgttctttaatttttttgtacacatctgatatcacaaaaacattgtttatgaattggcactgctaccttaaaatgtaaatgagggggaacttcgccatagatatccattattctgttggacaattctagcaagagacacctaaaaaggaagaataagtcaaacatagaggttctagcctcttattacaaacaacagctgtcagggcttcttaagaatatgtgcccatcagagaaggctgctgagttcttctgtgtctgaaattaataaaaacgcagttgcaatgccagctatgtaagccagggaggaactcggtggaaaagtgagataacaggggaaatgtttttatgtctttggagctgtaagtgcatttcaatgttatgccatgatcagaagggccatatgaagcaattttgtttctgaagaattgtggttatagagtttgaactgcaggtatcagtaaacaaataaacactactggtgattttgaaattgatacaaagccaaagttaggaaaaactgcattccagaactgttttaaaatgtaatataaattcaaagttccaaaatttatatatttttaaattcttggttttttaaaattttaccgtctaatagtcaatacattagtgaagaaatttaataaaaatggcaactttaccactcatatgtttttctgggagttatgctggcttttgttttaaccccatttgaacccattcttttaggtagatttctttctaaacattggccttttcagattttctctaaatatgcatttcaagtaataacttgaatttcaggaattttttggtcatatttttctgccacaatttaaatatatacagcaatctggcaatatagtgacctgcaaaatcagtgctcatttcttgagtgaataagtaaatatgtttataatttggaaaatagaaacacttttctgactcaatctttatccctaagtttcccttatcttaaagaaatgccaaacaacaacaacagcaacaccaacaacaaaactgagttcctttagcatgaatgaaaccatttggtgagctaaatgtaacaaacaaatgttctcgcgtgcttcctgctctgggacatcccaggctcttgaagaggaccaagttcagagcggcaccatcagtgtcatgttatgaagggggctgcaggatccgcaggtacccaggaaggattctcacttacatcaatagggttagagatggcttctgggagatgtcacctggaatatggaacacttttgaaaattttcaagtgaaaaaaacttaacctagctaaaagttttaaagaaggacctaccatgtttttttcctgtagaactaaaaatattagtttatacttgaattgcaagaatgtctattagcccagtggtctgtgttcacatgttagcactttggagcatacggtagaggtggaaagcaatataaaactatcagaattgttttatatagcccaatatggctctgtcatccattaattttctaaagttttcttcaaaaacacgtatatattcattctacctttctgaagtagtttatttctgtactcaaaatgcccattgagtatttttttgttgctgtttccttaagtttgctacttcaagctttattttttttaagaaattttttttttagaaaaagtttctcactttgtcatgcagcctggagtgcagtagtgtgatcacagttcactgcagcctccaactcctgggatcacttcctacctcagcctccagagtagctggtactacaggtatgccccacctacccactggctaattttttgaatttgtattttgtggcgacataatcttattgtgttgcccaagctggtcttgaactcctggccccaagtgatcctcccacctcagcctcctaaactgctgggactacaggtaccagccactgctcccagcacattccacactttaaatagttcttaccctcttaaattctaatgatgcaagatttctgtgaccacgttcctattgaaccaattggctgctttcatgtcttcatgaaaattgatcatacctttttgtctttgtagaaggagaagattttatctttgtaactatgtctcctatagtaggttgatatttccctgggtcgcaagcagtatggcatataaacatgagaaggtagttatagaatacattgcttaacaatgagcaattcttaggcattactaatgacaacttgaaactatttaggcagaagggctcttagtacagataaaatgaccatccttccagaagatataagctgtataattgaactggaataattgttgaacatggtatccttttcttttctgcttgatatgtcatattttggcaaatggacataatcatttactaagtagctgatattatactttagcaacttcacagtgacaactttttgactcataagttactaagaaccaatcaaagataaaaggtaatattataatattcttacaattttttaatgtcacataattctatgtaactaaattgtattgagacgaatgtatcggattatgttgtttgttgttttataggtttcttctcgtttttgttttcttttgttgttgttttgctttgtttggcttggtttggtttgagtttaggtttgcttacttcagtgttttggactgtgctgacatagagagtctacacacaagtttgggtcactcagctaacttaaggaattatctcaatgaggctgggtatataatggagcaaacatacatatgaactatctaatatgattgttacaaacgttaaataacttaatacgaggtaaagtattttgaccactgcttggtacgcagtaatcattcaatagcattctttctttttttttttttttttttgagtcttataattaataatagcatcacttcgtgggtcacgtacctttgcttttctcttgtgcaaacttatcctttatagcctaatgatcaataaatattggacatcagtactagaaaactatctcaatgtttatgacctaattacatcaaccaagtgggtaaatttgtaaagagattggaccaattgaataagtatatatatgtgaggtgtgtgcatttccatcttgtgtggtgggggagagagagaggttggcctgtgtgtattctcattcgtaatctctataggatattctaaatctgagctgtcatttaaattatgttttaataatgtggctcataggtacaaggaatttgattaatcagaattggaaagaaaaaattgtgtagcttaacttgtacatctttgtttccctgaaatctactcaccatgccacagccaaaaatgatgtttcaaaaattcaggtctgatcaagtagaattgcccacccggcttaacaatttttaatgacttcctttttcattttattgtggtaagaagagttaacacaatatctctagaattaattcatcttcataaactgaaacttcataccaattgaacaactccccagttccccttgcccctagtctcgggcaaccaccattccattttttgattctatgagtttgactattttacctgtctcataaattagaaccatgaagtatttgaccttctgtgactgtcttatttcacttagtgtaatatcctcaagtgtcattcatgtcgctgtatattataggaattccttctccttgaatactgaataatattcaatcgcatatatatatatatgacattttcttatccatttatctgtattcttaaaatatgtttatcatagggaaaaacatcatgacattggtttttgcaatgatttcgtgagtctgaaaataaaattacgggcaacaaaagcaaaaatagcaaatgtgactacatttagctaaaaagtttctgcacagtaaaggaaacgatggcgtgaaaagactacctacagaatgggagaaaatgtttgcaaaccatagataatgatgggtaaatttttaatgtaggaactcctacaaatcaatagcaaaaaaaacacactgacaacccaatttaaaaatggcctaaataccagaacagacatttctttaaagaagacatacagttagctagcaaatatatgaaaagatgctcagcctcacaaatcattaggaaaatgcaaatcaacaccagagatatcacctcacacctgttaggatggccacaaacaaaacaaaaacaaaacaaacaaaaaaacagatgctggcaaggttgtggagaaattgaaacccttatatgctcttggtgaaaatggaaaaagggttcagctgctaaaaaagcaagaggaggcttctcagaaaattaaaagtagtgctattatatgattcagtaatatcactcctgggatttggtcaaaagaattaaatcaggataccaaagagacattagcactcccatattcatagcagcagtattcacaatagcaagatgtggaaataacctaaatgtccattgacagatgaatacattttttaaatgtagtatatacatacaatggactactgttccactctcactttgctttctgtgcttcagctgtccccggcacatgctcactcattttggaggaatctttggcattctgaatcatcctcctataacactttcccatccaggccccacccaactaatttttaatcataatttagatctcaacacaaaggctggcacaaaggtaagtcccaaaaatatatgtaggatgaatgaaaaaaagatgaatgaataattaattgaatgtgtattttctcagaggctctggaataaagtataatttgaaaagttttcattagtagtttttcctctatttgagttagttttatattagaattatgtcaaaacccaacttaaagcttccctttcttatatttcataatcatgtatctgaatgtttaagattcttagcagggtaacagagaaaagaaatcctttatgtgctactattttcttttaaaatttagggttactgcattaagcaggggaggataatacatactctctttagaattttggacgatttgagataaggcccaaaacttagctcactgaaaatggaattactgcacatatcaaaactacactgaatggtcacaattgaaatagtgaatatgctgcatatggcataaactattttactatttgtgctctaaagtgttataaaactgtagtcatacaaagatactaaagtttaaaaatcttaaagtaaaagaattcctgtaagtgttatgaccttaatcccctgcaactgtctcagtctcctctcacagcagtcttggttgtttagagtgagtaattgagacaaaaataattcttttgaaagaaaaaacatttgagcctcaaatgctgataacttttcttctcctcttagaagagcaaaaagaaagaaagatacaacctctgcactttacttttatatataacaaggttgttgtggtcaaataaatgtgaacagtttagaattctataaaattataaaatactgatgtaaataataatattttattattaactattattaatgcaaatatattctgatatgccactgaggaaagtgatacattttatgcacactaaataaaaataggcccaatctgacaatgagaaattattcctaatcttatttctaagctttgtaaaatttgtaaatttaaatgattcaaaaattttatattcactttaatcttcctctatttgttagttcctcaccatattggaaatcaatatttgttgtctgatatatttcttaaataatacgaattaaatattgtgagatgttttaggcctttaagagatatcatttttccttttcagtttatgaaaatgctagttgccattttatatgtacagattaggcagctactatgagcatagaacaataatactaagcaagtgatgcacaacctctgctctcctggagcatatagtctataatcctctgtttccagcttcctactgaatatttgtgcttgattttcctattggcatttcaaatatatgatatttaagttcaaatcaaatacatgtgttcccctcaaatctacatctagtgctaatacttacaatctttacaattataacctagtaaatcaaatatcactttaactagtctttgagggaaaccactttttgagagttttcacaggtgagaaacaggaggcttaatggggctcagccacttgccaacaatcacatagttaataagtcccagagctgacacttgagccaagatcggtctccaggccccattaccatcatgtgatactctctcatcaaagatctcatgttgcgtggagcctagtaaatcatcaaaaatattctggaataggcttggtgcagtggctcacacctgtaatcccagcactttgggaggctgaggtgggtggatcacgaggtcaggagttcaagaccagcctgaccaagatgttgaaaccccgtctctactaaaaatacaaaaattagccgggcacggtggcaggcgcctgtaatctcagctactcgggaggctgaggcaggagaatcgcttgaacccgggcggcaaagattgcagtgagatgagaccacgccactgcattctagcttgggtgatagaatgagactctgtctcaaaaaaaaaaaaaaaaaattattgaataaacgaatataattgacttttattaattcatagttcacatttttttactatatctattttctgttttgttgacaaggtagtgggaagggaccaacatttgctgaacattaaacatttacatttatttgtaatcatttatttgtttatttgtttattttttgtattatttatttattgtatttatttgttattatttgaatcgtttatttgtcatatatcatcccatcttatcctcttaactctaagattggtacccttatcatcattttaaagaagtgaaaacccaagaaattgaacaattttctctaggccagtgtgtgttaaagtcacacactgactttagacagacaattccaagtctgcctaattctaatgacttaaatctactacaccatcttgctgatccattttgcctagcaaactatagagagtagtttccttcttcacatttttagcgtttcaaaagatgtatggcaaacatttcttccatattacttatatcaggtaagtcagaataaaaaagttgatgaggtgtcacctatttacttacagtgcctcagcctgaacccaggagcatgattcaaaaattcaggcatgtgtgttaatttcccactacatccttttgatatgatgttggagaaagcacttattccttctgtatcctacagatacatataaagcataccaaaaagttaatattcataaaagcattttcttgccaaaaatagataaatttaagagaaatcattgttgatttctgagttacatgtaaagtcaatatatgctgctaaactctctttaacttttccagtatgttacagtttttaacaatctgttgttcaaaaactaaataccagaggtatataaaatattagataatatttgagcataaactgttgaaggcaacagcataattttatttccttatgccataatagagcatcacatctcagtcagcctaccccaatgatgacatattttctgaattgtttttacccacacatcttatgctcaatttaacaaatatttattaagtgcatagttggcaaggtgacactatggaggagatgaaaaagactaaggtatcatttgtgcccttgaggaattaataatctgacggcaaaagctgacatgtatacaatcaactgtagtatttgaaaggataaagtaagtcctttaatagcaatataaactgctcggctagtattgagagagcaaggctagagggcagagcaatgtgaagcttggattgaagtggcaggatattaaaggcaagacatcagttatgaagctaaagcatatataggcaataacatgataacagcctgaattagtcagtggactgatagaatagaaggaaaaggaataccaggggcatttcactggaagaatcaatagtatgtgacaattagatgtgagagtggaaattaggaggagtcaaagataaattcaagttttcttatcagatactgggctaggaaacacaaaataagaaaactgtgggagaagcatatgacatttcatttgaggtttgtgggtttaatataccagcaagccatctatgagcagatagccatcagtgggaaatttgagtctacagtacagtaaagagaccagcagcaaagatatacagcatagcagtaattggagtacatagaagattatagaaataggaaagtgccgaggataaaaacttgggggaaattaaacacagatatgataaaggaagagtaagcagaaaaatacactgaagtagaacacaaaactagaaaaaacaaaatgtgtgtgcattgacacggaaccaaaattttgaaacaaagagtgaaaagaagctcaacaatattaacaatgtagaggagttcggaattgagaacgaggtatgggatttgacaaccaggacttttgtgatgactttagtaggatggaatggggaacctagattactaaagattacatatctatatatggaagtaaatgcataaaaatttactatgaaaatttaattgtaaataggagaaagaggagtatatggttaaataggatgcaatgtggaattaatattttgactcagtatggagaaaattgaacatacttgtgaaccagtagggaacagaaatagagaaaaatgtagcaagaattcttaacccaaaatcacggattaggagtctattaggttgtttttgatctcctgcaagcctaggcaatatattgaatgtacatgtagttttattggaagagtcatcacattctcataaagattcatacacccctctagcccccaccaccctcaaaaggaaactttggaatctctgaaatatgtagacagagtattttatgagcaatgcccaagggaacaagatgaaatgcatttgagaggatgtatattctacactatttcattgaaagttcatctgtgaatttcaagtgttccctgtaaatttaaaacacatttaaaaggagtaactcatatctcttaatttactctgaatcttgagaagaaaatagatctaaaaggatctccactgtattcattagttcaacaaatgattgttgaacacttcccaatctggggcatgcatagtgcagagtgtacttcaacaattaagcaggatacctaattaacccagactttagagggaccatgccaaagtagggttcagtaatattttagcagacataatatctaagctcaggcatgaaaaatccattcactcaacaaatatttatatggtgctcatataggccagatactatccaagatgctggtatcatgtgtgtgaataagacaaagtgcctgccctcatgcattgtatgaaagagagaaaataaacaaatgaacaagtaaacaaattctataatcatgtagtgataagtgttataaagaaaatatatatgcagtgacccttctgtatccacaggttcaacatccttggattcaaccaatcatagatcaaaaatatattttttagaatttgaacatgtagagactttttcatgttctatttcctgaacaatagactataacaactatttacatggcatttacattgtattaggtattataagtaatctagagataaagtatactggaagatgtacgtaggttatattcaaatactacaacattttatatcagggtcttgaatagccaaagattttagtatttacaggaggtcctgggaccaatccccaatagatactgaggaatgactgaataagataaaggtacaatggcaatggaagacttccctacaaaggtgacattcggaaaaagaccgcaataaataaaagaataagccaggttaacatccagaggaggtggagggaagagcaaatgcaaagccctgggtaaaaacatatcttggttgggcttcaggaatgaccaatgtggcaagagcagtttgaggaggacagagaatggtagataaggccagcagagccattatgggccatggcaggggatcaggataggaataagtcaacttgggattggaaggagtagcttggattggaaggagtagcatgacttattccagaagtttgatttgactgtgatataatgaggggagtgtggtgagatgaagtaggagaagtcagcaggacccaggaaataaagggcattataaacgtaagttatcatcagagcaaaggtgagccactgaagattttaaatggggaggtgacgtgctttatcagtcttgcattttgagtattgcattttcactggatatattatagaaaatgccttggcagatgatcaagattgtcttcaaggataaaatttacaagtaaaggcccaggattcgatgtctattgctctttctactagtactttctttcctaataatgggaatgattatgtactcaagtatattaggaaaattaatctgaaactggtgtttcagatgaaggggaagtagaagattattccagagtttgttacagtatctaagtataaagtggtaaagatctcagtcagtccactcaatgtattaatgatggaaattgagagaaaaaggtgagttgctgctagagtcatagaagaaagaattgatagacttgtgcctgattacagaaagaaaggaaaaaagcaaagatgacctcatgtggtattaatgactaaagacattgttatttgtatttgtgggcctagcccattgcaaacctccaataaaccctacttaaagtgaataaatgaacacaggaccaagtgagaaataaagaaagcaaggttatgggaactggttttagttttaggcatcttatatttgaatagaatgggtaaagacagttgcctaaattttaaaaggttatcagtatattagtttcattttacatcctggactaactcagtagtattataaacatgagtcagtttagctaggtgcacctatgtttcagcaatacacagaaaaaaaataagacagagacatgtttaagagcaaggtcttgaagcgtgatagccagggttcaaatctcagctcaacttcctgttagtgtgaccttgagaaaagtatgtaattgttatattcctattatcttcttcagaggatagcaaagatgtgataaataatctgctaccactagcctttagcacatacactataaatcaggtttgcagatcaaagacatcactgagtaacttaattacccaagattctcaaccgagaaataaacccaatatggcttattatgagctacacattttaattggattaattacccaatcctcataacagcaatgttggagatttactattatacccattgtttttgtttgttttctagatgatgaaatcaagaattatagctaagtaggtggatcacctgaggtcaagagctcaagaccagcctggccaacatggtgaaactccatctctaataaaataaaatttaaaaaaatacaaaaagttagcagggtgtgatgatgcatgcctgtgatcctagctactcaggaggctgaggcaggagaattgcttgaacccaggtggtggaggttgcagtgagttgagattgcaccactgcactccagcctgggcaacagagtgagactatgtcactgttcaatagatcatgtgagttaaaaattttctctcatcataattactttcagcaaatctctagactagattcctttcttaaccaaatttatcttataaagatgtccaaacttcttttgaataatttaaaaataaaatttgaaaaataaatttacaaaagataaaagaaatacattcatctgtcctcactaacaaaggactagagaaagtgaaggcaattcagttgaacaaaaacaggttgttaaaattcacagcatagtctgtgttgagattttagaaataataaaaaaaagagtagatgcattgttccatggattaaatcagacaagagagctaagcttttcaattcacttttctgaacaattcacaaagaaaaattatataaagtttcttgtgtctttcatttcacattgaataatatggtaaacaatttttcctaacatttttgataagaaaacaaacaaattttatttttaataatgaagctaaaacgtgtatttctacgtattttatactattttaactttgtgattctagaggcaaataaagtcttatgatggcttgacttggactatatattatagcagaggcaatgtataatgaaaagggcacttttcactgactagactgagaatcaatagatatgaatgatacttcaactatactactaatacgctgtgagactttgggcaagtaaattcaatttctgaacactgttttcaaggaagggaatcattgaccccttttaagggtctggtgaaaatgcataaacatgtataattttacaaaatatttcaggaggtttgcagacttctaggaattaaagttcctattaataggtaattaaatgaagaaatacataatcctaatgtctgttttacattctgtttctaatacaatttgtaatcatttaattgtaaatgatttcttaaactaagaacaaacaattgaacggtgtaggtgaaagtctcgctcttctattttctcccccatttgctgcctttgaccttttaaactaagattcttcttatgtaaatatcatgtaagatatcttgccacaaagaatatttcagtgtaattattccttaaatattcatgtctcaggtaattagctgatatatcatctgtgatttgcttatacgtaaggtcaaaaacctaaggtaatgcatcataaactaatcatttatattttctttgccaaggttcactgaatcttttaacctacattgactacgataaagttaattttccatattaaagtaatattcaaattagacttttaaaaattatgctatgggaaaaaacgaacacacagaagttaaaattaagggtgccataagcaaataacttggcagcttttctcagcaaaaaaaaaatatatatatatatatttatgaggcacatttctctaaattatttaagttggtgtattaaaccaatttatatctaatccagtgaaatttatgtcacatatgttcattaggagaaaataattgataaattaagaaacacttcactgtgaaaaatctattaatattcctaactcattcgatttttttttcacctttgagtttttatgaacttatttctatgccataacaatataatatagataagtataaaatacatacgtttggcttaagttatatccccaccagtctccctatcaaataaagggtgccagacagtctgctatctgcatttatctctaaactgagaataactaaaggattcagaattttatgtaaacatcaagacaatgggcttaaaataattgaatcttactctacaataatcgaacttaaagtctcagagaaatatgttagttaggacaaacgtattttgctttcccattagcctctttaccttctatttttcatcaatttgttttgcccaatcgggttttatttacacctttttaataaactacaacaactctaacaactgtttcttttaaatttattttttaattcacaggaaaaatgatatgtatttacatgcacaacatgatgttttgaagtctatgtacattgtgaaatgactaacactagctaattaacatatgcattacctcaaataattactgtttttgtggtaagaacactttacatccactcttagtatttttatgactacctcatattattaactatactcaccatgttgtacagtagatctcctgaacttattccttctaactgaaattttgtttcttttggtcaacatctccccagcccaacatctaaacaccccaggccctgataaccgccattctatggaggcttctcaagaaattagaaataaaactaccatatcatccagcaagcccattactgggtatatatccaaaggaaatgaaaccagaatgtcaaaggggtatcgccattccactacatattgcagtattaatcacagtagccaatgtatggaatcaacctaaagaatgtttttaatgacaaacaaccaggaacacattttgttaatctaatgtgctccaacttactacacaggttgaccttgcataaaagtaactttacaagaatattagcactaaataattcctaacatcttggagacaattttcaaaataatgcgtttgtttactcattcaagatgtatttactgagctaccactgttatatgccaagtgatgttctaggtcctagacatgtagcaaaaaccaaactgaaaaaaaaattaactcttgtagattttcaaagcaactatagcagcaagaggaagagacgaacaccaaaaaaaaaaaaaaaaaaaaaaatatatatatatatatatatatatatatatatatatatatatatatatatgcagtcatgtcttagtgacaaggatatgttgtgagaaatgcatcattaggcattttgtcattgggtgaacatcatagagtgtacttacacaaacctagatgatataagctaactatatacataggctagatggtatagcctattgctcctaagctcaaaaccagtacaacatgttacttcaatgaacactgtagacaattgtaacacaatggtaagtatttgtgtattgaaacatagtacagtaaaaatatggtattataagcttatgagaccatcatcttaaatgcaattcatcattaactgaaattttattatttggtgcataactatattggataatgataagtgctatgaagaaaaatatagcattacttataaattaagaaaacagatcaatctactaaacatcaggtcttccgaaaattattattattattttatttttatttatttatctatttattttgtgatggagtcttgctctgtcgcccaggctggagtgcagtggtacgatctcagctcactgcaagctctgcctcccgggttcacgccgttctcctgcctcagcctcccaagtagctgggactacagccacccgccaccatgcccggctaattttttgcatttttagtagagacggggtttcaccatgttagccaggatggtctcgatctcctgacctcgtgatccgcccgcctcagcctcccaaagtgctcgcattacaggcgtgagccaccgcccccggccctgaaaattattttttaaaccaatataatagttattcctgagaataggtacaagaatttttttaatcatgataaatttcatatcctacccctcttcattcctgcctccacctcaatccattcttcaaagagcaactaaagaaattagatcgtccagaggcttctcgtgatcctccttgcatagacccttcagcacaaactcacccatgcccgcctccagcttcatcatcctccgtgtttctctaaactcactatattcaagccatagtaactttttatttttttaagtctgtcaaacgtttaatgctccttcctgccttgggtcttcacacatatattgttcccacgttgcgcccacccccacctccctgatcccaccccacccccaaacccgactaactcctggtcactttttaataccgaagtgtgatttctgcatggaagccagttctccatgaggttcctctgttttcactcttcaagggtctttacctatcctttgggaacttactactatttaaattatgtaaacacttatgttatactctgtatatttatcaaatacccctcctcagattgcaagttctgcaggacgagttcagagaaggggtggaggcagttgtttctctccttggccagtgtactttcactgctttgcaccctgcctggcatagactaggcatttagaaaattgttcctgagagaattaaagaataaatttcataaaaaatgtcttcagtttacaacatgtagttttatgcaacacttggcaaagtgggttctggtgggagctggtaatatcctttaaatcatgggactgagcaaatgattctagttgaatctgtgttatttaatctgtgtttttaaatctgtgaggctcttgccccagactctacttgaagtctgctgtgcttgcctgtaagctcataatcccaatgacagatggtttttaatctttgctatttggcttctagaatgggtatgtattactaactcatgtattttctctaacatgtagaatctgattctggtggccattccctctgaggaataagatactttctgggacttgtagccatgggagaaaggtttaaaacactttcagagagttgaggggaagccactttatgcttggaatcattgttgaaaaaaattcaattatgaaaaatcacaaatgggtaaaaccattaaataatcccagatagcagtagctcagggcattattgtttaatcatctcatgctcaatattctaaaggacacacacatacacagcaaacaaacagtgttggtgatgttttctgtgttttttagagtgagaaattagaattatttttgaggactggaagaatctttcctcactaactagcatatcccaaatttacaccatgacacttaccaatttataaaaatattttattttatttccatatatgtcgccctaacttctttagaggcatgaacctatcttttctcttttttatccccaaggactggccaaaaagaagaaaaaaaagtttaaaataggcaattaatattcattaaataaatcacagatagtaaagaagtattaaaagcagcctgagctggagtcaactatttcttgtctgtatcagccaggcaaaatgttgctcagaagccattcagggaataaaactctcttgtgaagaatctgttcctttaaactaaggacttacgttttcccaaaccctgtaaattcccatgtttttctatatggatttatgccagaatcattccaatccactggttggcgaagagaatggtttaataactgcaggggaaatgtaaaattctattcagaatataatgaaagctgtatggtattatgtattcatttaccttgtagtaggaaaactcaaatcttcaaataacagagtgttgccatgtcagcttcctctggagagttgaaaactaaactgtaaagacagtagaacgatgtgatttgtattggagtcactggaatcgacaaaacctaaattttttttataatttatttatttcaattaacaaatgacaaattttataaactagtggtatacaatatgattttaatgtatgctctactatgcaaagcctcaattcttaattggtctacaggattcagctgataacgtgaattctgtctacctgcgtttttatatttgtgaaagaattatgctactttataactcagttttttagagtttctatattctaaaattattactttcaaccatcaaatataagatagtagaaatatggggcaaaattttttgcagttttatatcaaaaaagtagatgaatgcaatagggagtgcattaaagagaacagaaaaaaattttaaaagaaagaatggggaaaaaagaagagaaaaaaatgtaaaagaaaggcgaaggaagggaacccgaaagggcaaagaaagtgaggaaggaagggaatattgaagtatttgatagagcttccctaccacccagatgctttagtatgtgcagtatttcaaagttcttcctaggtaaatagcaatgtctttcctttttattagcactgctgcagctgctgttgctcacaaagagattcacaaatcaaaatagactcagttagcttttcaataattctgaaaaggtaggagaacattgccagaaaaggatagcactccagtatcctaacatagagtcttgttagcaaaacaaagtgtgaattgcttagataattccctgctgttggtaattccactgggtgtcttctgtggcagcacaggctacttctcctctatagaccaatgccattgaacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaaggtatttggaaaaaacaaatttttgacacattttgttgatgatcaacctcctttatccatccatatctttttatatgtggcggcggggccggcggagggaagggtagtatttgtgctgaagattgaagaactgtatctctttaaaaattcttgtgatattaaggggaaattagtgtttgtcacatattctgaaattattactattattaatgtttttgaaatgctgttttcgttggtggggcactggctccttgtataacatgtttgctttctcccactgtcattttgtactctatcaaatccaaagttgtcatggttcattatctgtagatgatcttgagcagtcttgcattctaaaagaatatgccatggcatctgcctctgtgcttttgtggcctgctgcacagatgatattttagcacgagtattgggtgaggggttagaggggagagcagaatttgtctcagactgatgtttccttgtaccatgctgtgtctcattctttcatatatggctaattcaacagtgaagtacatatatcacactgtgactattacatatgttagagtacataatttgggttgtaaagtatctgtttgtcttaactaatgaattccatcaaattcaattaccattcttcattaaccaatcaaattactcctttggtctaagtcatttctaacacacttttattaggcatacacacaattctatgaagtaaacgtgaggtgattagattatctcatgatctttatttggagtcccatgctacagaagtttggatttctaaagaatagcctttcacattacttccactgtatacaggagaaatagtgttacagtgtgaagctctgtctttaagactctgttttactacttctatcttagactttcttttccctgaggaagtttgctacagtggatcgccaatacaaaaatacatagaaatacaccaactatatattcctataaaattaacctatttattaagtaaatgtacctatacgcttatgcgatactggatcataatatttttcaccttttaggaataaattatttcagtactagaactttctcctatctcttgcagtaagataccacagtgtaggatcacagttgttattgttgaaacacttttttcaaattatcattatttctttacatggatttctttttaaacaaagtggttctggaaatgcatatacccagtattgatagtacttcagttttctaggaaataattgccacagtactaatttacattggatattttaatcattttacaatgaagggcaggtgcctaatgtccttgcagtatgattcttaccatacagatcttaaaatatttccattttgttctcttctacattaatgtcttttaggaacattttcatcttctttcctacaactattttgagaaacatctcaaaatgtggtctaaagccaacctacaaaaatacatgttctgagttccatgccagacttaagtcagaatctttgggagtaggccctaggaccagcatttaaaatatacatattaggtgattataatgtaatccaaagtgaaataaccactgctctacaaaatgagagcaaggaaacaactgacagaaaagcattgtaaaactagatgtataactgatatgaaaaataaaaacaccacaatcaagttaaatttgaattttaatttttttctacatgttttcattacttggctgcaaaaagcattctaggttgtttatttcacctttaatatgagttttaaatatcttaaattaaaattttaatatttagtgttaattaaggatatggatgtctgttatttaaaagctttttccaagttgccaaacaatgaatgatagttataatggtaaaaggtattaaatttataatttgtatcattcattagtattttcatatttgaatctttagttttacaaagctttgtaaataacaagtctatctttaatattttatatatctaataaacaacactttttaaagaatttcaaccgatctttttgttaaggtttccatttaaatgaattacgtgagtgtcttactttcagaagatactttattaatacaactaaattgaattctttgggctgagatttttccattttttcataaatgaatatttccatattatctaatcttaataagaatattttctcagtgcggcaagtaagacatgtttgccaatttaatataccaaactctaaagtaagtatacactcaaatgagagttaggggacaaagaactgtcttctgaaccatgaaaagacggaatgtcgtgattacctcaggcactgaaagacagcaaaaatctacattagttctagtagaaagactacagagaatgtttgacccataaaattaatttttgcttcctacatagccgactccatggagacaaggtctaaaaagggaaaatggtcgaaatcttaggtttgtaggttaacttactttgtaaactagatatgtcctgaaaagactggaataatttaaattgtttctgcgttcataagaatcattttatgtatcaaaaattcttttgttttcagctagttttgaagattgtatttagattatggacagactactttaattgggttgtgtttcaaaagtttcattatgaagttaaatatttgggactcaaaacttattttcaaatataaagaatgctataaatgctgtttcatgcccagattcaattttatgaaatccacaacattatagtaaaattacataagttataaaactagaaattgaagggaagaatcattgaaaacaatactatatgatcgtcaaaattaagccaattagacaaaaaatattacattatatatttactttgaatataaatgctaaaggaaagtaaatttgcttataaataaatgagaaattaaaagagggggtagaatatttttctaaaacacagagagagtggggttatagcatgaacagtattctcctgagccaggggggagagggagatggaggggagagatgctgggtagatttagagaatgaaaggcaaaaggatctcaagtatgagtggccaacagcattgaactagctattaaaaagaaaatttgctcataaatggtaggcttataatccagaagaacaggtgtattcaatggtttgtttgtttttgtgttttttgttgttgttttgtttgtttctttgtttttttttttttttttttgagacggagttttgctcatgttgcgcaggctggagtgcaatggcatgatcctggctcactgcaacctccaactcccaggttcaaatgattctcctgcctcagcctcctgagtagctgggattacaggcgtgagccaccacacccagctaattttgtacttttagtagagatggggtttctccatgttggccaggctggtcaaaaactcctgacctcaggtgatccaccaccttggcctcccaaagttctgagattacaggtgagagccaccatgagcagccttaattcttttaaaatgaataggtaactatgttgttacatatccatttagaaagcagctgtgtagaggaaatggtaaggagagatagtgggcgagcatgcatgctaactcagtgagtgccaactaatggagtgaagggagaactaatgaatctttggccttctactaatggctttatctctgagtggattaactccttactctttattgagttccactttctaaggaattctaccctttgtttctttctgaaaattcagcatcaagtgaaccaaatttaccaatttgctgcctttgtgtgcacagttgttcatttaatttatgaaatagttattgaatacctactatgtagtcagcactatgcaaattttgttacttttagcccagacattaggacacaaagaatattttgttgtatttgaattttagtattttgtattttaccatttctcatttattttctgtttcttaaatttggatagttgaagggaacaggtggcatccatgcctagggatggagggctaggagtgtggataacccagagaagaaggtgcaaaaaaaggaggtatctgtcttgttcctctattctgctgattttaaggaggtcttagcagccctaagcagagcccccatcacttccatttaaccttaaaaacaatttttagagatggaaaaaatagaactatttgctcatgataaaaattctacattcaaagtgaagaaaaactactacattcaaattgaagacctgcagtatatagctctttttgagctgatatatctcattactaggctaatctatggtataagaagcaagaagttagaaaggcatcctggaaaaatggcccataattcttcatcaactgtaattttcagtgaaataaaagtctaaatctccattactagttagtttgaagtacagaaggtcatcatgtaagtttctaaaatcccttttaactctagaaattctactggagagacaggtgaataagattgggaaaaaataattgttcatctttcattgaagaaagttatttagaggaatttttcaatatcaagcacccctcctttccgttccattttcaagaaacaagagcaaaggatgagttttggcaacattccaagaagtgtcttagggcagaaatggtcaatgcctgtgttgagttacctgaatctctatttggcagcttctgaaagctactataaaaacctgggcttaagaagaggatgatggtatggtctcgcagccttgtgtgaattttctaaacggttttgttaccccaaagcatagaagtgatacctcaaaatttataactgatgctatatcatagttatactcacatataaacttgcttgataatatttcctacagttgagtttccaatcaatctatttttatctcctacacttccctgatccaacaaatcttatccatcatgcagcctgagttcatacctttgtttcttcaatgtttttattaaacatctacaatgtcagttattcttcaaaccttcttgtacaggcccctgtcctcatggagactaccttctagtagagaggtagactattaacaaggaacaaatatataaataataagacccaccaaaatcttgtttattcactaactttaatcgtatttttgtctaaattttcttcttccaagtttttttttttcagtcagtaatcctactcttcattttagcctacttgattcttactgttttcaacattgccctcaaattaatataatccactattttaactcttttaagattttccatcatcttaagtggaaggaacaaataaattcataaatttacatattagataagatgaattgccggagaaatttgatccgtatagccagatgtaagtaataccagagtggctccaatgtggccattatggaatcaaatacctcacagcccaggcctcaaaggcatcttttcttatcatgagatttttcttaattacattttccagtgattaagtgtcccatttctacacattggaatgcattttctatattaagttgtcaatgatcataaactatctgtcaagaacttattccaattatcctaacaacctcctctaggatccctagcttaaccattctacatttactatatgtacttggcacaaagatggtataaaggtttagccctaaattgtttataaatttttcacactattccaggatattagaacaggatagtcatttacttgtgtacacatataaatgtctgaatacacatcttgaaaatgcaataggttacatctgatgatggttcaagaagaactaaaaggataatcttaagggaacataaaaatttcgtgtttgaagttactgctaagaagaatagcaatgtaagagttcagataactgcaaaagtaaagaatcaaggcagtgtaaagtttctataacttagggaacttaactagctgttaaaagggcacctctctgacagcattaacatttcaaaaatttgatacataaagatgtgccagtacaaagtttggtccttagcaataatcaattaatgatactgtccttttcattcagtgaatccaagaataatagttttcagacctaaatatttacaaccacagtttcatcaaaatacagagaatatatattgtatcaagtgtgcctttatctagggcaaatcttaatagcgtctagattcagaccaaccaccaagacaaattgccaagagaattattaagaaatttgtataaatccctttattacatcttagattttaaaacttctcaaaacaattacagcccttacatacctgtgatggtttttaattccctggacaatttatcaagaaattaaaaattcagagcaccctagcaacacagtggtatatttaccattgcagtatgccagttttgtttattttttatggcacaaataccacaatgtattttatttattaatctattggctgaagtataatatgccaacagaaaagtgaataaaacatgcattttatatagcattatgagattttttctcttgctttttggtcattgatcttgtaaattgttattttttagttattatgatgaggatttaatatccagaatatattaagaaatcctacaactcaacaacaaaaacctaatgtgtctatttacaaataaaaattacaaattagtttagataattacaaattagaaaacaatgaagaatagaatttaattgaatggaaaataaatgtttatattcatggaagaaacacacataaagatgaattataatttgctatcaaatatacagaaaattagatggagtttttggttcacaatagctgacaagttgacaatatgcttatgttaaaaataaacattattctaaggtatttaaatagaaacataacaaaaataatcctgggtacggtcacttcgttagagacttgggctcaaatttaggtcccacaatagaaaaagaattaacaggaaggtggaaagagcaacaaaaccgcagttatttgtagtttgcgacataatcttgtaagaaaataagttcaagatgctaaagagagaaaaaagaaagatgcatcaagtgtggatttaaagtaaatatataccattacaagacacattgtataccgagaaccaaaaagaaacttactgaaattgtaggaaagaacaacgaatgacataatgcaatattctgagaagagaatgttgaaatttattcttgattttttttaaaagacagctatttatcttttgtgaaaaatcataatacagttctgtttaacaatgaagaactattccactgtattacctcccaattctcacatatttatacataagtattaaaactatacgtagtataataaacctaaatttctgaaatatgaacactatcacaattttctaggtgataagttattatacgattttgttatttaactgtaagcaagggagaatctaagaaagaagaatatattctttctaaaataactccccttcaagatggcagctgaatacatagaataatcagactaatcatttggggttagtggttgtttttatgttacatagaaggagaaatgaccactatctgatggcatccaagaaagtgcctctctggggacagaattgtcaccctgatcaccattgctcatgaacccccttcatgttaatgggcacattccaagtagaagacgtgataacaaattctttatgttcttttaggactgttaattctaaaaattttgggacttattatatagtgctggttaattctgagtataaatgtaaggaaattctgtttcataatttagtgtctagaataggactttataaattggtttatgatcagtgtgcttcaagtttattttgggtaccaaatgttccctttatttaatctatttaaatcaacaaaagaagcaatttcaaacggtattcatccaataaactgtagttaggaaaatgttcattaatctatttttatttaccaacaactttgtcattttctttcgaaaagcactttgaaggagggaaaaataaaaacagaaggaaagagaaattatataccactataaaaattatatgcagttttgcctgctttttatgtaacctagtattcaaaacttaactggttttatcagattccattatgttatgaacacacaggccagtatttccccaccagtttcttctaactaggaagtacattcaaacggaaaatctaagtttgtgtttttctactgaaagaaatgtcgctggtgaatagcgaagatgatttatgtgcataaagctgaccttataaaaataatctctgtgttcatcataattttattgctatgtaacatttgttccattttctttttgtatatctctgataaaccattagtttgtagatctctgatgccttagaacatatgacagtttaaaaatatctattgtgtttttccccaaattattttattagtcagtagttttttttgatgaaacagtgacatcaatttctttcatggttacaatttttgcagtgttttagctaacatattttactaactgaaaattatccttgccttttatttacacttcagaagttaaaaataaatatatttattaattaacaattatatctccaaaacaaagtaacgattatttggtttctaatgctagcagttcttgtttatatttaatgaaaatcgcatttctcctgacaggggaaaaatatttttccacattaagaaaggcttttcattcatgtcctgaaactacatatttttgttctggaatataaatcatctatttatttgatatgtatgttgaaatttagtttgtgaaacagaatatatatctatttgtatgtctctctataatagaattatggactgtgatgagttgttctccatatacatgaaggattagatacatatctttcttctttccaaaaatgccatcagcattgtcagtctcagaaaacaggtggaaaattgcctcagtgtttctgatatctcttattaaagatagttacgatgcagaactgaaaaatactaaagttttatgaagcatcaccatgaaataataaaactttcctttaataaagggctcatatccaataaagggcttatatctgaatgaatattgtcgttcactatggtcaccttaaatttcagatgcttccatcgttcaaaatattctgctgtttgtttgcaacttttagagccagtttatgcaccaggaagcagtctttgacaaacaccactgtgaaggcattatatcattatgatcagtacaaatgaggaggcaccctttctaagcatgaggaacatttcttttaatgagtctgtgccctctccaaaggaaatatgcattcatcaagtacactttaattcaaaatggtgtgtgttttctagacaaaaagatacatctctcataaaggagaagtactctgaggctgatgggctcatgaggtcacatgttggctaaaagacctcgcaggctatgcccagaacattagttagaccttttcaagatgtgggggaaaaaaagacacataaagtttcaggctgaatcaaaaagactatttttttactcagctcttgttatattttatagttacatccttatcccagacaggatataaggtcctttcaagaacccatgaggctacacatgaccttcccctgctacctctctttactggaatatgaaaccttacttgagcctacagtactctgcatacatagttaccatttgctatttactttacattagggatatataaaaaaaccctaaaaagccagcctataccaagctcagatgggcttactagtgaattttactcaacatttaaagaagagatattactagttccctacaatctcttccggaagatagaagcagagggaatacatcctaactcattctgtgaggacagaattacatgaatatcaaaactagacaaaggtaatacaagaaaagaatactatagaccagtatctctcatgaatatagaggcaaaactcctcaacaaaagccagcccataaaccatcctgtcaggtgaaaaggtaatggaactgtggagggatgttctgctttccattacaaaccatttattcattcaaccaatatttacttctgtgaggttgattctacgtggtcaagaaatcaaacctgtcatctctctcattcagtcagtcacttattaattcactcactgaacaaattttttttttcaaaatgtacaatgcgttaggcattatacctggtgctgggggatacaatagtgagcaaaataggccaaatccttgccatcatggtttttacattatattggagaaacagacaataaatgagatattaaacaaataaacaataaacaacataaatatatctatgttatatactatgttatctttatatcaataaatcaagatacatagatatcttgtttattatctatttctccaatataatgtaagatatatagtaagatttatattatatataataaatattatatatatatataaaatgtaaagtatgctaaagatatatgccaagaagaaaacaagaacttaacatgtacatacggtgaaatttacatagattgttcagagatggcctcattgagaaaatgactttgtgtaaaatcccaaaggcaatgaagaaaagcatcttgataatgtttcctggaagagcattgcagacataaagaacaagacacaacaacagaggctggtgtagagtgagtgaggaaatatacttggagatgtgaagtcagagatttagatggaaatcaaatcatgcagagccttgtgagaaatgacatggagttgtgatttttggccaaatgtaatgaacagccattggagggttttcaataggaaaatgctgtaaaatgattgactattatacaaaatttattccagtttctgtatagaagacaatatttagatatcaagagtgcaggcagatagaacaatagaagttattgcagtattccaggtgaggcagctaccagagttggtaattttgattaggcttatggctgtacactactgagaaattaatagacttgagatatgtttttaaagtagaacctatatgacttgttgatgaattgaatatggaaaataagagagaaggaatcatcaaaataattaccctagagatttccttgaacactttggtgaagccatttattctgatggggaagactccaacagaaacgggtaggggaggagaaaacaaattttgtttttatatgttaggtttgaggtcatctttggacttctaagagaagccagttaggcagttaaaatataggaggctggacctcagggaaaaagactggaatgaagatatcaaattaggatttgtatgaagtaagatactctcaatagcaaattaaagaataccttactaaaatttacttaaatattattaatatttgttatgtcactttattatatctgtttattaaatccaactctagagagtaccaaggtttattcagtagattattgatatgaaaaccctgggtcagcctctctgggagtctcagggcctagcccccccgttcccagactttgtgcagcatctcaagcatcatatcctcccatggcaacagagaaggcagagtcactgtaaggagaacatgcaggagaaagggattctttttaaagttagctctcttatctgattggggagaagagagaaaatatcttccagaaaactaccaatggatttccctaatgtcttcctccagagctacagcaaatgcccatccctataccatcctttgcaaaagggaagtgtattgtctaaaattgagaggacaagtatgagttattacttgtgactcaggttccatcatcaaagaaaaaactaggacatgttgggaaggtaaccttccatgtctgctacaggagacattctcttacagattttatttaaaatcaggaccagatgatgtccccaaaaatacacccactgtgcactcaagatatcttcatcctctctgtataaaactctatgtggctactggaagaaacagattatatcagcctgataaggggatagacagacctgttgaatcataaatagaacaagcagaaataatagaagagcttagaacattcacaggaaagtagaagaaactggattttggaaaataagtttctgggtttttgtaccacaattgagggattgtgggtggtatttgaacatgagctagtgcacctgaatgtcttagatgcctgtgaatgctgccattcaccagcagcctctgtgagagggcttaatgggtattaattgttcatttgtttctgagactctccgatataccaaccaggtgctgtgcctggagcaaataaaaagcaggcctctatcctcaaaaagttcataatttctgatggtgatctaggtaaattagtaatatattaaatatttttgccataactctcctattattgtaactttttctgactttaaaaactataacccaagcaatctattgacatttaaaccatgactatctggtttacactgtctttccagacatttactttgttctatttgttctattatagaaaagacaatgcgagttgatatctacatgtgtttttaagtacaaattcttatctgtgtctgccatatcacacggtattgtgagaagtccaaaatttaggttctttcttaaatttaattatctggtactttcctacaacactgtgtctcctattgacatttcaaatttcattttgttcacatatcttatgtttgtgtctccttgatatggataacaatagctggtgtaagagcttatctccttttgattctgaaaatgtaataaagaaggaaaatgcagagtaacagccacatgtgccggttattcaagcaaccatccaacttctgtatgaagttaatttggggaaaatatggtatgcacgctgcagctcaagctcacttgtgtcaaagagaaatacgaaaggcaagggatggtgctactttgacaagtacatgaaggaataaagtattgaaataaaacaagtgaatgtggccttatgagaatctttgttttacttataaggcacagcagtttcaagaatatgaccttgcttaatatattactgtttttacttcaaaacaacagcatttgtattcttatctaacaatttatgaatacaaatgacatgaaaatcatgagatacttttactctttatattaatttttattccatttactccacttggatatatatcctaagtaatcatcaaaattaaatgaatatttgagggaatatataacattaaaagaacccctgagaagttatgtagttcttgcctgactctaggcaaatttataatatgtaaagatcttctaaagaagaaattcatataacctattatagaaactcttccttatttctaactcaaatctttatattttatattaagcttgttgaagttttttcttagaaaatttgtaataaaacatcatatcatgtctctttggcctatagcgaatgaaaaaacctcacagttaattaatacagagattttaaaattgtagacctctagaaaactcattttgttttctttggattttatacataaaagtaaacattgatttgtaattaagagaagagaagaattcatgatttggaatcattttctgtaaaagaagaatagaattaaagatgtggcactatttaaaattagaaattagactttttatccatgaaaactctagagaaataattttgattttcaaatatgattagaaaaactcaaacattcagccttgccctttctttgaactctttcttaggctaacaagttcttctaatcttatagttttaggtgctgtttataaaattgatagttgtacatttatagattttacagaaatgtactctttttgtggataagtatctttatgccaagtttatttggctttgtgtgaattactgtttgaaaaaagactgatcattttgtaatgagtatcattacatgaagagctattatttcctggaaactttattctgcagcctcagaatgtagatcaggggccctagcaagttaaggtccaggctcctcatcaaggtcattttccttttcataccactgccctttccccaactcaaagtcagcctaatggtcagaaaggttcacttacagggaaagaaaaggaacagtgccttctttacctatgccctgcatagcaggtaacaattacctaaaattcattgtggaggattggaatatccaagagttttagaaacagttatgctcagacacctctgtgtgaccctaggcaaagtgactaagctctccaacgtattgtcctttatacacaataattaaaaagagtcctcaaaacattatctctaagataagatatgaaggtagttatggtttttcccaaactattttgacttgttctttgtcagtagcatgaggctatattaagatacaactttaaatagtgcttcataaacagtggatggccatggaatcgaattagtggcttgtgattggcatttgaataaaatagaatagaaaaaaataaaggatgtaagttacatcaaatgcagcaaggattagtattgctttgtgaaactttgtatatttgtactgtgtatatgaaattgtgctgtaaaatgtatttcttaccgtgtgtaaaagttttccaaaaatgtttaaaagatgtcagcctacagaattggaccatctagtacaacatgaaaaccccctaaaaaataccactcaaagatagagagcacagactggcattcagcaccactagaaagaagcagtgcagtgatgatcttcagggtctgtgattgctttgggcagtcttcttgctgtcatgttgcagtaagtaaggtatctgagctgcagtcatcatgtgggtgtaataagtaaaaactcacacatgcccattcagttgggcacttgtgggaaaaaagcaaatagaatagtgtatccttatttagtatatgtaagagctgtgtttaggtatctttcctcagaattcatggtactatgatgactgcagagaaaattctctatatgtttcctctacaaacttttacacttgctctttggcatttttttgtcagcaacaagatggcaactgtatgctaataaaatccctgtgcatctacctgcaactcatcccttctgatggctttatatctaattacttaaagcctgtattatgtttatctgttttataaaacagaatatgaaactgtcaggcctaaattatcctgaaccccaatctgtgaaaggacacataatgatggggaaaatatattccttatcagaacaaccaggtgttctcaaatattgactgagctgcataatcatttgggcaaagtatatcttgcaagaaaaggcagtaatgttcaaattcttgcatttttattttccatgagtttggtgttttcctttcagaataatcattgttcatgttcttgataaaatcaagttgatgcatcaaggcagctatccttgaagatataaagcctatgacattaggtcctgtgatgttgttttacatgttgcttactggcatggatgcccattcagaaattctgctattctactgggactccatttctgtttttctagaagcaactgcacatccatagaatctttcttctggaaagaaaacctttcaaataaaacacactctgcatttatttattttaagccacattaaaattttaaaaggcaaacaaaatttttaaaagtatttacatgaaccatatgaaattgctgatactttggttttttggcctataaaaatgatgatttcatatagcccaatctaatattacttttcaaaaagtaatgtaatattctaaacccaatatgcaattgcttttaagtatccaaattctttgagttcagctggtattagaagcagtctgatgctcttcctcattctcatacttaacaaatattgtcctaagtttctgctatgttcagagtgccaggcatgtggtaaagaaagaataaagctgacacaacttaataattatgaaacattttttctgatgatagtatgttgttggcagaacaaaaaagttgtgtttccattgcctacaaagtgacccaaaactttacaactccttcacatgtgtggtttttcttaagcatttcctcaacttcgtactgctttttatcgaattccctgtatttatttcctcctgagtagattcaccctgaatcaacctgtcagtgtagtttagtctttcccagatattgttccccaatttttaatgtaagaattagcctagtctttctgtgtcttgaaacattaacaaagcacttaagtgagcctttatcatttcaattgcaccaaccacgataaataaaacattagttgttctcatatattattgttccttcagttttgaggagagaatcacaagtggatgtctatgtagtttgtccctttgtaagacattcactgaatagtctgcctattgttctgcctagctctttcacatttacttgagaagtgtcatcataatttttctttttctttgttttctttttcttctccttttttttttttttcttttcgcttggtgagcatcctttgttctgaggattttttttttttttttttttgagatggagtctcactctgtcgtcaggctggagtgcagtggcgtgacctcagctcactgcaacctccaccctctgagttcaagcgattctcctgcctcagcctcctgaggagctgggattacagacacctgccactgtgcccagctaattttttgtatttttagtagatacggggtttcaccttcttggccaggctggtcttgaactcctgacctcgtgatccacccgcctcggcctcccaaagtgctgggattacaggcgtgagccactgtgcccggccaatatttttgaaacgaatgtttcccaccatcaatatacccaatgctgcagagtttctgttttttgttttttttcagagctctcactttgtttctccaaaattggtcatcccacctgtgattgctgcactgacgctccccagtctatatgctgagtaacagtagggaaattcatggaagccagcgattctccaccttcacttcaccctggatcacctggggagttttaaaaatactgacacctgggtttcactcccaagattctgattaaataggcctgaaccaaaggctgggcattaggatttttttaaatctcccagggggagctaaatgcacagtgaagcctgagaaccactaattgaagttttaacaagaatccccaggcatagccttgtgtctttgacctcattgaaaccaggcccaaactttggaataggctaaaagcaagtgtctatatccacttttagaaacccattgtggtgattcattggctaccatttattaagttttttctatctgcccaaaattcatcagagtagagctcagatctcaataggggtgagaaacaataaccataatggtcttgaagtcactttttggtatccactgccagattatgctactcacctaacaatttgggcagctttctccagagagtaattaacatctttgtaaagatgtaatcacctgaagcagctatataagcaacagcagtctcaagagctttcatttctagcagcaaagaaattgtattacagtagcatttcgccagcatatcttagaacatcagtgtaatcagtattagaatgatgcattgtaagactgaataacagaaagagattaatttctattaaatatctacatctgttggttccccaaggtagattatgctgggaaaatctaatggaggattttttttaacccagcctcctttcactccgtgcccaattcctgcagttgttgctgaggtttaccagatggattaaaagaaaaaataagaagtggctccaaacatgtaagcaatcctcaattcattgctgtttgaatgaactgtggtgttatttgcattcagtcttaatttacacggaaaatgacatccttttgcttagaaacaaagatagttttctttttctacgtaacattactcactgtaggatcaaaaacttgcctgaagtttctgaaccaaacttattgttgtccataatgtcactaataacccaggtctatctccatccaggattgttacaataaggtctggaggtgtaattataggtataatttgacctcttttttactaccttcatacaatttacttggttgaaagatctctgtcagcttttgctgaactttatgcttcgctacctcagtgcattaagtaaaccataaaaagaggtattaatagtaattttcaatgaatataatatccagctgctctcaagagaatcccttgatcacatctattgccatgattttgccttagaaaaatgttactaagcaccgacttctcccttaaggaagggttggtttcaggattttataggggaatcttgcaaagacacttttgcccattgaccagtatattgagacaaagttagagaaaagaatgagatgggaactctgctaggtgtctgttctgttttgtcagaactttgttaaagccgtggggaagagctttaaacttcccttgattgttattttagacgctaatagtcaagggtattctttaaggttcttaaagttcagaaaggccacattgacactgttacctatcaataattaggtttctaaacatcacatcaaacagcatatgcagaatgagcccaagaacagtacgatttgaggatgccgtggagttccatgccacaccctacaaatccatatatctgcttttcctgctcaactctagtttaccaaaatacagaaaacgggtcaaataaatcacagatataaagaacacaagtaaactaacaaaagcagcctgggaaatgcagtgctttaaaggaaactcagaaacagagtttggattattcacagaataaatataggcctggtcactgtatgaagaatctttgaatggtaagtcatagaaaccatgtgagctaatctcagtgatttttatcaaaaaagacactgggctatctacagaacccaaggaagcattaggctttagcatctcaaagagagagggatcaaaagcaaatacagggaggtcagcagcaggagtatggtctccaggtttctggaagtctcttagaggcccaacagcatatgcctctatatctctcagttccaattccaaactggcaggaaagttatttgatttttctatttggataagaggctcatcctatatgaactagtgaattagcaataaccaggaaagctgttcttagaacaaaaacatggcccgtgggaatcattgctatagacagtgtcagcagttctcacttagaaggacctagatagataactccataagattctgttatggctattttcacagagtccttaaaataaagaaaggtcaccaaaatatagggaaacttatgtatcatgttattcccaatgccttgggcttttctattttggctaaattgccttatattcttgacagctagatattaaataattatgccttgagagtaggtggtaatactttgcttttaaaaatagggttaaactagtctgtaagcaaccttgagtttcttttctcttgagtttataagtgatacttgaggaggagcatgcactgagggtatcttctgccctcccagaagccatctattacccaaattatgtatctttcccctttctttccttctttctctttccttttttttttttctttttttgagaaatgaggaagaaaacagtggagtttggatgagatgacgggtaggaaaggccgtgaggaagaagagacacatggggaaggaaagacagtgtctagcagagaacactgctgttaaacgaggtatcccctcacccagcagcctcatggaaagagaaccactgcttcaaggaataattctggagaagtgagactgactccacagtcaccccatctttctcttagtgatcctggtgcctgaaatgactttacaaaagctctgaccctcagtccacatttaaaaaggaaagactggattcatttaaattcaaaacaagtgacaaattggctcctatcagatctttgccccagatcaggttttggtagatctgagaacaaatgaaacaaaagaattacaataatctgaaaaggaaagaaagaaagagcaggatctgagaacccccaaaatgactcttgctttcttcatagtttgcctagtgctgtccttgattagaagtaattttatttcatttgcctatgaaaaagaaaaatattgaaattatgaccaagcatggagatattttacagataccaacctttaatttagctgaaggaacagttagggcaagagcacaacagtcaggatttgacatgaaacaaatttcattcatactcattggaagataaccctaaatatgtgaactcagtgcaacctatgtgtgaagtctctttgccaaggagcaatgctgcttgctttgttcagggatctggattatgagcactctgagaacagaagtcatgtctactgtgccatgacataacacccagcacctagcatagggcctgcacatggaggcgctggactgagtaagatttgctgaaaggatattaaatcataaagcagtatctaaacaacgatatgatgtttgagaaatcttgggaagaagtgtagaattagtagtgtttaagagtggggactctcaagttagattaaattgattcaaatcatgactgtattctctagctttgtgatctccgatttgtttactctctctaaatctggttactttctctgcaaacttggagtaataatatgagcttcctcatgggatcattcttaaaaatgaatcagcttttggacataaagcacttagcacatcttctttcacacaatgagtactcagaaatattaagtacaacaagttgctgtacagctatatgcaaagtccagtggaaatttggtcaatatcttgagtttccgtattgacagaaattttcattctatcacactgattactgatcaagggatgggtgaaataaagcgtggtgataaaaaggtctcgtttgtagatagtaatattgatgttctagaacatcaatactttggaccatgtcacagaacatggcttattttagtgctctgccctatcaactaaccaataaataaattataaaattcaaataggaagctctgactcagcaagtaatttttggaaattcatatctcgtgtttttcatctacattagcatcattcaaggagcagtagcatgctcttggctgtggtcctaagtgtttttgaaacttcatttgcaacattctctctagaaaggcagcaaacaatttagaggcaacatgatggtgttatttgtcaagaagattcttatgtatatctatagtttcactttctgagggttatttttaaagagtctggatctttgacgtatttttctattttttgtctaaaagtgggagactaatagtgctgaccaaaaccaggataaccatgatgtaaacggtttctgacagcccttctaatgacaagttcaattttgatttatatcacctttccttttcttttctaatccctccagcctggaagaaatagtctactttggatggaatgtatatctatcagaatacatgtgattaatagcaactggaattaaaataatcacactctcaatatttgaatttgtgtgttttagagaggataggtacatgtaatgcagggttcagtgtagcactttggcccactgaattgaggtaattcaggaatcagtcactgtcagtagttaatatattcaatattagtgagaatgggagaggggaccatcacaaggtgtagaagcttgctaatatccctacaaagaattcattaacttcaatatgatgtgatttgagagaaaacgttctaatcactacacattttaaataagcacttgcacttaataggtgccagggtgccgattatacaactggatattatttcatactaagaaatgctaactattggaaatgtatcagtgaagttcatggaaatatacaaaatgtttgaagtgtgaaataaatgcaaacattaccaatattagatcagattatattaaattggattggggcgtgttagaatataggacagacaacatctctaaagtaattcaaaattaattcaccattactaagctgtgattcagctgcaaacaaaatggaaagcagagtgcaatttttttttcagctaagcagtggaaggattaaaaattgtaaacttcttggaaacaaaatacctcccttgctgtttaacataagtggtatttaaaaatgactttttagaattgccttaactgcttcttttttttttttttttttttttgtgacagagtttcgctctagttgcccagcgtggagtgcaatggcacaatctcagctcaatgcaacctccgccgcctgggttcaagcgattctcctgcctcagcctcccaagtagctgagatttcagttacaggcatgtgccaccacacccagataattttgtacttttagtagagacggggtttcactgtgttggtcaggcttgtctcaaactcctgacctcaggtgatccacccacctcagccttccaaagtgctgggattacaggtgtgagccactgtgcatggccaccttaacttcttcttaatttgaatacataaagctctttatccttaaagggaaattataatttgtctgtatagttgaagctgccaagactgaggttggatttcctaatggtgccttagtcattcatacacattattctggggccaaagggttccaatcagtattttgtttggggaagaaacttttttttcatcacgatttaatgaattaaatattgtggctagaccaagtggtttaccttttaacatcaatatctgttgatcaaatacctgtatattcagtttctccaagaaatgccaatttaaattcccccaaatatcgctacttagaaaaactaaacaaaagcaatcttagccacactgtcaacagaaagtttcaaatacattggataattgaacagtgcctttccaagaattctgaaagtttacgtttctaatgtgattgcccatggaatcccttatttgtccataccttaattcatatactattctagtgtaaaaattacagcaaggataaggggctccaggagatttctagtttaaactttcagtagctaaaaattgccattatttaaccagtttacctattttacatgctacatttaatggactaaaatgatgatattttgcaaattctttacacattatgaagttcatttcttttaaaaaaaaaaaagcccctatccttctaatgaagccactgtcagtagtacagtagaacattctgaagtttcatcattcagagataatttagagaacattaactttagttcctattattaattggattcaaatatcaatacttagtagttttctcttcctttagggcaaattttaactcttgtataaagaacacagttcaaacaacgcatttaaggagaatctatgactagggtttagaagactaaagatgttacactgctctctctacgatccattctaatggttggtaagatcaggtgctattagtgactatataaaggctcaaggagtcagcacaccaccattatctgactaattgctttgtgaagtgcttttagaaaaattggaactgaaaggcactccatactaccaatttattttctgttcttagtgtcagtgatgcatgagagaacagcatattgtaaagtgtgtttttctggtgataatatttttgtcaaagtgatgcagattttaaaatactctcttgctgaaaggtacagacttatcatctgtttttcctgatgtgaagtttatcttctggatattgatttcttcaactttcttcactcagataaactagtgtttttttttggcacttgcctggaatttaaaagaagctaaaaagagtacatggattaatttcagtggttgaattaactgagaagttttgcttttggtgatttcagggttttataatcctattttaagagcattctctactttaatcatctgcatgataaaataactaaaatatttaaggaaaaaacactgctacagttgcatagaaatgtttataggtcccttttataaaaaagtataaaaatataatgtttgtttctcatttctttcaaacaattaaatcaattttattatagacttactacaatcctttgctgtttaaaaaaatttgcagaaataacatggaaaaagtaagcttaagcaagaacaaagtgcatcaatgcaacatgctccctccccagtcgaaagactatgaaataaaagcaatcatggcatatgcttgctgctcctttattataattttcatttatgaacaacttacttgctcttagctgaaatttcctcagtaggaggaataacagcgcacttgtgatttcaacatgaaatattccttgtttggctttttgctcattgccagtatttttttttttatgaaggaaaattttgcttaaaataatgtctcatcatttcacatttttaaaagtttttcctaatgaatgaagtttggcttttgacctcaatttcggtatccaggtagggagctacaccaaaaatgttctcatgctgtttttatttaaattccctgaactcttgccctgagcttatttcatttatattccaagtctcctctaattgtgaatctagtttagcatcactaatgactatgtattccttgacgctcaaattcactgagtcactccattgggatccttctattgttgttaaggagatgaggaggtaaaataaggcagaatgagaaacataggagccccctactttgtttggaaatgattttatgagatttaaagttttaaaaatatgtgttatattaagatcagtatgtcgtttccttttaaaatgagtacaaggatcttttatttatgcagcacctttcttccctaaggagtgttacaaactatacaaactatacagagtgcagaaatcacttgacccaccactggagtagaacaaagcagctgtttaacagatcacaacaatactgcaaaatcatttaagaaaagaattcaatgagaaagtacagcatcccaaagaatctatagggagagtcagaaaaagcagactacagtctctcaacttagaatttagctaggatattcaagccaaacacttcattccatttttttccccttaaaaattgtagtgcctttgatccagtgattggtatctagaaatttaagtgtttctatcacatgacatctcctagacctagtcccttggaaattacttgtctagaactgatcccccccaccacacacatacacacaaattccacttaatgacttgcaatcttcactcttctagtgtacctgccttcctaccttcatgtatcctttccaaacacagtcctagtcaacattagcaatattgcaacacatatgttatttaaaacccacagtggcggagttgtagcttatcaaaagcctcataaatatgaacaggcacacacttaagacatcactgcaagattagaaaaaatttagagatattcaatgaagttaagtaaataatgtagtagtaaaataaacctagtatgcatcattgattggttgttgcttctttgtttctgattacaaaagggtatactttaattcatattatactgcagatctttctgaactccagaatatgatctattcatacttgacacgttgatgatgtagtctgttttctcaatttgtaagtgttgaacagtcccatttcattttacataattctatagaaactacttctacaaagaaaaaatgtaggctttgaagtcagattacagttatttttttttccatctggcaggtttgaatcatcactgtctctaaaaggattaatttcttttgttccaatttaaagcaacaattgccagcatcttgaaaagtatcaattatgtgggaaaacagccatgagcagaaccataagaaaacagttaaccttcgtctttagagtaactgtgatgccactaataattccattttctatgttcccaaatatctaatgaccctcctttttaaaaatctaatactctatccaagaaaaggtaatcacatttagtttatatgtataagaaatgataatgaaaaaacattcatattcactgaaattttattcgatttacagttattagtgaagctaccagttgtctaaaattcttaaaggtaatgtacttgggcattttaaagcatgctatattattattaaaaacaaattataaatatgaaagtgatgacaattgcaatttctgttaaagtaattatagcatgtaactaattcatctaattctcactgacttctcttatgtacctgatcaattccaagatttggatatgaagcactgaggacagtcttgggaattactgagctctacacaaattttgccatttttattatactatcgttttctttagttgcataagtaattgtataaattactttagttagcataagtaatttgaatgaaatttcaataaaatgtcaataaaatagctattttgttttgttggcttagggctaaagataagaaagatttgatgttgcaattgcttttggatattttattagtacagtagcaattgttcataaatacagagtgaaaataataatgcaattttgatacagatgtgagaagactctagaccaatattttgtatctaatatgtctcagcttcctttaagtactttaccacatttcatttcacaacaacattatcaagaaaatattatttccatatttagataaaggaaatggagcagaaagtgattcagtaacttgcccaggtcacatggttataagtgatagatcaatatagctaactctaagatcctttctattaaacaataatattggtttggtgaataatatgctcatataatttcaaactttcaaagcagagtttacacaaaaacttgaagcttaactttagttgtatgaaaccccagggtttcatagaaggtaacttgaaaaccataatagatagcatcttataaaaagatgcttattgtgtgggcacagtaaaactttcctttagcactttcagtcctagcaaataaggcttctctgtgactatgctaattttattttccttagctatatgtgaagtcagcggagaaccttatttcaagggtgcatccaacatgtgttataggccagccatagactttagaaagagagtattaatgagctcataatatatctgaacctatttattagtaatgtttttcatgataatattttattcatatcatgaaattcaattatataaatatttattaatagaaagtataccccccatggatattaagaacatggaatttaaggtcccacaaacctggattgcaatctcagttttccttttgctggctctagatctaggacaagtaattttaattcactcatctacagtttccttataggaaaactcaggccaataataatgtctatctcagggctgttgtacattaatcatgtattaaattagatagtatatgtaaaacacttaatgggatatctgagtataggaagcccttcagaagtgattttattatttttgcatatataatagcattattagtgatagatactagacatggtccttaatattaaatagacacggcccctacatagacatgtaggttatggactgaaaagagaggcagttaaacaagcattggccatgcagtttactaattaccaagccagaaaagaattaaaattgtcagagttccaaaagctttcactgagttcaaaagtaatttcaagttgagaactggtcccattgaaggtatatatgtcatgagggccccagtctaaactcacattttcaaattgtccttcccaccatggaaacacttcaacactcatgggttagaatcagatacccaaaggagtattgccatttggataggcgctctgtttgcctacatttcttttccctaattgttttgcattgaaagtgtttggtgcaccttttaagatgccaaaagaccacaggcctcatctcctaacaaccagatgtgactgtgaataaaaagtttagagaggcttctcattcaaggttttcttctagggaggaccaaaatcttgaaattgactaaaaatacaatttctattttagcttagagaggacatgatggcattcattactttcaggatttcctgtctctggcaggccaacttgtgaccatgtatgaagatcacttatatcaggtttgggaattaaagtattagattcggtcatcaaaggaatgcttggttaagactagccaatggatcaagtgactcctgtatggctgaaattgccaaggccaaagagtggctagtatgtaagaagtggttcccataatatgttgtcattggaatgctctatgaggggaaaaagcagaagcagcagtgactgtaaatgaggtctagacaacaggtgcttttcttgagaaactggtcatgttactaagaatgatgatgatgatatatatttggcttttcttatcttttggcagtcagtagggataagtatttggtgccatcttctgagagcccctgaaatgacatctgtcccatctgttttatttatttgtgtgtgtgaattttttcttttgttttgggttttgttatctgaaatatactatgtaggatcgttagatatttgtgagaagatattctcggaaagcttcagagctttgcgtagtaagtctgattgcaatgggggaaaaggggaggatcctgcaacacagttcctgctttctccactatcagccatgctgatgcttttggcaaaatgcattatgatcacacttaattcctttgaaacacagtttgttaatgggtaattaagatgtcttgcattgattattgactttggttgatatatagctcctgatatttcttgctttgtaaattttttccagccactagcagagttctaaagaaagaagtaggtctgtatccttacaaatatacccctaagctctctgcccattaacatttcagtttataagtgttttcaatgtgaaactattcacagttaccttgttggccatttttcagcaaaagggccactcctgctgctgacaggcatgacagccagccaggagaaactgggcatagaggagaagcaaatctcccctcaaaattatgtgaggggaaattatatgactaaatatagcaactgtttaaattcatccataattcaagattttatcaagtccctcctcctctgtgatgcttcgttaagtactccaagccatgttgaccaccttgtcctctggactttcatggctcttagtttattcgggtatttaaaatgaaaagtaagacacattagtcattgagcacatggaaactattttcctagagggtgaaaacatgcatgttttatgtgattattgtatttttttgtagtcagcttcattaccattattaggagattattgcctggatcagtcctgaccaaagctgtttaaccatcatgtggtaataacagtactgcaggaacttgatgcccttaaggacctctatgtcaaatatctagaatttactttttcttaatttaatagatcatttgaactcagaagttagtgaacggttaatttgggaatggaggacaaaagctagatcatacttatacccttttttgttcccatacgtcaaccttcatttcctgggaggtgtcaagaaaaggctttgggagcagaaggtgaatagtagatttgagagctcaattctcattagagaggtaatgaaataatttcagtgcaaaagttcatcaaaggcagaagagtatgtgggaagtagattctgagataggaaatgcatgtggataaaaagtatgagtaatggcccccttcagtcattcggcattcaactacaaatgctttctaagtgtctggcactggttttaggaagcacttggagatatagtaataaatatgttagccaggatcactgccctcaaggaacttatactctagtgaaataaaaaaaagaaaataaccaatatgcctataaatagtgattactgtggtgaggggaaacatgaagataaaaagggaataatgagtagtgacttgggagtagaaggtccatttgtatagcatggtcagagaaaggctgtctgaaatggtcacctcttagttgaaacctaaagaataacaaccatcctggaatatctgaaggaagagggctccaagcagaggattcagcatgtgcaaaagtcctaaggcaagagtgactctggtttgttctaggagcagatagaagtgtatggctggaatttagtaaaaagaagaagagaggattggatgaaataggcatgaccacagcatgtagaatcgtataagccatgacaagtggtcggacttaattctaattacaataataagccactgagatgttttcagcagataaatactatgatcccagatatattcaagaaatttactctggctattgggtagcatattgactatagggagaaaagataagagttaagagagtgaagagaataatggaagtgatttagactataatagtggctgtgagaacgatatgaagtagttagatttggaccactttttggagacagaatagataggttatgataatgtagagagtgagggaaagaacagaatcacagatgatttccaggatcctggaatcagcagtatgttggatacgtaaggtgctccaaatgccttctcagccacctccctttgcttattcctgctttttgctagccttgttttcctgcctaatgtccttctggacaagtgcccccatgtcttttctccacaccgtgtctagcatagcttgaagtacacagcaggggatcaattaaaactccatgaactgattttctctactacctagaaaagaaaatatgattcaagaacaattttcttctataggaaaaacattttggtaaaatttatagaaactttagctttgctctaaccatgtttatggttccaagattacttggaacatgattgttccatttagtggccttccatcaaatttaaaatatgagttgttcactttcattacatgtttaacttgcacgaagatacctctttttgttattatgtgacaacttctgttgtggctgttatgaaatacaaaacaatattttaagagctctataaatggttagtactttctatgagaaaaaagtctctatgattactgtgtatcgtattttcctacactaatactttaaatcttagtgacttcaccatttagataaagagccctctggtttttgtttgtttgttttgttttgtttttgaattccaattatttatgtaaggccatacactctgtggattgtcaaaagcagtaggcaaacctactttcagtcttccctgacctcagaataatctttggttgtctgcatacttccttatggatgagcattggcaaatgcaaatcatagctattaatattaaattataggtattaagttcttacttgctccctggtaccatgataaacacgtgtatgttttatttcacttaatcaatggaaataccctatgaagtaagtaacataattatccccgttttactgataaagactgaggcttagaaaggttaaacattgtgccaatatcatctagctgttcaactagaactgaaatgaataaaagtctacaactcacattcttaactgtttagattttcagcattttgaaatttgatgtgctttcacttgcatctcttctttgtttccccatcaatatcaattccatttgtttcattatcatcctatgtttcctttcttttatttttgtttctgaatctagatttggtgcttttctccacaggtactttgagcttagcacagacggcatcctctatgtttcatggcactttcccctcattgctgtcactgttctctctcccagattcacaatactgagctctgataatatttccaacatttcttacttgcctttcagtgtctgtgaatggaatactgctatgtgagtctgaggtttgtactggaggttttatgggtttcttgttattgctagatgaatactgtaggttattactattactgtaggttaatgtttctttatcctgttctttcaatatcttcctagtatgatggagagagaggttgaaaaatcaatagaattagaattgaaaagagaccatgacaagatgaaaattggatagaaacaaattgaatgattttttttccaagttgaagttcaagattagagtaaagaggtgtctccagcttctctcagaaaataaaaggtggggaatgtctcacatgtatctatcacatgcccttttctcactttggttgcctactatggaatcctccacttcattctgaacaaattctcctctcaaaatgtttccttatgtgttcacagcagggaccaagctgtttgtagtagtatttcctactgcctcccttgatgaagaccgcacctctttatatgaaagtggggagaggaggtatctatattttatcccctcacttattaaataaagcccactacactattccctactatattttttaaattaaacctggattcctgatttaaaatttcaattcctcctataatgcctccaaaacacccagatcttctgatcttttgattctcactgattatgcctttgttccttcactacagactcataaagtcctgtcctgctatcagttttcaagtcatccctatggaagttcaaaattttttctagaggtcatcctaatcatttcacctttctatctgtattttcattattcattttatgaagacaattttcttctaaagctagatcctctaattgtacccttcattttatatttacctaattcctgagcaatcttgctcccataagaatgttgtcgttttccaaacctattttatttcccctcaaagggaaggaaggacagaggtgtcttggtctagaattgtacctgcagagatggtgagaaatagccagatttaggtcattatgccaatcattgttgagaagttcttacagaatttgcgttctatttcttaaaagaaataatggctaaaaggttgcattagaatataatatgaaactttactcgaaataatataatgtcattagtgaagaggaagttaaggaagagaccacagtcttcaagtaatggaaacatttatttaacatttactgcatattttttcatgcaataagtatttattaattgctaggtactctgctagatattaaagattctcttgagcatacaataaacaatatctccttaagtttacataccagcttagaagaaggataattaatcagtttattacaaggaagtgtgatgagtgaccagattgggaaattacagagaaatatgcaaatttatagtagggcattccatctagtcaagaaggaaataacatttcatcagagaccctaagaataaataagagttaatcctatcataatattaaggagagaaagttgaaaaaaactgtccctgacctctaagaacttacaacacaggaatctatatgctttctgaaagatcttgctagaaatagttcaaataaactagggaagaatttttaaaacaatagctgccaattttgctcttaacattttccagagatttgtaaaaaaaaaaaaaaaaaaaacacctgtgaccaatcaccattttaaacctcctgaattaaaatttctgggagtagatcctgggaatctgcattttataagctccctgggtgtttcatatatatatgaataattaggaaactttgcctaaaatataaacataggttttcttaagaaccatctgtgggtgttttaggcctggcatggtggctcacgcctgtaatcccagcactttgcggggctgaggcgggtgaatcaccttaggtcaggagttcaagaccagcctggccaacatggtgaaaccccaactatactaaaaatacaaaaattggatgggcatggtggtgtgcacctgtagtcccagctactcgggaggctgaggcaggagaattgcttgaatccaggaggcgggagcagtagtgagccgagatcagcccactgcactccagcctgggtgacagaatgagattctgtctcaaaaaaaaaaaaaaaaaagggagagaatcatctgtggtgtattatatctgcatactctcaggctgtacctgagaacctggaatttgtagcggtaagaggtccagactctatttttgggaatcagcacagtcagtgctggttgaggagtagacagaccacacatggtaactgagaactctgaagtttcaccaccatattatctattacagaagacaactgtggactagacactgatttaagttttagaggcagattggatccaatcacctggatgatatcttactttttgaccatacatagcacaaaccatctcttactcaagcataattgagcaggtactattctggtatacaaaaggcaaacacttctttgttcacaaaaatgtaagtatatgtagagatttcaataagtaaggagagaatcacttttccaattctattatttgttattgtggtgcttctgggatctatgtggtcacgtcaccattatatagctcttcctttcaaaaagagctgaagggaaaatttattataatatttcctggttccttgtgaagtgtgtaggcaaaaacagccagctgtctacaaacaagtgttcaatgcttctgaaaacaggagagtgcaccctgtcgctgctccctgtgcctctttccggactgccactgctttgtagtcagaatggcattttccttctgtggtttctcattatgctttatgatgaggtaatgtccttaatgtggcttgctgtgctttctgggacgtaccccagcccacctccagatgcatccaccctctttctttgcttcattaactgtgccatgctcctttctactacaaggcccctcctcccatgcagtcccttctacctggaggtctgtgccacctctgcttgcttccacaccagcctagctaacactcgtctttcacatgtgagctcaggagtcacttaccaaagaagcctaccttgattccccatcaaggtcagttattaaacactatttctatcttgtagagtgcacttctctgtttgtttttgtattctctttcatgagtttatttgcttaatatcaccttaactagactgaatgcagggattgtgtgttggtgtgtgtgtgtgtgtttaccatattgcctaagcatagtaggtatttcataagtatttgttgaagaagtgaatgagggtttaaaacactttgagagcatcaggtctatgatttcagttcactgagtgggttcatcaaataattgttcaatatttgctatgtactgagtccagtaatgggcaccaggaactccaagagggattaactgtttataaactgtaactacaacttgcacactgaattttagccaactctcttacaagtagatgctgttggagcacccatttgtataagcggtagccctttctcactaactcatctccccatcttctctgcaagcatctgaagcatatttcactatatttcctgcgttttttcctctataacacctaggaggtcttaataaaaatatccaatccagtccagttatagaaaacaaagcaaaaacatcagataggttcttcatttactatataaagccacttttattctagatagttatagaatgtaaaggctaagagaaaacattagaagggtaagcttatgaaggttttcttcatgtaagaccaagattctatcattatgtccattttgttagaaaataagccttcaggccggacgccgtggctcacgcctgtaatcccagcactttaggaggccaaggcgggcagataatgagatcaagagattgagaccctcctggccaacatggtgaaaccccgtctctattaaaaatacaaaaattagctgggcatggtggtgggcgcctgtagtcccagtactcgggatcatgaggcaggagaatcgcttgaacccaggaggcaagggttgcagtgagctgagattgtgccactgcactccagcctggcaacagagtgagactctctccaaaaaaaaaaaaaaaagaaaaaaaaaaaaaagaaagaaaaaggaaaagaaaataagccttgggtatttttgacaacttctaatgaaaaaccagttcaaatattttcatcagtaacaagtctcatagttagtacaatttattttttctgaaatttaacctgaaacctatgttcagatatgattcccagtcttttcaaatactttatactatttagaataatgtttagaattcttccctttaaccattccatatcatgcctattttagtgcaaatatttcttctctttgaaaatgcattctcaaaagaagacatttatgcagccaaaatcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtatactagttcaaccatgtggaagtcagtgtggcgattcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatgttctcactcataggtgggaattgaacaatgagaacacatggacacaggaaggggaacatcacactctggggactgttgtagggtggggggagaggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaaaaataaaaaaagaaaatgcattctaaaactttgatattaaatgtaagttaaaagtttcaaagctaaacttgcactctaatataagcttatgctgcatagactggactccaatttaaatatgtttgtaatattgtccttttgttttaagtaataataagtaaccaacttttttatttgtttttcctatttttataggtgtgcacatcaatttataccatatattatctctttgacaatttgttttatctgattcatattgttgatgtctgtatcacttactactttgctaatgatttaaactagaagaatcagagcctaaatagccagaaaaataaaagtttatgcattaaacatattcatataaaaaagatatgcagccagaatatttcggtctaatggaccgaagtaaatataatcgctccctatttgcttaaacgaatccaaaatacctagttgtcaaaacagttctgaagttcaaatgaaagcaatttgtttaaaggcttatgtgaaagacacagtaatactcttatgccatcatgtttatcctttatatcaataaacttccatgtacatacctatttaatgtattctgctagtgtttatttttgccaagctaggtaggccaggattatctacacttcttataaatgaaaaatctgaggtaaggggaggttaaatgactttgccaaggttgcacagtgagtccacagcagatctaagatgaaaacaaagtgtaatgagccatggtgcctcccttcctggaaaataatttatcaagcacttatcccaaatcaagattaataaggtcagatgataacttttccttcactgaaacacattcagctaatacaactgagatctgtttaagttaccatttctaaattttgtgtgtaatgaatcgcaaagagaaagacagttaaaaacagaagttctttctgttctctaataatatcaaaggtttcacatcttttcactatcacagcatctgtgtgaggtaggacatgtatagtgaatttatcacacctatctccagataaaagctcaaaagaaaaataggtctatggctcttcaatgctctgatatcatacgtgtttctagaattaaggctgtgtctagtgtgtttccataagcattatgctttcctttggagtcacatggttcctgtttaaacagctgtcctcagtgcaactgctttcatactggttgtaattatacttcaaatgaaaaacattgttgcattgttatttataaattggggagggagagcaacttaaactacatagaggttagtttttcagatctggaatcagttaaattatttactaagggcgccagtgtcagaaagattatcctctggtatatttatacatttaaaggggaaaaactcaattacaaaatccctgagcattaaatgggtagcaatgcttactgcaacttaatttgaaatggatttttaaaactggtggaagttgttactaatgatgtcatggaggaggcatggtgattaagttaatgttcagtatatgcccaggatttaaatatctgcatttggtctcccattcagtttgtaacagtttaataaataactaccaacaaggtataaatttgggaaaattgttattttttatttgaaatgtagtgtagtttgatggatgaaggccaccataaatccactccactatgtactaactatgatgattttgggcattttaagaggcaaagcattggtctgtttaattatctgctcctagatatggacaaggggcttattgtgtttacacaaattttcttacatccatcacttattgacctattagaaatccctggtgggaatggagaaaaatatagtgactccctaatattccacaagatttccaaaggtggctttaaaaaacaacctcaagtcagctacctgagaactgggaagttctctgctttatgataggtagatattcactttaagaaaaatatgacttcagatcaggagacaagaatattagaaataattgtagtacattcattttatacttacttgtattaggcatttattttatatcaagcattatgctaagtgttaagaatagcaaaataattaatcatagtctttgtcttcagtgagctgtctaataaaataaccaagcatgtaagcaaataaccacaatgtaatggtagagtctctaattgagacacatagatcaacaaagaaaaattaactaggatagttcaaaaatataacagagatgttactgaagagataattgttcaatgatttttcaaagtattttatttaccaacaaactgatagatgaggagggggttgtgagcaatgtgtgtgatacaaaattaggaaatctaaaagggcatgacacattgtggggaggggacttcaacctagccagaacatgtaagagttgggagccaatgttggaggaagaggttggaaatataaaaagaggttaggctgataaaggtcctgcatgctctgctaagtaatttcaggaagcagctgttgaagatttttgaccagaaaattgacatgattagattgtactttgataaaatgtctctgtcaacgaggaaataaatagatagaaagagtaacacaagtcatataaagctagcagccaagagtttagtatagaagtcatggcatggtccaggccaaaggtgaagaggtcagtagggatggtttaaaaagactggtttgaaataaaattgtttattttggttagaagagtagtgtggcatggatggcaatggataatgaggacaaagaaggacatgaagagcagatctaggtttagggcaaaagacaatttttcttaaaaattgtgcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccagggacggttgtggggtaggggaggggggagggatagcattaggagatatacctaatgctaaacacgagttaatgggtgcagcacaccaacatggcacatgtatacatatgtaacaaacctgcacgttgtgcacatgtaccctaaaacttaaagtataataataataaaaaattgtatatttattaaagtctttcctcttatataaaacaaattctaagtgaaaaccaagtaccaagaaaggaaagagctgctagaagtggatttcccttggttggatgggccaaacctaagtcctataaaggcctaaagaaaaacatttgccacttgagggtggagactttctagagttgggcagcaagacattcctggaagaaaagttgctccttatgggtatcattatttaccttcagtaagcataaagactgggttctttgagagttaaagagtttccttctaataatttgggaaagacatgttaatctcagttccgtgaattagtagttataaaattttgtatgaatcagttggattctctctgaaactcagttgtattatgcttaaaatgggagaataatatctgcctcataattatttctaaaattaaatgaaatagtataagtaaggtgttttgtattctgctcagcacatacgtaatttgtaaatgatagctattcgtcaaattcctattgaaagtagtacatgtgtccattaaattaagggttgccaaacctcaattttatatttctttatatcttgtttctctcctttattcaatcaacaagcagtttttgaagtgttgtcctgtatcaaggggtcacagatttgctggctatggtctgacaatctaatggagagagagaagtattgtcaaataaagacagtaaaatgtgatttcgcagtctataaatatatacaaataatatttcattcatgagtattcttttaatgtccttcttaaaataacttaatttggggatttgtctttaaaactctcgcaaaaatttgaagccaaattaagttactcatgagataactagtttgaattaccatcaacattccagggttatactgcaaaacctatagatgatataactacataaaccaatctacacattgataatatcataatgatagtaatcataatgaagttaaaagttaatgcaaacattatatttcagagtgcctacctaccacagttgctatctgtatagatgtaattatcaaggataatcaacatgagagacattttatttatgattcatctgcctggttggtactatgttggttacttttaacttcgatgggaaaaatgacattggactgggaggagttagaagtgaagaaacgacctacagcatttatttatttatttattttactaaactcctttcatgtcagagaaacataaaactgctgattagagaaaccaggagtaaaatttgtcagtgaaacaaaacaaattctaatcaattcttgttacagtactaaaatgctttcattttcataacccatttaacaagtagatgtttcctgtgatgcaaaaatacattttttttccttttcacacctctacaaattgcttttgtgtgatacactgcaccacaggacacttatccaaagagctaatgtaaaaacctcattttgagaaacaaaagtagtgtcaatttatatgtcaagagaatgaatactgcattccaagttgatacaggatctgacatttcaaatccaacataaattatttggaagactcctgtctttttccctgatctctgtattaacagcttttgtgaccttgaatgcaaatgaagtacaatactaaggatgttcttcatcagtatgaattagaagttttttaatgtatgtttctgtgatcatcagcttattttccaacatttattttttatctccctaaatcagtttaaccagcagcatgttgcgaatgtgactcatgtcatctgtgcctgtggttaacattatgttgctgcaacaagtccacctgacagattttttgagcctaggaagttgtccatttcaattaacaggatgcccaggacatttccctggcagaataataaaagctcacactggttctcctcctctctgaaaaagaagaaaatattatgtactattaccataaagtcaactttctatttttgtttgaaagcacagtcttagcaggaaaccaatataaacaacaacaaaaaaagtatgtgctgaaacttagagaagtgtgatttctttattctctgcattatagtatatgcaccaggcattcctttcttaattctgtctctcctgtggaaaatagatggatacatccatgagtttatattgctgctattgcctgctgttccctgtccatagcaataggtctgggttttctgtgctctggaaagaaagcactttgaagaaaatgcatcattctaatgtttaaatagcatttactctatgaactctttgaagaaacctgtggtgtttaattcctagaccattgctaagcaaggctacctaatgggtggtaaagtaaaaacacagtgtgatgatgactccaaagggcttcaagaagaatttatgcagcttctcaataatactttaatgagataggaaactgacattttctcttagtcaacgttggtgctaaacttttaacaaaattgcattgtaagccataactcttttagtccaactcaatttctctctgttctattcttgataaatatttttaattttcatgtaaacctacatcagaaaagaggccaaaaaaagaaaaccaaactgaagcaaagctccattcagctataaaaacatccttgcaaatgtatgcaggcactccttagatataccattttgtatggttgagcttcacaaactcatctctgcagcaggctgcacatttggctaggagacaactgagttataaaattggttttggactgttgagaaaagaaatggagctaaagcatagagattctatcatgagcctagtaaaataggaaccatttcttttagtaaatttttcctctaatattggtttattgtctttcataaggggcctgatcattatcaagctgcctcaccctgtttctccatgcacagtgatcctcaattaaaattgtgcatatatagatagtgaggagatgagcctaaaatactgaaaatatctcctttcttaaaaaaatcaattattactgaaaatagtatcatagcatcgtacaattgataaattatagcattatgaaaaataattataaaaaaagaaccatagcatcatacaatttgagaactgaaaggatgatcagttaacccctccaaaaattattttaaagatgaaaattgctgtgcacaaatgttgatttgcaccaaatcagaaagctagctagtattggaagaatagaagtttagaaaatatataatgcccaaacctaggctttttaagaaaataatttagtgtaattctttttatttgatttttcaaagaattgaattctaagcagaaaatttaactcactcattaacatttttattctgttgccaaaataaaattattttttatatttgtacgcccccttttttttgaaagcatcttcaaatctattatttttgtcttcatagccattctgtaagttagctataaaaatttctgatttacttttttcccactgaggacagtgtaaaacagagataaactacaacatttctaagttcacaaatcaatgtcactacagacattgactatataattatgagtgccaatgaatttgcggaagaaaaaaaaaagaggaaacttactttcactgaatacaaagttatttgtgctgaaaactattgagagaagttttatatttattaggtaattatctgtggagagccattatctcaatttcccaaacaacagactgagtctcttagatagggtaaataattcaactgaggctttaaaactgcttggagacaaaggtgggattcaaactcagtattgttactccaaaacaactacatggtctgctacgtcagtggctctcaaagtatgatctgggtacctgtagaccccaagacgtttttaaagaagattctaggattaaaactattttcattataataccatttaaaatctcattctctaacaattgtacactggagttttctagaggttacctccagctgcttgactgaagaagcagagtccatctgttttctcttaaatcaaacatttaataagatttgcagatacaaaaaataatgtcatgcttcttattatttgttttgttttggaaaattgttttaaatatattaattatgttacatgttagaggtttattgtttattttaaaataaattaattatatttttattttttacttttaatatctagtaggttatatgtctgtagatgcagctcacacacataaaacctctcatgcatccttaatttttaagagtataaaggagttctgatacaaaaaacattttgagaactgtgctaaattaagcttctttactgagtaaaattggaagctacaatatacagcaaaacaacccaggatctagctttcgaaagacaagcaaatctctgtgtaccttagttttagtgctagaaataacctttagataaaatcttgcttccatgccggttttttatttaacttatcctagaaataaatcagtaattattgttctttgcttggaggtcatgagttatgaattgtcactgtaaccaggtatttaaatcagactcttttgacttagtttgagcaaaggtctaaaaagccaaaaaggaaaagatgggtgataaaacttgcacgttccaatgtgaggggctagagtctccacagggctttcaaagacaactttaaaaattggtttgacaatgctgcttctacctgaatataaaagagttgaagtaggaaaagccaggtttttggaaattaaataatttatttgattatggctgtcattgtgctctgaatcttcatagaggagggaagaagaaagcttctgtctcccacaaaacctgaggggtggggctttagagagaccatctggagatcctcatctgtaacacatgacatttctggggctccacagaggatgtctgacccacagcaggaaaagtcaaaggtggggatattgtgactgactcagccctcaaatggaggagcatgcattgggagcttcattgagagcaatctgtgcttacagagactgagagccaagaatgatgtttcctctgggaccagatattgagaaaccagcctgtagtcgttgtttttagtaactttttattttttattatatataactgacaataatacattcattattattacataattatattgcattatttcatgcctacagacgttacaagacaagcacaaaaatccccatatactctttaccaagcttcatcaattgtttctgttatctcatttgctttattattccatctctctctctctctttctctctctctccatgcacattcatcacacatccacttttgttttctgaactattcacctataggttagagacatcatacctctttactcctaaacacttaagtatgtacttcctaagaataagcacattttcttatataaccacagtacagtggtcaacatcaggaaatttcacattgatgcaataggattacctaacacatagctggagttgttttaaattcttcgcaacactgcctggaagagcatcctaacctcacggagggagagaactgctgttttcccaaaggttgaaggaggaagtgtgaagggcaaacagatggaaatgcatggggttctaactcagtcttgagtgtctagcaatgattctaggaaattggggctggaaatagaatagaatcatttactgaaggacaattcaaagacgtatttgctgggtaatgggattgagagaggcgtgtggccagcaagcagcaaggcaaattcgaggatgggttggagagcacctatcccaagcttctgtttgtgcctattgactaatgtcagaattggtggcagaacccagggttgtgctgcttcaaaaagtaaagcacatttatgttagctgctgtactcttatccaaatccagaattttgcttgacagtatgttaatataatgtgtaatgtatctttaacattctagggctataaactcatttattcatttaataatcaaatattaactgaatgtctaccttgtaaagatacctgagcagtttgttcaacactcattcattcaacaaacacttacagataagaatgatgtaccagagtttctaattgctaggaaaacagtatttgactaaaatgggcaagacccctgctctcccctggaaagtactttctagggtacattctgttgtccttgttgaacttagcaatatcatttctgtagggggatgctgaaatgatgttttggtatatctgacatactatattttttatttttgtgattaaggaaagatttggattggagaataacgctaaataaaattttgatctagctttgttcctcagaatgatctactgtcttcttaaagtcctgtttgttggctacatattttgttatttttaaatattttcaggatagcaggtactttatgctgcatttattgtgacctttgatagtctaaagcaaagcagaacacacttatttaaaatgtgcttataagatgcttctttaggcaaatagaatttatacattcatgagcaaaagcttacagatgtatacattaatgaactaattattgtgaataccaagtgttgattttatatccaaagttccatgtgtgtttttaatatttaggaagttatgatttgtctacaagtattttgacgtgatacatgtattaaacactcaagcctgaattcagagtaattttcctctggaggcaagaaaaaaattatctgaaccatcattagttttacttcaatgtgaatcatgactccacatcaacatgattccatttcccctaagctgactttaaaactcttaaactcaaagccaaagctataatgacatttgcttgttgagctttatagaagcactgggaagcctggaaatgatgcttaaattatattgaaccttgttgtttctagtagccttttttaaaccatgagaaactaagtttagtagcttgctttggggatattatttctagacacacaaatctagtgaaaagaactcgaagtacactgtgtcagatttctggctattatacgttgtagaataaaaacatgattgatatcttaggcatacacacacatataacacatatgcatatatatgatatatgtatgtatatgtgttttatatatacatatatatttcttctatacatatgtatataggctctgtattttgttcttcagtacttgtaatgtatgcattcatatatatgtttatgtgtgcgtgcataatagctattaagtggtagcaagttataaagcctgtttgactctagagcttttttaaaaaataccagacattgtaactgtataagtgaccttttcagaaggttggtaatattgacaacctcgttgggaaatgtgttttgattttgctaaatagaagtagattatgtttatatatgaatatgaaactactttaaagtgaatctttccctcagtgctagatataagatactgaaaatagatatttaaaaagatccttgaaatgcaaatgcctttggcataatattatgataaagcattgtgtttaaagcctgatttgttaattttatgcatcatttatttgaattttatataatttttaaaggaaatattactattcaagtgttttaaatcacttccttttataattctaagttaacagattgcttacagcagtttatgcttctgttcaaacattttaaaggaagaagaactttattaacttgttgggcatagaaattatatctgttccataaacatgttccaagtacagtacacagttattattgcttcttgatgaaggaggagtgcatgtcctagttatagaaatgaggaagtaaagatccaaagagttagttgcattctctgaatgtgtaatgcatttatatattgaacattggaaaaaatgcccattcttatccatttaacatgttctttcttgataagaaaatgcaattttgcagttaagaaaagcgaaaagttataacaaataaaacactatgcttttatgttattggaatcacgtggtttatttatttattggtttttagctattagaatatatttaaagctaattgaaattccacagaactggatactgacttgttccttttatacacatatatgtataatattgtgtgtgtatatacatatatattttatatatatatatatatatatatatatatatatatcacactttcattgtccattcactatcaatggacacttaggttgtttccatttcttagctattgtgaataatgctgcaagaaatatgaagtggagatatctctttgagatactaatttcttttcctttggatttatcaagaccacaatgagatttcacctcacacctattaggatggctactacaaaaaaagataagcgataacaagtgttggaaagggaatggagaaaagggaatcctgtacattgttgatagaaaaacaaatgctacagccgttatagaaaacagtgtggaggttcctcaaaaaattgaaaatagaactaccacacaatccagtatagcccacttgtggatgtactctgctttattaagaggactgaggttcttgctatttcttgaacacagagaactatctgctgcctcaggccactgagccttcagctctctccaccttctctccaggaagtttcttacctggatcctcagctgaatgtctttctcactttactctggtttctgctgaaatatctttccagagacccctttgctgaccgcctactttaaataggctctcctccctgtctcctgcttacttccattaagctttacctgcctatatttttcttcatagccattattactaccaagagttatattgattcactttctcaatgagtccatgagagtgaggacttcatcatatttaacactagaaacactgtctatcatattaaggaggtgtcaaaaaataaaatgtcaatgcatatataaggcatataaatatataagtatgctttttattatatataagtataacaaataatacatagatattatgtagatatatataaacttgtcaagccctctgtggaataaatgcattgggcaggttgaaactcgaaagcttttaggcatgtgacaaccatacatactcgaagccaatttgtgatcttaaaaaaattcatttttttcccaaagaagaagtcaaactaaaacataatattctatggatattttaatgtggaacaatagaaataatttatttaaaaccataaataagaagctttattaagatacattctatctgcagcaatataaaagcatagcaccacatcaattatcttgagtttgctttaaacagatagagaccagtatagccatagacttcacatcaaccaccggccaaattttcatggtctgatagcctttctgtggatggacatttctccttatacattcccaccttgtgtgcatttgaacttgtctgtctctttatgcagtcatattatggactgataaagatctccacatttgatcagattaaaggggaaaaagaggatattgaatatgaccaaatccataagatgagattatcaattgcttgttcaagtaatattgtaaaaacacgtggttaattttgtcatctcaaaggtatttctatggtgaatgtgttcaaaaaccagaaaaatcacatactgtgtactgaaagcctcttcaaattttctgtctgtcgagttattttttgtgttctactaaccctgtcagaccttatcagatatttcttcacttcaatacaaatctgtttttaagcataatcttctcttatgttactgttcttctaaaattttaagtgtaaatgctgcagaataatgcatgttgctgactaatctaatactatagaagttcaaaattcaaaacacagaaataaaggaatattgatagagctaagtgctattcaaagttttttctgtagagaaaattagagcctgtatattcgttacagagactgtaaacactaggagagtaaagtccctgtgcgcactgtgggcctcatatccagggcacttagcactatataggcactcaatacatctttgttggataaacaaaaatttgaggctatgtaaatgatcccttttcccccaaaataaaaataattataacacagtattagccatttaggtataattggtaaatagttaatatagtcttactttggtctaaaatgtgcctgtttttctggatgtggtattgggaaggaatgaattatattcaataaacaatgaaatgtataagtattatagttgtataattgagtgacaattttatgccgttccataagtaaaaacttcactttacccatgaccttgtctcaagagcaatagaatagttgaaatgggacaagacatagaaaacgtatgtagaggttcctgccattcaaggtggaataataacagtaataaatattctaagagcattatttcaaaagagtcttttatgttaacaatagtcacaaaaatatttcatttttctatatcttgtggttgggacattagtctcttatgcagaaatatgtacaagatatatttttgtttttgaagtcctacatggtagtaggatactttcttgttcctgggtaatttctactaatgcaggtatcagttatgccttcaaactattcaatacctcacccttgcatactatcggtagtgcagatttgtttttgttttatagcctttgttaatgcatttgcagattgcactgaaaagagcctgagaaaattactccatatatcagcatcaacagtacaaattgtttttgtttcttttcttttttaattcacacactgtgctagtgtgccatattgtacaaatcagtaaaaaaaaaaaaaaaataggtaattaaagctgttctggaaagttgtagtgctggagcaaatatattttttcaatgtttctcaaaaccaagcaacagaaagggtaaataaaataaaacgtgaagccaaacatacattctgccctcttccaaccacaaggattcagaaatatttgcaacttctgatttggtgattaatttagcatcacttgtgaaattagtgaaattaaaatatttttcatgcatgtaatgttattctctagctaaggaatcctgaatgaaattttatttatgtagatatgctaagtgtggccataggaggttacatggtataagttaagtaattaataatagctgtaataaatgttattctaagaattctcacagtaacattttacaattagagattattttataatcaactgtattataaagataatgattttcttctttactcaaatgtagaaagaaaagttagctgatttgtatgttgctagccacatgtattatataaattctaatacaattacatgtcactgtgcttagtttttatgtcagacttgcttcaccattcacagttttcctttttctccttgaacacagatcatcagtaccatataaactacatgaaattttgtgattttaagtcaatcatgttttctcttcaacatgtgatgaatttcagtattaaatacacttctatgaaagaagcaaaaattctacatacttcataattcactttctaaattttgccttacaatattttattttattcaagtactgtgacacattaaatgaaacattacctgatcaaataaatgctaccaaattcttgtgctatattaattttctgagtttatcactgttctcatgagaaacctgaatttgctctttgttgccctttgtgaccttattctaaggatgtctacaatatggtccaatcaactttttcagtcttctttctctctccttcccatacttaccttattctcctgccacactaacctactctctagaatccaaacattcccagtgcttttctccctccataacttttctccttcataactgaaacacttttctctatcaaaacgcatagaaagaatggtcacccttcaaggaccaaatgccattagggcttttactattccattgagctctaatttgtatgcataaaaaactcattatagtctgccttgggtagagttttaaatgggttgaactctccttttcccactccatcttctggattaaaaattcttgaaagcagaaatttcttgagatttcttgcttttctattttaaacagcatttgggaaaatgctttgcccaaaatagtctatcagcaaaatataatgaaccaatatacattatgagtgaatggcaccaattactttggtgaggccatcccaaaataaaaacaatagttctttatacacttttatgtttaaattaagtgaaggagtaaggtgatgccatcagctctactttgtcttagaagtatacctacattgtctttaaataatgatgacatttagatgagatgggttgagttctcctcagagatatgttatgtctccagtagagttatagtattctccaatccttacctccaatgcgtactcactcccaacaaccactatctaaacttttggagctgctgctcatttatatatattccagaaagaatgaaatgcgtaagtttaaatagagaataaacacataattttaaaaaatgatttacataaataacatctattaaaattagctgctcaataaaatctctactagttgaaataatcatcaaaatagtattgattatactgatattaactattaatatcacaattatttgacttctctcatgttaaaactctattctagaaaataaataagaacattttccttagtatattaaataaacgtaaattttattttatgccttctgcaaatacttctgatattcccttttaagtaatattataaaatttgaggttgtagtagattgtgcctaatgtattcatcagggcttccatgttaagttattttcttagctttggcttcttcacaataaagaaacatgaacaatgtacaacacagaaacgacctctcaggtttgtggataatctgttatagcttgtcagaaaatgcaggggaattttatatttatggcttgaatatccctaaatcaccaaatccatccgctcttacttcctgttaagatgctaattcttgttagaaccctattatgtaactttcatattaaacacatcacagaattaatcctggctcttccttatagaacttaaaagaaaagcaaaggcatgcatagttaatgggcaggaggttagtaaggtttgaggtgtagtaattatcagactgggaaagaggaaaaatgagacatagaataagatataataatattctacttttggaaatcctaatcatgggaaatgtctagaatatatgcccacatatggcaaagtatctcctgtacccgttttttctttctattaatggtcacaaatcatgtttaatgatgcaagctggcatgtaagcctttgtgaaaatatatatatgttattaatctaaataaataaatatcatgggagataattgaaaattattttatgtcctacataataactaaatatcctgtagaaatcaagtaacttttttcacgtttacataaaagtcaggagcatagctagtattaagcctaagtgtaattgtagctccatgattcaactgtaccaccagattggcaaggtaaattctgagtgagaggatgctgtgttgggaaaggggactgattgtgtcctttgagcttttagtttaacaaatatttatttagaaccttatatgtatataccaggcaatgtgctaggtactgtgaactgaagattagttagatagcatttcttggggagcttctattgccctaaacaacaataacaaaaacaaacagtgtaatgcactaagtgatatatgatagagacatgaattttataggcagggaccttatcttgtactcttttttacaccacacaactcctggaattaaacaatttgttgatgtttgcctgttttatagaaatggaactttggcttcacttggggctacctccagtgtattgacataagaatacaactcacaaaaatactgtgatttgtattcagctagaagggctgagcttcccatcaacctctgccaaccaagtttgctagtcttaatacagttagcatttaaacgatttcattatgttgacattttaggtcatgttacaattgttagtaaaattaaaaatccacatgtgatagatggtgttacaagattccagtaaagtctgttaaagtgaattattttatgattattttctgattattccctatttcaaggatacaaagtaattgtaagaaagacagtttcttttcaaaagtgttacaaacttaaaccataacaagagagaaaatcacaacgctaagggattctatggcaaataccacaatgatgacattgaaaaacaaagcaaaaaaatcacttgaaatcacttgctatagtatataactccaaaagaatttgaatttcaaattgaacttcagtctctttagttgagttttatatcagaagaccaaaaactcagatccttataatctgcctcgagttgtacctcccaggaaatttgcctgttctaaggaattaatctgatatttctcttgaatatgttcttttgtcagtaaaaattagttgccattcacattagacacctaaaagatcaaagattggaagctgagaaaacagctcatccatgttattgcttcacttgatctgctgttattctattcattgtatcatttcatgggtgaaatgagagtctccttccaaccaagtcaaatagtgtcaaaattgtaggtgtaattagattgaactcttccccaaatctctaaccatagtgcacccaattgcttcctctagtgaaaactttagtatgacttaactatacgttcctcatgtaatttgttgaatgctgtctatttctctcaaatataattacattactttaaaaacatctttgaattctcctctgaataaatcattgatttagaatttcataggattgcatttatgctcattttaacattaaagaataatttgatcagaattaggtggttggttcttaacttatggtgagcttctttcttgcatcgtctcctacctttggtcttttctgtttatcagtatgtttcatccattgaagggggatctagagtctagtattctgaaatcatggcttcataagtactccaacttccgaacatctaaatctaagaactagcttttaaaatgtgttttaaccaaagtaaatttttaaaaattttacttctagggcttttagaattaaagaaatgctgtccatttaaaaggagtgtggctatttgggttaacatggtcttttgtgatttcaagtctccatataacatatcttacccatctctctagtacttacctcttcacttagattttcactcatattttatagactataattaagacaaaacatatctctagacctccatagacatgtggttttgttttatgcctaatgtaattctatgtgaactatgtagaaatagatgttctggagttaaaagtagtatgacaaatgttttgaacttctcataaatttatcctgaaggcaagcccacaatattaaatcatcatgtgtagaggaagctgtcctgttgattttgaattttttaaatataagaatcatgctgttcaggcaaaagccccaggaaaactgatcaatttaaagatgttttatcttgaaaattctttggaaagcccttttgttttaaggcttttgttcctctaagattagataaatgattttcagaaatctaagatacctcaataaattagtaaatctgttctctttcctttgggtaaatactgctttctccccattttactgatgaagaaattaagatgaagaaaacttacattaatatgaaggtaatatatctaataagtagtaaggaatgtctaaaaaattgatttactaccctctcaaagtccattccaaaattacagagacttttttgcaagagaaaaacaggatttggatacaaacagaattgaatttagatcccagctctgatacttattaactccaaagaagttatgaactgagtttgctcatatgtaaatagagataattaacgcctactgaacaatttccttgtgaagctgaatgtgataaacatatgcaatctgctgaatgcagcttattaaatagcagctgtaatttttttaaactatgctgcttctccataaataggcatatagcctcctccagtgaatctctgaagagggcaattttcatgtgaatataaaggtccaggatacctgtgaacaaagctgtattattttttataatctgacacctttttaaaaagttttattctatttttaattgatatatgcccttttgatatacctgtaagttggtgtcttaaagacagggataaaaaataatggtgtctttagagtaatttagcatgagaagttgattatttcctattttatttctacagttgttctccacatggatgcccaacagtggaaaccaaagaccacttcctctaggctgtaatttttgtccttactggtcttgcatttccagcttggcaccttcccaccattgtcatcacagggtatggtactgaactaaactcagaatatagcaaagcacctaaagatgagccgctagtcagctcagaactataaaaatctcacgccgaaccccaacataccacttacttgttcaatgacacactgctgggtttgaatatggagcaaaccaaggtttaaatacataattttctcttcttcagtcttaggcgtgtatagagaattgctaccccattctctctacctcacttccccaaaagttgggaaagctgaatccatttatgttcattgtttgtcatttcaccaacatcctccatccttataggaaatgtgcagagtttaggcagttaccttagagcactttgtaaagatttttggttggcttctcctttttatgaagccaacaattatgtatctgttttatctcaacattctccagactctaactgttgcagcatcagaatctgtgtagatatcaataccttctggaaatgaaataattcctttgcattctctttccctcatgccttcctcctcttctgtagtcccctttgtttacccaccacttcctgcccacaaagccacccattctgccatcactgccatgccagcttccttataggaatattgccatggtggtcttgatttgtacatagaatcataagagacattctgctctgttttgatatagctgagaaaatgacccctgctcacccctgcagactcaactggcaaggaaacttgaagctgtagcttcagttgcttgtaatgctttttaaatagacctttctcattaaagaactgtacatctttgaacctcatgtgataagtgccctggcctctctttccaagaacacctaggagaatatgacaatgagaaaacaaaacaaacaaacaaacaaaaaaaaaaaaaacaaggtagaggcatcacagaagtcccaggaaccatccagccttcatggctgagaagtcatctttggcagctgccaatcaacattcctgtccagtttttaagctcagagtattttctgctcatctccattcattgatgagagtttatctaacaactactcattttaagtaccagcttattacagggaagcacaaatatatagtgcatggcctcctctagttgtcaagactaaatgagcattgatgaaactgggaaaatagagagatcatgtgtaagtaagtgttgaattttgtgttacagaatgtaagtacctgacaagcttgtaggaaaaaaaatacctaaggaagccattgttggtatggaaagcttcatggaggtgtcagtaattgccagatgggtattgaattagctcttcatggaattaaatatagatgctaagaatttattcagctccttttcctctacaatgagtagtctcaattatatgaccctgtagtaaaagaatgtttacataaactcctaccattttgtagcatcttttgaacactcttcatatctcttcacttggggatgctaaacgtggaagcaggaagtgtgtagagtcactctgactgtaataaaaagaaaagataaagatttctacatctgcatacctatatcaatagtacatgtgaatgtcagttcatgcatacaaaaaccataaattacctttggcattctctcctttatattaaagcccctttcagtggtacttacttttcattatttgaatcagtgcattgatcctttattcatcttttctatttttctcatttctctttatataattcatatcaggctattctctttcacgagagtgttcacaatggcccattttaataaacggacctgtatgcagaaatatttaaagctggaagtcaccttggagaatcaacttctcccactctctcatttcacagctaatgaaatcaaggtcagaatagatgaagtgatttgcctaaggttatggactaaatagaggcatcagaaataggattataagatacagaattttacttttgtcattatgtaaccttattaattgaacatttatttatgtgacaggtactattctaggggctggagaccaaccaaagcccccccaggtacaattctgctcctgatattcacatctctgcagatttcagttagatgtgctcaatgtgactttccgttatagattttggtaaatagttttgtttcttcatgctttgatagtgcccttatcgtcactcagtcccaattaacttccccaagcttctcatttaattaattcccatcctttttttttcaaggtacatactagctctcctgacttagtgccatcctgcctcattgtcatcccccctttctaaaataattattttgagtataatgaaatgttaaacatgattgaacccagtatgtgattattgtaactctggctgccaacagatgttttcgtatttgttgacttgtataataaagtgtcaaaacagaaaaaatgagtagttctttcatccctgccccctttccctttttaaaatctttgttactaaacatttgttctgtcataatgagagcgggcttgtagacttatgcctcttacatggttgtcaatggttagacaacaaaagagaaaaaataggaaaattcttctgccctaaatatgaggtacaatcttttggccttctaccttcatttccaagaaagtccatattctgaaccattaccttccatactgttcctaccagcaaccccacaggtacttctagtggttacctgtaaccatagaacatttctttgtttactctattacttgatgaattctttttctttcactacctaatactctttagtagttatccaggtaaacattattatcttctatagctgtagacacaatcagataatgttgtgcttaatgaacaaaataaaatagccacagtttcatgtaatacagtattgataatgaaaatggcattttatttttgtttaatatttttaaaggatagttgtatggtctttttttggtaatgtttattgctctataattttaagttctcacaaaaagctgcagggatagtacaggttctcatatgccctctaccttgactcactaattatttaccttttgtcatatgtcattttttctctatcttctctctctctgtgaatatatgaatatatatatatatacacacacacatatatatacacatatatatacacacatatatatatacacacatacatatatatatatagttgtccaatacaggcaatttatctttaatataatggtattaatataataccattatctaaatcacaatctatattcaaatttcatctactgtcctaataatgttcttaacagttaattgttttatttcccactggtccaggatccaatctagaatcatgcagtgaatttagttgccatacagtgctttatttttgtgttgaaaagcttacattaacaataatgatctggacagtgtccttttaaaaataatccctgcttactgactgctgttccaataataagaatttaagtcaaaagatatgtaacaaaatcccttaggattagtgatatctgtgctgaggatatctgtgcacatcaaccttgtaactattttctaaccaccagttttggcatttcaatgggagagggtccaagacagaaaactctgagtttattaatattttacagttttgaaatttaaaccttaggactaggattctactgccattctagtccatcatgggttaaagggatagtgtttataagtagccatggaacaaggattcacagtgccctctttaaagccaatcctaaataaatatttagctcagcactatgctaccgaagcctcaaataaaatcaatattctcctcaaaagaaatgcttgatatatttaaaacaaaacctggatgtaaatatgagttgtcattcttgaaagtaagttatctttttaaaaacatacagctatgcacttttaaatgtccaacattaaaatgaatataaatagttgtcttcctccccaaaaatgccgcaaaaattatttgtatatttctgatgcctaaagcatgcagtgttttgcttaattctgtaaatagactatggttaggtctacagggtgtgagcagtttgctttctagcctctgtcgaagcaacaataatccctaaatctcagatatattttctcaatgtcaagcctgtttctaaaactagatacaaaaaaacactaaaaagtcatcagctttaccaactatgaatgtatataatattttgtgaaaaacacacaaccctacctaaacagattaatgttctttaaaagtattgtacaaaaacataaaagtatcaagccttgataagagaaaattatctgagtcagttaataccaattacattactgaaacatcagatagatgatggaaggtgcaaaataatcctttgctatgttcactttctcctctaaaataaagacaaggcatttatacatgcaagaaatagaaattagctaccagaaaaatgctgtgcccatccatattcagagcatagattaagaataaaatagttttttaattgattctaccacattttttatttttttattttttatttatttttatttttttattttttttattatactttaagttttagggtacatgtgcacattgtgcaggttagttacatatgtatacatgtgccatgctggtgcgctgcacccactaactggtcatctagcattaggtatatctcccaatgctatcccttccccctccccccacccaacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtaatgccgcaataaacatacgggtgcatgtgtctttatagcagcatgctttatagtcctttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtgatgatgagcatttcttcatgtgttttttggcagcataaatgtcttcttttgagaagtgtctgttcatgtccttcacccactttttgatggggttgtttgtttttttcttgtaaatttgtttgagttcattgtagattctggatattagccctttgacagatgagcaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtactgaatggtaatgcctaagttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccctgctgttttggttactgtagccttgtagtgtagtttgaagtcaggtagtgtgatgcctccagctttgttcttttggcttaagattgacttggcaatgcgggctcttttttggttccatatgaactttaaagtagttttttccaattctgtgaagaaagtcattggtagcttgatggggatggcattgaatctgtaaattaccttgggcagtatggccattttcatgatattcattcttcctacccatgagcatggaatgttcttccatttgtttgtatcctcttttatttcattgagcagtggtttgtagttctccttgaagaggtccttcacatcccctgtaagttggattcctaggtattttattctctttgaagcaattgtgaatgggatttcactcatgatttggctctctgtttgtctgttgttggtgtataagaatgcttgtgatttttgtacattgattttgtatcctgagactttgctgaagttgcttatcagcttaaggagattttgggctgagacaatggggttttcttgatacacaatcatgtcgtctgcaaacagggacagtttgacttcttattttcctaattgaataccctttatttccttctcctgcctaattgccctggccagaacttccaacactatgttgaataggagtggtgagacagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcaactattgagataatcatgtggtttttgtctttggttctgtttatatgctggattccatttattgatttgcatatattgaaccagccttgcatcccagtgatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtgggcatttagtgctataaatttccctctacacactgctttgaatgtgtcccagagattctggtatgttgtgtctttgttctcattggtttcaaagaacatctttatttctgccttcattttgttatgtacccagtagtcactcaggagcaggttgtttagtttccatgtagttgagcggttttgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagggttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtgggtcactcaggacttgctttatgaatctgggtcctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatatgccagtctgtgtcttttaattggagcatttagtccatttacatttaaagttagtattgttatgtgtgaatttaatcctgtcattatgatgttagctggttcttttgctggttagtcgatgcagtttcttcctagtctccatggtctttacattttggcatgattttgcagcggctggtgccagttgttcctttccatgtttagcacttccttcaggagctcttttagggcgggcctggtggtgacaaaatctctcagcatttgcttgtctgtaaagtattttatttctccttcgcttatgaagtttagtttggctggatatgaaattctgggtcgaaaattgttttctttaagaatgttgaatattggcccccactctcttctggcttgtagggtttctgccgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccagtcagacgtagacttggtcttttcacatagtcccatatttcttggaagctttgctcatttctttttattcttttttctctaaacttcccttctcgcttcatttcattcatttcatcttctattgctgataccctttcttccagttgatcgcattggctcctgaggcttctgcattcttcacgtagttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacgctgccgtgtgaggtgtcagtgtgcccctgctggggggtgcctcccagttaggccgctcgggggtcagggacacacttgaggaggcagtctgcccgttctcagatctgcagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcccgggcaatggcgggcgcccctcccccagcctggctgccgccttgcagtttgatctcagactgctgtgctagcaatcagcgagactacgtgggcgtaggacccgccgagccaggtgcgggatataatctcgtggtgcgccattttttaagccggtcggaaaagcgcagtattcgggagggagtgacccgattttccaggtgcgtctgttacccctttctttgactccgaaagggaactccctgaccccttgcgcttcccaagtgaggcaatgcctcgcccctgtttcggctcgcgcacggtgcgcacacccactgacctgctcccactgtctggcactccctagtgagatgaacccggtacctcagatggaaatgcagaaatcacctgtcttctgcgtcactcacgctgggagctgtagacagcactgttcctattcggccatcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttggtaagtagtaatgtacaatgtatatagtgtcaactattctcttattttttaatagaatgtctttgtcttatttaacaggtttttttcccatatttcttgtaagaagctctgtgtcactgtttaccttaatgtgtatgtccacagaatcttgctctagtttttgttttaataaaaaagaagtgtccgtatactaaaactatacaaagcatatctaaaattgattatggctctaagtcatgtttttagaggcagtcaggcaaacctaggtgcattttaacattgctcttccaaatggattttactaagaaacagttgagtttcaagcaggaataaaggaaaagcagatcttggagatttaactgttgagcagatgcagtaaatgaggttttggaaataccgctgtcactttagatattttatgctgagttacctatgtgacccaatagctagagctgctgatattaaaatatttttgtaattctgttgaaaatagatgccatgagaactcttaaaaacagagtaacatacttattataagacctattttaaatatttcattctttcctcattttcatgatacctaaattttttgaagactgaaaatgatgagaacttatataaaaaggtacttgtctgtagcatcatggaaattttcatttatgagttgttaacatgtcaaaccaaatcagaaattcctgatatctttattacattaaagcaattcttaatgttgcctcttgagaagggtttaatttttttactctttaaactgaaagtttatcttttttatgcaatgacgtgcaatcatttttctcttaattcctgatgggcttgtaatatatacatatttatttgtgtgtgtatgtacctacatatctattaatatgtatataaacatgtatatttaaatacatgtatgtttatcctatgtactagaatagttagtaggttatatctagatattgattagcttctgaaaataggcaaatatgtataacatattgaggtgtttctaacatcggtgaaaaatataaaacttaaaagtaacatggggctgtacaaggttgatttgtaatagtcatattggtaattgagacagcaccagatatttaattgactaagaatcatgtgatttatttcttaataaatgtaatattctctaatgtctgcctagattagtgttactctaatttcaaattaaaacactatagaaagcataattgacttttcataaaatcagtatataaactatccacagactctcaatctctagctcatcaaacaactttaaaatccaaactatctgtattatatatactaaatatggatatatatgacattatttttattggaatatatagtaaaattttaagtagaaatattaaataataaaattaacatatttatgacaaaaatgattctgaactatgtgtagtcaagtaacctctgtatatattgttttccttttagaaaaacagaataattctgaaagaaagaaaacaaagaaaaacatactccagaattcctaatagaacagtaagtactttaatgacacaatgatgataataaatctgtaaaattagagcttacaaatgtcttttatagaaatactaacttctattttctaagataataaattagtagaggaagcaagttgagccttctctttcaatttactggagtaaactgaaaatcatttgtcctataatcctcttacataagagggcaaagtactcgttgtgatacatttatggggcagaaaacgtttatgatgactccatcatatcttttgactagcatagtatcatcttaaattctaaagaagaaaacagtaataagctagatgtaatcaaagtgcctcattttctccatatgtgataaaaagtttttacttattttgaacaaaattttaaatactattgatgtgcttggtttatttataatcactaaattgggattattaaaaaatggcagctatctgcaggcttaaaatctacaccatattctcattagtacatttgtttctaatctcacaacttaactaaaagtgtatttcctagaaatgtatttccttgctattgtttgatgataatatagttttcctaaatatgttctcactaagcaaagtacatgttgatgtcaatctttatggtaaaattggtgacaatataaaattttcaagatgcaggcaattataaattttgaatatgtgaatatgaagaacaataacataaagatagaaaagcaaaacccatgttgatgacccacgttgtatcacatttaatatttttgaaactgcatttgaaattgcatttcaaactcaatgtttcaaaagtttcaaacaaatattagagtaaaacatagtataataaattaacaaaatgaaacatctatatcttagtacatatcaaactagagtcaagttcaatggaaaaaaatgtaagtttgatatataaaaagtagaaatttctaaataattttataggatatatacaaattattcctgcataataacattttttagccccaaagaactttgatgcataaattacatcttaactttgaatgattgggtataattaatcatcatcacgatgatataaatgaagtttatctgaaatatattttatttatttttgaggtgtgagaaaggcagagaaaacacatttcttttacctgcctgtctgaaggttatgtatgttacaacttcacacaaagcactctgccacttactttttgttgtagttatgaacggccatatattttaaacagaaatctataaaatttataattcaaaatgtttacacttttaaaaactactctttgatttaaaaaattaactctaaatgtatgaaagtctattttgagtattcagagcaggttacgggcatgtttacatagttctgggtacagggataatttaagaatcagatttttctgtcatatataacaatttttgaaacctgcaaatctgcgtgagttacaagatatgaaataagtgagaaatttctttttgacatagaaattttttatcatcttaataccctaacatagacaatgaaatcattcagccaaaacaaacctttttcaacatctaaaagactagactgtcttaaagttttgtttttatatatataattctgtttctaaacataatttcaattctgtacaatactcattggaaaatggttgaattttttaaactgacaggactgacataagctctttatgcaagaaccaagtgatatctacttcactccctcacaatttctcggccctctgagtataatttcatgtgaaaagccatcaatgactccttttctgcgctgatttatgtataagttatttgatctattgttcaggtgtgacctatataagttatttgactggaactgtaattttcataattgtattgaaataggatttagcctagcatacctcggagacatctcattcaagtaatgagatctcctgttcatttgcagtaatcttagaaaaaaataacatacatgtttccaaagaagaaattatgcctcttttcatgcatttttatgtggtttggagcaggttttaatctcagattttaattacctattatttaataattatatgctaaatcactcataaattacatgcaaaaaaagactcttcttattatactgtaataaaaagtataatttatcctttaaaaattttatcagatattgtgaagaggaatactctgacttaaatgacattgtcaaaacataagagttcttaaaatatcttagccactaaaggctcgtgagttagtgttagacaatacatggaataaaacatgatatcagatgaatataatagataatacagtgacattttatctatagattgtgcatgtgtttctagcccatgaatgagttttatgaattgtattggaatcaaaactttataaatgaaagctttttagcacaggaaagctctacaaacctcttacaattttgcttttaaatccatagcttaagaacaagttgataattgattaaaatattactataatattgctaaagacgcttagagcacattgcatttattgcttacaaaaggtttttgtgcttaagaaatataaaagataaaaatataagatgctttcttataagaatagaaaaataaaagaccactggaaagtgtattctaaaatacagttgactcttgatcaccaactcccacacagtcctaaaattccatggttaacttttaactcctccaaaacttaactactaatagcctactgttgactggatgttatcaataacataaatagttgattaattcttatttttcatgttatgtgtattatatactcttcttaacaataaagtaggaaaagtgaagaaaatattactaagaaaattgtaaggaagagaaaatgtatttactattcattaagtggaagtggatcatcataaaggtctccatcctcatcttcacattaactaggctgaggaggagaaggaagaggaggggttggttggttttactgtctcagcagtggcagaggcagaagaaaacctgtgaataagtggacctgcatagttcaaacccgtgttgttcaagtgtcaactatagtcatctttcttttgattgctgaagctcagtaatactttcaagaacttcatagtctcctccttgtaaactctgatcacactggatactaataataaagagggtgtgtttaaaaaatcattcagatgctcagacatccgtgttagaaactcttcatattatcctagatttcctaagcctctttaataaaactgggagttgatacactcactcaaagtgtgacaactattaacaacactgctttcctgaaaaaacaaatatagcaagaagtttttagtaagagtgattctaatggaaggcagattttaaccaataaaacatcttgtggctcattagagaataaatattatttgcaaatatcccaaatgttacctgcaaatgctcctgacaagttttacttagtcaatatttccctattagaagtaataaagtcctgcaataaaaaagcataagcctgtgagtgtgtgtaatagtggcataaagctaggagaaaatttagaggtcacctattctaatattttcattttatagaggttacctcctctaatattatcatttatatatggcctgataggtcaagtcatttgcctaagctcttatatctagtgatagaattgaaaaaaaaatctgtgctaattaaccacccaccatttttttctatctgccatattaactgaaagtgctgttattaaaaaatgcatgtgtcggaactgttaaaaaaaaactcttctccaaatttaatcttttttcaaccaaaacactagtgaaaatttatgtaaattattgtttgtctaatctctagtagtttaaaattgtattttgatatagtttattagaatgatgtttataaaagttatatatctccacagtataacctttataaataaatatatatatacatatatatgtatctccactatgtatgtataaagagagctcatttatataggtatttatttatttatatttatatatatctctactatatatgtataaagagagaggtaatctgagtcttggcttaatccatctccacctaatatttattaatgataagtagtaaagaaaaataacatatgcacattaagttttcatgtgcagcgaatccataggaaaatgtgaggacattcaagattacacagtgaaaaaacaactagataataataatatgtaataataatacataaaagcaatctgccatcagcaacacttaagcagttatctcaatgagtctcccttttctcatctgggtaatgaaaaatgtctacccagcatacttcccaagattctctgagattggattaagtatatgaagatctctatagtgatatttaatttaaaattcttatatatattatcctttccccattgcttgtttttgtcaggtttgtcaaagatcagatagctgtagatatgcggcattatttctgagggctctgttctgttccattggtctatatctttgttttggtaccagtaccctgctgtttcagttactgtagccttgtagtatagtttgaagtcaggtagcgtgatgcctccagctttgttcttttggcttaggattgacttggcaatgcaggctcttttttggttccatatgaactttaaaatagttttttccaattctgtgaagaaagtcattggtagcttgatggggatggcattgaatctataaattaccttgggcagtatggccattttcacaatattgattcttcctacccacgagcatggaatgctcttccatttgtttgtatcctcttttatttcattgagcagtggtttgtagttctccttgaaggggtccttcacatcccttgtaagttggattccctatttaataaatggtgctgggaaaactggctagccatatgtagaaagctgaaatgggatcccttccttacaccttatacaaaaattaattcaagatggattaaagacttacatgttagacctaaaaccataaaaaccctagaagaaaacctagacgataccattcaggacatatgcatgggcaaggacttcatgtctaaaacaccaaaagcaatggcaacaaaagccaaaattgataaatgggatctaattaaactaaagagcttctgcacagcaaaagaaactaccatcagagtgaataggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacgcttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttctacactgttggtgggactgtaaactagttcaacccttatggaagtcagtgtggtgattcctcagggatctagaactagaaataccatttgacccagcaacaccattactgggtatacacccaaaggattataaatcatgctgctataaagacatgtgcacatgtatgtttattgcggcactattcacaatagcaaagacttggaaccaacccaaatgtccaacaatgatagactggattaagaaaatgtggcacacatacaccatggaatactatgcagccataaaaaatgatgagttcatgtcctttgtagggacatagatgaagctggaaaccatcattctcagcaaactatcgcaaggataaaaaaccaaataccgcatgttctcactcataggtgggaattgaacaatgagaacacatggacacaggagggtgaacatcacacaccgaggactgttgtggggtggggggagcagggagggatagcgttaggagatatacctaatgctaaatgacgagttaatgggtgcagcacaccaacacggcacatgtatacatatgtaacaaacctgcacattgtgcacacgcaccccaaaacttaaagtacaataataataaaatttaaaaaaattcttatatatattatataaattcttatgtataaaataatgcatattaactttaattaaaattattttataatattgacaattatttaaaatatatatcaccaataaaatatattgatttttaattaaaaataattaaaatttatatataaataaacaacacttatttttaaacaaacaataagtattattacataaaacttagactatattattgtaaaaataagttgtttttgtgaacatttgccttaattgtttttggagtaccatgcatcattttatgaaggcatgtttctgaaacaaccaaagttgttggttgatttttgctttaggcaataatgatcatccagaaaaaaaattctctttttcttgaatttataatttatctttaatcctgatctgtgttcccacacataagcctaagagagttcatatatagaaggaagggagttgggaaaggaaaggaagcatttattgggctcttgttttgtgtcagctgtttagtaggcattgaactaaatttcatttaattattcaaagaattcttctgatgttatagtggttttgcagatgatgaaaatgtggattgaaaggtttataaggttagcttacttagtatgcagcagagttgccatttaaactcaggtctgtctgatttctccttttcaagttaggactcaactaaacggggacaactagtgaaagtaaggcatatttcaccttcctatatgaatgtctatgcaaaatacttaatgtgcacacgttacttttcttttctacttatcatcaataaatattagattgcatcatgcatatttgtccttcagatgctaaaaataaaccatggtaggagaatttaattattaaagacagcaatcttttgataggaaaagtagaacccaaatcaaaatggattatagccataagtataaacattcacctaaaggagaaaaacaatatttattttgtttgtaaataacaatacagtggacattcaccatatatacttagatttttatacatgctacattatctggacttattttctttaaaaactttggtacaactttggaaattcattcctttatccttcattctttattcaacagctgctattgattacccactgtatacatagttccaggtgttttagatataggaataaataaagtatagtctctgtcatcaagtagtttatatttttagtaattacaaatatagaaaagtttgcttcataaggagaataaaagttatattgactataagtcatagattttcttttcaagctactcgtctgtttaaccatgatcagattaaattatgtttttatttgtcaaatgattcagtgttttgtcactttccctggaaattgagtaaaatgggtttcccacaatcattattattcatgataaatctaaaccatatttcatgatttacagtattttttgatacactaacaaaggagtcttttataatcttattatagcatagtactggctttgaaaattctctatattcaaatgccagctccaccacttattaactatgggatgtaggacaattttttagacctctgtgagttttgatttctccattgagtaattgtgatattcaaatgagtcaaatataggcaatgtctttgtttatataagtgtcttgttgattgtagttactgtattcaagttagctattataattagttgatagaattcagttcattgtttctaaaacttcttattaatctttgatttgtaagctctcattgatattagtctttattttattctgaaaaacattatctttcatgactctgatatgtaagttgtctagtcaaaagagataaagtggaaattatttaaccagcatttacagttttaaagaaatcatgtaaagtccaaagttaataagactttaaatcaaatgatttagctatatgaattattagttttgatctgctataacattatgatttatttacttggctacaccagggttttgccttgggttgcattattctcctttgtaattaagaatgtttgcactggataaaaaactgtattcaagtgctatttctgccacttactacctgtgtgtcagcaggaaaacaaaataagctgcctcaatgtcctcttctataaaaatgaaaatgaatcctattttatacgtttcatatgagaataatgacatgtttattaactgcttattacagaaattaatatagtaacataagtaaaaattattgttgttatatttgttatttaaaacatcttagtaatatcaaaggggcattcttttctttcaaatttatttatttattataaattgacatcttttaaattataaaacatagtcatgtaccacctaacaaatttcagtcaatgatggactgcatatatagcagtgacaccttaagattataatatcagatttttactgtaccttttctgttaagatgcacagatacttaccaatgtgttataattgcctacagtattcagtacagtgacatgtacaggtttgtagcccaagaacaaaaggctaaaccatacagcctaggtgtgaggtagactgtaccatctaggttagtataagtacatgctatgctgttcagcaacaacaaaattgcctaatgatgcatttctcaggatgtacccctgttgttgagtgattcataactgtatatagaagtctagatggaataaagaggaagggaaagtgtgagggaagaaagaaaaggagaaaagtctggttggaaatctttaacacaagatgaaatttcgatttgatagagtaggatgcaggcttgctttgggaggagtccatcaggagccctctccttgaaggcctcttccttcttaaagcaaacacagaaattagacaatctcaatagcatgactcacttccagaaaggtggagagtaaagcttgagacattttgacagtcttcgtggccctagaagtaggctgaatcagtatgcatcacgatgtgaagggtagcaaaaatgctttctatcttatcatgaaattattttctttgtaataacaaaggggaccacttcctccagagaaaatagacctaaccaaactctagactgaacagatgtccagaaataaattacatcccacacattgttattacatgcaccattttaaagttaagggcagtatgatgccattacatggcaactctcattttaaaaaataataaaattttgtatgtgatgtctgaaattgaaatcacagcattattcttttaccaaagaaatctcagttgacaaagttgcttattttgctgcatttttccctcatgatacagaatactgtttctcctcattttaaaacctcaattaattatcttcaaatgaaaattttcatattcaccattttaagtggttttgttgtttgagtcattcttttgcaaacaccataaaaatccctttacagtctgacatgggctatcaatcctaacaccacttctcctttcaatgtaaaatcttgttatgcctctaaagatgagtatatcccagtcttagtaataactattcctgtttcagcagaaagtaattcataataagtatcttagcattttcctcctttccttggaattgaatcattacaaatactgacaattttatttcttttctattctgaaagatgaaaaatctggttcagcatatgctccattgtacatttgagcaatctatatcctctgttcttatggttaatatgaattgcttaatcctgtgattgtttttgttttccattttcaaaggaatcctggcaaagcctatgttcatgaatttgtacaaaatgtttcagactaaggaaaatgtctctaaacaaaagctcaaaatacattggtttctaactcatatgaccccccccaaatgatattatacaatttttcaatagtctgaaatatattataagaaataattcttagcagtagttttgcaagttgctcaggatttttgcttatccattttatatttgcatgtggcattgacacaatttgctataacatctcctaggaagtaatatattttttttaggcatttactatttgagctgtgaaggttagtcttagatgttctttctcttttgtactttaaaattttttttctaattttgcacaaggtaaaaatgtttttaataccctctatgtcttagactcaccatgcaggggtgtccaagggagagagtacagtcatgggttcttagtttctgtttctggttgggccagtaaaaccccttcctcatccctccttcctgcttacaattagacacagaaaccaaaaattatggcttcaggctgctaaaagcctgaaacaaaacaaaataaaaacaacaacaacaaaataaggcaggttggacaagctcatgagcattacatatgtcacaacctttataataaataccattttattacagaatgcaacaaaataattatttgaattatgcctagtaacataattccagaaagaaatgggtttggacaattgtatatttatggatatatccattgttcccattttaagaagtgaacaattattagtgtgtttttttgaaaggcaaagccagatttgtcattaaatgagacagctaaaagaatggaagcaatacaagcagtccccaacttatgaatgagttatataacaaaattccttttaagatgttttctttccattttataagatggatatttatcgacagtggccacacaaaaaaacctgtgaaaacccacagcttatgctaaatgacaatatttttagcattggttatggtgactgtgtgagtgagagggacacaaggaaaaacatgtttctccatttttcctgatactcagttgaccctgcccaatatgtgaaaaataactaaagccagcttttcacacagccttctctctctttgtcacctttgttttcttcctgaggtaatgctgtttcccaactgatattctctagctgccttttctttaaagtggttttggtttccaattttctaacccaacttatctcttgatcaaaatgactcagtacagctggtatggggaaatgtctaagaaaaaataattgggccaaagtgtccacaccagccctgcatcttgcatcccctctgcttctcacttcccgacccccacaccacaattgttaatttaaataaacaaataacttaaggaatttctggcagtgtggggtcctggagtgatacatgtatagatagtatgggtgaagatatttggagacaggaactgggataggtgggaattcagccttaaatgcagcatcccctgcactgctcttgaagtgatacattttcttcaatactatacttaggagcctatagtttctttattttaatacatacacattttcccagtgggtcttgcaaagcttgtgatagaagatttgttaatgaggtatgtattagtctgttctcacactgctaataaagacatacccaagactgggtaatttataaaggaaagaggtttaattgactcacagttccacatagctggggaggcctcacaatcatgccagaaggtgaatgggggtcaaaggcacatcttacatggcagcaggcaagggagcacgtgcagaggaactcctttttataaaaccatcagatctcatgagacttattcactgtcacgagaacagcatgggaaagacgcccccataattcaatgacctcccattgggtctctcccacaacaggtgggaattatgggagctacaattcaagatgaaatttgggtggggacacaaccaaaccatatcaagatgtaataagctagagataactgcttcattttttctaaaatgtaaaagtaaatgtaaaatacatgattatataatattgtttacctatattttaattttaattcttttcaatacctcaaatgtaaaaccatccactcataaagtaaattttaagagttacctctatatgaaagaaatcgttatttgtgttagttataacattccttatacctggccacccaaaacaagaaaataatcaagttttcaattttcaatttttttatcataactctggatataaatataactaaaatgttttcagtaataactccatgcacaatgatcaaacaaatgctgtacttgttgtgggctggcatcaacaattatgaaagtggcttggtaaggccaggccagacctttgtaaccagttataccaggctactgttagacagccccagatagcccatccctctgcctcagggcttatggaaacagtggatgttggtaactgaacacttactccctgctgcatgcttcccatgtcatttcattcctgtgaagtgcattttcatatctatatttcataaatgaggagacagattctgaaaggcaaaccaacttgctcaaaataactagcttatatattttgagccagatgcagactaaagtctgtgtaatgctaaaacctgtgctcctagacattatgcaaactgtttcatgggcttacactgaaataatatctgatgaatttctctttgcataagagagtgagctccacaagtgtggtaggcagagcatcctcctatctcagaacctgacacagcgaaggtgctcaatgctggttgaaccaaagtgacaacttgtttatccagctctatcatagcagtaactttactaaaagttctctgttcccttactttttttcagaaaagttatccacgtccccaaacaaaacctacgtccctgtaacaaaaagcttttattttcaagagctgtatctttagccatttttttaattgtggtaaaatatatataacatcaaatttaccattttaaccatttgaaagtatacagctcagtggtattaagtacattcacactgttgtttgatcatcagcatcagccaccctcagaattttttcatcttcccaaagtgaaactccgtacatattaaacagcaactccccattccccctccctgcagcccctggccatcactattttaccttcagtcttgatgaaactgactattctaactacgtcatataagtggaattaaacagtatttttccttttgtaactaggttattttgtatattgtcaaggtttatccttattgtagcatgtgtcaaaattttcttcctaaggctgaataatattccattgtatgtatatatcacattttgtttatccatttatctgatgatttattgagtaatggagttgtccaaaatgaaatctttttgccaattctttgatggaaagataagatgcaaatatagaaatgcaatgagttcatgatttttagaacatctctctttttatatcataagccctaaaattaatcatggaaaactagttcagtttaggcaatcagcaaaaaaaaatagatgggcttaagataatttaggatttatgagttataaatatgccacattttaactactcaggctggaattagcctgtcttcatttgattatctgttttgatacattgactgttcttcagaagattcgtgaagttagggtatttaaaaattgccatttctctaaaattaaatagaataatagggaagggagcattgattctaaataagaatgcaaatttatagccatcaagttttctactactaccatttaacttctaatcagcgtattatggaatattcttgttcaagaattggtgtctgaaccttaagtcaataagaaggaaataatctatacagtttttagtattttcagcagttttccttatgtgctaaccaataattttttagctggcatttatcaatgccagagacacgctcatatacacatattatatatcctataatacacagcattatcctctaatcctcacactgaaaagtagacatcatcaccattttacaaatgaggaaggagaggatcagaaaggttaagtgactttctcagttaataactggcagagttggcatttgagaacaggacttctagatacaaggctgctgctctgtcacctcacacttcccctacatgttgtgaatggtgctgggccacaaaaatgaatgggacagtctccaccctggaaaaatttatattatactggaatggatgggcatttttaactaattaaaatataatagtatgaagattagaagttctttggatgccagcaggtagacatagcttaacagtgcctgaaaagctttgcaaaggaaagggcattccatcttggccttacatgacttccttccatgctggttttccattttaattagtaaagaatttagttaagcacatgggatgattggttaaagttgaagctgtaatgagatcatgaaggttaaattaaagtgtttgaagtttatctcttagcagtggaaaacaaatgtttttatgttttcattcttgctacttttttctgcttaatctaccattctgtagaagccttagtaatagaacaagcgaaggagaagaaaaagataatttttttaaaaaagaatccttttatgagcttatgctagcttattttaatgttcttgcattataggcatgattaaagattttaagtgtatgactttgcattttgatcagagttatcatctccctcaaggctgctcaataacatgatccataatgacattttgttgttattttctgacctgttgggtgaggcactaaagccagcttccctaggtctatgtagctttaagttattgcagtgaggaaatttcacagtgctgtcatgcttttggttaatacagttttgtgttttgcttgggaaagacaattctgagagtgtcctattgattcagatgttttctgacagtagctgcctaccaggtttgccttcattgacttttcaatgttctgttacaaataacttgcatgtacaatttgatattgaaaagcctagaaggttccccactgtgcatgaagttagagcagccctgagccatggggtggtgagtgcttattatcattctgaaaatcatccacttgtcctaggctgttgccataaaagggttgtgttttctctgttattcttttttgttctcctgcttcttttattctttcagacattccaatgcacttcttattctttaaaagtttaaacttcattcttaaaaattccccatggtgactgaaacttgaaatataaagtcacaggtgttttctgatatttttgaacacacggaatgtgagatggcttggattggaagtacttattttgttagtacaatttaaaagaatcacttctgtgagattttcctaaaatgatgaatggttagaaatgttcttttataatcataataaaaataactaccatttatcgaatgcctaccatctgccaagatctgtgcttagcaactttcatgctatctataatattgacaactctgtaaggtaggtatcattaaaccatttacagataaagaaacaaagactctgagaagttaagtgacttgtccaagacaagaatgattacttctatctttctaattgtggttgacttctacttattaaaaatgatggtaatatcatttgggtttgcagagcacgtcacggtttacatagcagtttcacatatgccacctcctttaacctcacaaaactgataactatattttgcatttcaccttaatctttgtgagaccatcttgaggctttagatcagaaatggggtatgaatttccttgtgctgaaatatgaccctttgttaagttagcatcatttgcaaaaatgtcttcttttctaccattactagtttatgcttctattttatcaggggagaaggcagctggagaacttgtctgttgatgcccttgaagagtttgtgggattatgtttacccagaaaatagttgcctgtagcaaaagcataataatgtttttgagacccagctgctctgcccctgaaaactatgtaggaaatacttacatagctgctatttcctgctctctcctcccaggatcccagcccgtggcatctctgcctttcaaagacattccactgtgcagtctgtccctatgtctgcttgtaaaccaaagcataatgttcatttacacataagtggaggagggggaaggagaaccttatagaattacaaataagataatattataatgggtaataagtacatttctgccttatcaccagtatttccaaaacccaatggcatcaaattctctgaaataatttagggctctgaaatgggaattgggtaaagaaaataagtaaaaaagttgttggattcaatagggaaaaataataaaacaaatacagtaacaggtacactaccctcctctatcccccttgggaacaccaaagcaaacccactcacccttccaaaaagtatcatttctttcaaatatcagagctttgacccaggagtctgacctcacttttcctgacctaactcctcctaggcgagattggtttctccctctcttctgtattctcaaagcacctaggacatgcctctgcttcagtatccatcttctctactggacatgagcaaaatgagccccctccttatccctaccattccggagaacagtccatcacttggagcataaagcttagtgcacaagtagatgaatctattcagccatgcaacagtaccagaccttctgttagtgctgtgtgctacactcagagaatgtttaaagaaatgaggaatgaagaaagggagtgaagaagacagggaatgtaggaatgagagagacagggaagaaaagactgaaggagaaaggaaagagggagtaaggaaggaaggaaagaagaaagcctggcccaagatgtgaataagagtgtaatgatttcacttatcacatagtatttcacataatatctattgtttactttcagcaaagaaatttattttgagaatatgaatatttcagaggaataattcacagtggagatggggtagatagttttgtagaagactagaaatcagtttctaaatgtttctctttccactaatttcaaagtctatttttcttattactaaaatatttccacttttatatatgtgaagataaaacttttgcttactccttagctaatgaattttataaacaaactcttttatatgtttttataatataatatgtgaaatgagaagactaagggattttacctaccacctacatattaccatattaagatattcctgaataaagtaaaccccaccataaatgtgtgtgtgttggggggtatgatttttctttttggtctatgaaacagattatgctaatttacaccagcacttccaataacaactaactattctgcaccccaaacacacacacacacacatacacacacaacacaccccatctactcttctctctcctgctccagtactctgtagcattagtttagtttctcttattccctcagccccactctttagacaaaaaaatagagagaaagaaagaaagaaagaaagaaagaaagaaagaaagaaagaaagaaagaaagaaagaaagaaagaaagaaaaggaaacctttccttctcatttctagggctctaagggtttgcacgctgccactctaccattcttcacacattccaattagaaacttaagggaggccagcgtagtggcttgtgcctgtgatcccagcactttgggaggctgaggtgggtgaatcgcttcagcccaggagtttgagatcagcctgggcaacatggtgaaaacccgtcttcacaaaaataaaaacaaacaacaacaaaaatagccggcattatagcacacacctgtagtcccagatactagggaagctgaagtgggagggtcgcttgagtccgggaggtgaaggatataggctgcagtgagcctttagtgtgccactgcattccagcctgggcgactgagcgagactctgtcccaaaagagaggagtggaggggaggggaggagaggggcacaaaggtgccatgcatatcagaggatgctttcttgtctgcttatctcaaatctggccatacatttgaatatcaaataaagctgatattctcattttcttcctctctactgaaaaataatctatcccagtaacaacagttagcagtcactgcaggcaagatgataaagaggaaaataaaaaaatcttgaggaaaaaaaaagtcaaggatgattttgaatatttattatattatcttgaaacccatcataatcacttcacaaattcttaatgaaatctgaccaaaatgtgctcccactatttgttgagatctataggaaagtcaaaatgatacaatttctcattttatcattattttttgtgcacttatgcgcacagaagatactgtgtgaattggtttgaagttttccttcttttcactatcttatagcttaattggtaatgagcagcaaattttaaaagattaaaaattacgggggggaagggaagaggaaagttagtgccctagatagagtgaaaaaaattacaaaagaacaaagtaattattcacaagatgggaaaaagatataaatgaattgaattatgagtcagacagaaaagaccacacacatatatacccacatgcatgaacatacacaaacacaaatacacatgcacacacaaaaagacatgcacacacagtctacactacacacatatcatccacccacacaaatgcagagaccacacatttgacacatgctcacaaacacacttatccaaacatggcaaaattatgctcccaatttaattagcaaagaatacattttaccagaagcagggtaaacaccacataggatagtagcatatatcagagtagcttcccttgatccccagagtccttgtgggggctcacagctgcctatgaactggacatataagcaaacctataaacctgaattctttctgcaacaccgaacttttataagccagaggtacaggatgacttcagaaaatcttaaacttacaatttttatgcctctgattaacattaagcatcacatctcttggtttgaaaaaaaaaattaaaaaaaaaaacaactcagtgacatggaggccatatcatcatctggggagagagagcagagtcagtgagcagaagctatgagcaaaatggcattaccttgcagtaaatattgtgaattatacttaatctaatattcaatttacaaatggggataattaataattagtgcctaattagaaataaatgaaataatattggtaacatagctaatacaatgcctggcacatcaaagatgcttaaaaaaacagaaatggggaaaggtgagacagattttcacttccttgttataactgatgattatccagttgcttttggtctagttggttccccttgcataatccattagcttaaactaattgcattttccaacttgatctccatttagtgtcctaacatgtattaatatgggctactgaatctgcattcatatgtctctgagacctgaataaaaccttaaaattttcagggataggttggaaatacacattacatgaatgttactatacattgccttgatgcagtgttactataattgcctccacgcagtgtgctttgggatcatagatcaaaatgatgggaaaaccttcctgccacaacaagccagttggcttgtcccactgtgagattctcccccagcttacaaaatagacatgctttttcaaaagtgtttcttttaatttgttgaaatgtcaagaagagcctaatgttatagattttggtgaaaggtagttttcccttatcaaaatcatatagctcatacctatctatttttttcaaatgtccattgtacaaaaatacagtctttatgggtatttaactcctacagttgactttaagttctgctctctatattgagcagaaaaatagtcatggaactgtggaattggaatttgaaggtatgtatatcaatgccatttaaatattaaaagtagtaggaaactatatctatataaatatagtcattttctagagtcagttagtttcaagaggcttttctttttttaacatttaagatgctttacttggagttccttagagaaaaatttcttcaaatgctaagataatataaaaaccatagctttccaaaaacttttacattaactttgaaacaagtaactaatgcaagtgaggccaagcaattagtttgtaaggagaccttgtaatgcagaggtgtaggggattccaggtaaaacatcaataccaactgtacttttttgctgtgtggtgtagaaaggcagatgagagaagtcgggatatggacacaggtcctggactttaaagattcacttaaatttccccacttctttatcctggcatacatcctcccctaggatcaagctgccatgggctagaaataaagactcagaatatatttgttcaagaccaacagatcaagtagaaattgttgtagaacatatatgtgctgctgcgtttcagggttgaatataatcatttggcaatatcacctctacatttttatttccacgaagacacacccatgagacaagccttaaagaaggtgacagcaatagatattatttccagagctcctaccatgctttggattacaatcttatcaatttgggttgaagttgcaaaaaattcaggccaaaaatgaactttgagtagtttatgaaacccaaacacacttgtcaaacctaaccatgcaaaacagcacaaattaagtcaactttcaatctggttttgtgccaaatggaatgaagcctctggtgggctagacagctctatttcctgctttcaattttggagattccaattagtaaattaaactttaaaaagctgtctaaaataattaattaggtcataattattcagaagcatattttatagtgtactctaatctagtgtctagtctaaatacttgaaaacggtatcaatttcattattaaagaattaattataattgggcctaatcctttgctgatgaacgttgaaaaaatactctggggataaactgttcacatatgcgaagtggataaattctttcagagctcaagaataatagttatgctctggaagtgttttctgcttatattaattcctttgttaaaattcttacagatatcacccaacaaataaaagtttcataggaaaaagagccctctgtttaaatgagtttatcacatatggacaactgattttcctcctactctattccaaacattttccataatcagtacattggtacagaaaagagaaaagaaacagggagaagtaacctgccgggcatggtagctcatgcctgtaatcccagcactttgggaggccgagccaggagaattgtttgaactcaggagttcatgagcagcctggacaacatcatgagatccatgtgggaaaaattttgatatttctttaacttccttctcatttcttcctaatgtccttttatgatctagcaaatcaaatttaaaaactcaacatatcataaataatgataccagagatcagtatagcttacctgtttccatctatgtcagagagaagaaataaatatagaccatttcaatactcttcctgcatatacaggccaaatagaattataaagccaaagctctagagttcaataaaggaaaggcagttaatgattatagttttatgggtaaattgttgtagtgaattaatgtgtttttcagaagagagagaacaggaatggcaggtgttcatctataaatggtgatgaacaatgtgaaaccaagaccacaggtaatatttctggtaaggatttcacaagagtgtaaaccacagcagctaaaaacaaaacttaaatccataagtagacaagttaatcagaaacatattttatgcactgtttcttctataattttaggcttcacaaaatacattacatacataactaaggccataatgctgacttaagctcttatttaaatgtatttgttgaaaatattcacagactttttcagaacatatgttctttttatatttgtctatacatgtttctattttttttcaattgtgtttggatgttgagactctaagtgatttttctattttatttatggatattataatattaattttaatactaattcaaaattttaaaaatataaaaaggaatctaaaaatccctgtaatgtagaaagatggctactaactatgacttacatgtgacttgacattgatagaaaaatactcgtgtgtttacaaatgaacacataataagtatgaaataaggatatagtcagatgttaaaatccctttctggatctcagtcctcttggcaaacataactgttgtgttactctttttattttaatgggagtaaagtgtttgggtgaaagaataatttttacttttatgtttccaaaaatacaaatactgctgttttgagatgcaaaatggaaaaattgaatagaatagaattaagtctcattgtccaacagaatcaataaataataaatgagaaaaataaagagatgctcaaatataaccttgaacataatgctttgcagggttataagagtgttcaaatgcctttcattttcatcctttcaaatttttcaaaagctaattaaggtgtcataggtaaataataatgcttctattataaccaaagcctattctttgaaggcggtttatcaagcatttctgctagtttatataaccgtagtggatctaccaatacacccaatgagtggcatacaaactgatcaagatagacccaggaatctagatacatgtccatcagtgtgagaatagcatttgccaagtcaacatttttgcctccaaaatgctttatagacctcaagaaattctaacaacactcttgagagaacatttgctcttattaacaatttctagtgagaaattaatggctaattaatttgcccaaggacaaagaaagtcagattatggttttcaggctcatttttttttagtctaattgattattagcgttgcattatctctttttttaaccttgaaggtctttttgttttcttaaaaatgcagcattctttgctattgtgaatccatgttgtggctatacttgtatttgaggttacacttctattctaagttcctatttccaacaccaattttttaggcgtttttctcttcttttttttctttttctaaagttttactttattctgcaaagctaaactagaaagatgtactaaagattgtttggcactgggtacacttgaacataaacacgggaacaacagatactggggattactgaagaggaaagacagcgacaggggcaaggctgaacaactacctattgggtactatgcttactacctgagtgacagatcatttattctcgaaacctcaatatcatgcagtatacttttgtaacaaacctgcatgggtgccctctgaatctgaaataaaagttgaaaggaaaaaaaagaaagaaaattgtttggttttgtttcaattagccaaaatttgagataagtaatagctgcaagtagtaaaaaatagtctacgctgtgtgtacataagagtagataactcaaacctcggttcccctctaaacacaaactctaaataaaggaagagggttctgcccttcaaaagtgaagatatatagacaaaagaaacaaatatcttgaaatgctgagcctcatccttttcaaaaaatacttaaataactagaaaaacaaaataaaaatagaattcagggtgtgtgtttgagagcaacagatccttcttcagtatattattggctggaagtgtacagaaatctttgtaaattttatttaaaaataatttattggctaattcaagattttatttactactttctatgccagacactattatgagttctgaagttacaataacaaatgatatggactttgtccttaaaaagctcacagtctaagagagtgggggaacccaaatataataaatctgtgctaaaagagtacaaggaaagaagtaattattaatacttctgtggacaataaacactactatagatcagaaaactgtatcccaaagcctaaatgtggttaaatgcctactatatttgtttgctaccataacaaaccaccaatttgcataacctcaacaaaagaaatttattctctcacagttctgaagactagaaatccaaactcaagatgtcagtcaggcagtgcttcctctgaactcctttagggaaggctccttccttgcttcttccagcttctggtagccccaggcacttcttaactgtggcaacataactctaattgctgcctctgtcttcacatggctgtcttccctcattgtctttgtctcttctgttcatttaagaacaccagttatgttggacttaaggcctaccctactcaagaatgacttcaccttaattacatctgcaaagaccctatttccacataaagtcatattcatagataccggggattaggacttcaacatatctttttaagaggcacaattcaacacaaaacacttactcagctaggtgctcattaaaacactggatttctgccattctgaatttaaaaggtaatgatttaattaaaacatcagagaataaaatgacatattgttttacagtttacagttctatatataggcatatatatacacagctgtcattatttcattgttatctgtagaatttcttattctgtctttaaatataaaaaggattatcttctatgaacaataaaaaagataaactaaatttaattaccaattaaagatggggtaaaaaagagcaacaacactctaaaacagaataatcatggatattgtgtaacctctctctttcgtagtttgttcatactgggagactaatgaaatagaatgataaaatcttgtccagagatgaggaggagtattaaatgacatcctgttcatttaatgtgaatataataaacttcaaagtcaaaaatgtgactataataaagtttgaaatttttgaaaatatgacacataagcataaatacgtacataagattaacacattttatctataagttatttaaatttatatacatatccaacctgaaaattgtttaatatttgagttttttatagtgtctaagaatgcgtaaatggtatgcaaaaatattttcaattttttgcttaccatagttgaatgttacaaacttactgtatccagcaaattccaaactatatgctagaacttgcagagaaaacaaaatgttttccatgacagcaagagactctatttaatcattatattaagagatttaaacaagatgagaattaaggatgggatggatattccagagaaatggaacgattaattcattcaatttatatatgttgagtttctgctctataccaggcaccggtcaaggtattgggaacacagcaatgaacacaatgttccaagtctctgccctcaaataggttaacctcaagtagcttaaattctaggtgaaggagtaaggggaaggaagggaaacgggatgaataatagataaacaacaaataaatttttagtacaagtatgttccatgaaatatttgggacacttaaataattaaacaatgaataagttgtcagaataggtaatgacaaggacaagtaataatatttttcatatgtctgatgcaatagttagaacataattattcttttttttaaaaaaagacaaggtctcactctgttgccatgctggggtgtagtggtgccataatagctcactgcagccttgaactcctagactcaagccatcttcccacctcagcctccctagtagctgggactatgggtgcatgccaccatgcctggataggatataattaactaaaaagttttttgttgcttgtctgaagttcaaatttaactgggtgccctgtattttcatttgctccatcaaaccatcttaacaggaggagatagcaaataaaggcatttttaaaagtagtatgttatatggtgataaatgctttggagaaaataaggcaaggttaggcgaattcggaatgttgtgaggagtggggaatccctactccatacatcagcgggatgacctctccaataatgaagcatttcagcagatacttgaagaaagtgagcatgtggtccaagccaccggagtcttcctggcttggctagaaggacagcaggtgaaaatccctgaggcagaagaatggtaggtctctccagaaacagagagtccagtgaactggagtagagggaggaaggagaaaagcaaatttttgcttacccttgcagtatttgttgttggccagaattacttcttcgacattaatcaaaacatgaccttcagctgtatgtatctgctcacctctgtctacctgactctctttttctgtctctccctttatctctgcctctcagcacaggcacctatctgtcttcatatatagcttacttataaaccaaacacaaagcaatgtctgctgcaagaaaaaataatgagcaacttaattcaggccttatttaccctcacgttgtcaattttgatcatttgcttatttaactaaattgttctgctttcattccagtcattagcttccatatataaaaaataatgtgctcacattccataagtatgttagatattcacacattttgcattttgcaatagagaccaagactctggagtgtttttatttaatgaaacctctaatcagatcctgtggatttactagtaattaatctttaaaataacaccatatacaggactttaataccccaatatgttaatctcatcttttgttttgaaaatcgtcctctatttaacattctatcacactgtatgctgcctcactcctgcagccctcatctccacacagctgtggtctacatggccccaacatgtgtattcagtactgccctgccaattgtaaatgagaggtttaaaaggctccagatccaagtgacacatgcagcatttgtgttgaggttctgcctccatctttgtgcctaaatctctaactgtgtagcttcccacaactagtctctagaagcctggaactccacctttatcctctcattaagtcttttaaaaatctacttgttctctgatttctagcccagttgctgatagaatttcacctgctgataaaattttctgaataaaatgtcagaatatgaatcatccttcattcttgagttttgcttacttatgaactgcgacatcctatgtcagcctctcagactcctattcttgactttcccctcgacctgtaccctgctattatcatgcttcttgacacaggccaaggtttgcctgatagactaaatttctctgagcatcagctgatgctcttgggcttcattcaagcccaattctgaatgtgattccagattttattatccctgtcttccctctttggatttggcagggctgagacacttagggataaggtaagttctgccctcttctcaataatgggattggttggatattgctttttacttcttgttttccatgcagtaggaatataaccaaaaaatactatgtacttcactgtgaagtcctgaaacaaaaatatcatcgtaaataccctggatctcaaggatctctaattagatgtaccatacacatattgtataacacttccagaaccagggattagaagaacaagccctatatttgcagaaatgcgaaccttaactaatatatgtctaatctctttaattttacatactgatgcaaaagagatactaggagttcccccatcagttcgttcaatctcttgcttcttgggcaaaatcttcaaggctcttgaatttcatagtgaatttctctttttggtctgtgggcctactctccatctttgttacttctcttttgaggctttcaccttatactcactacaacttctctctctctctctcttttttgtgctaatccaaatagactttttggccttgccctagcagacatttagattttccttcccagcaagtgtctgtctctaaagcttgatgaatagttgccaaagaacactttcctgatataaggaaatagagccatgtttggttgggctttaagatgaaacacagaatcgtctttttcactgtggtgaagtacatctgatgctttaacatttatattctagatctaacatttagactatcagttgtgtgaccttaatccccaagtcttggtttccttatttgtaaaataagaatatcggctatttgatcttgaaggtcacctacacctctgcagtttgtgatacaactattcatcacatttagcagatgcccttctctttagaaaaatctcaagcctatagaatcggatacaatttaaacgatccccagcataattttgccctctcaggatttctatcttcatagtcatacacagatttttttgaaaaccccaagaaaagaaaaccatgcaaattagaagtgaatatatattagatgattataaatcacaaattatatcaaccttgtagggaagaaaagatttcttttctaacccatagctaggtttgtagctgaggcctttataacaaaagtcattaacaagagaaaagcacacagattttttaataaaaattttatgacatgtcataaaattacattacagaacacaggaaccttcagaagtgaagagcaaaggaacggggaaacctatgacctttttgctaagtttgatgaagaagtggatagttgtggagaagtatgatgtgatctaatggaacaagctgggggaatttaggagggcctatttgttcagattctcctctgtgtccctgttccttcagagataaggatgtttcttttctctgggtatagcgaggcacctctagaatgagggttttatgacctgcttcaggggagaaaaatcaaaggaaggtgaccgtgaccttcttgcttctgttgtttcctcaaatgccaagatacattattttgtggtagcgtgttctgaactccatatttaaaaaatagaatgttaccaaaattttctaaaaagaaataatatactattttatatgttgttactctcatactttctatccattctttactgttttatttgtaggtgaatacataaaaagtttcagaattttctaaattaaccaaatcaggtgaaatgcaattgtgacccctggtcctctgtttttgcttttcatagtagatattataaatataaaacattcagtgcgagcatatttataagaatataaattgttgaggcagggtgcggtggctcacacctgtaattccagcattttgggaggccgaggcaggcagggatcacgaggtttttgggaggattttgggatcacgaggtcaggagatcgaggccatcctggccaacgtggtgaaaccccctgtctactaaaaatacaaaaattggctgggcatggtggcacgcatctatagtcccagctatgcgagaggctgaggcagtgggcttgtcattgcagacttccatgcctagatttcactagtatttacagagatgttttttagcctgtcttccttcctacccctaaccccaactcttctctggattttccacttgctggatctactgtgtcaattactgagccagtcttgacaaagttcaggtgttttagtgcaggctgcatctcagcatgcctttattcccttgtcccagctgttgcattaaccaccatgaattttctactttggtctgctgctgccctgagctctcttggataaagccttattcctgcttggtttctgtcagccccacctctagagaatgagaagctatttattcctacaacattgctatattccttccagaaatgggctactttgcccagatacaaagcactgccatccacctaattctgatattaaacatactgcttattcttccatgatacagtgcattcacactattgtattcaatgctcacagtaaccacacagagatctaccatttgacactggataggaccaagggaaggtacactttctagtttccagtttcttgcccatttcctttccattgtctcttgttgatgaaatggctctctggcccattctgaccgatccaaatagtgagggaaattaggtggttatttgggtaagttatcatgttcttgggcaattaatgggaaaggaattgaggcaaattatgaatattcttcttttaaaataaagtgatattaagcaatgtattgaagggtcaactgtgcagtatttgcaagaaataaatgacaattaattaaagacataaattttgacaagagcattacatactttctgcttttcaatgtgttgttgcttttcctacaaattgttagctgaagggaactatgaaaagctgattaaaaataatgtcacataaaaataagcattgggccattcagtattatcatgtctatcttgctggccctattagaaataccatgccctttttaaaaaattgtatgctttttttttctggtttgataaatttttacatttaaattttaaatcattaaaaagtactactcacatttttttctgatatgttttctgaaatatttttgcattagtttttatgttagtaggtacagaggcaattttgtaaaactacatttaagaatacatttttggtgtttaaaacttgttttttatgaaatggttttttttctctaaaatttcaataagcttcactagaactataaaattaaggttgcctttttccctttactcactggtcattgtccagttgtaatttatcctactgactatcacttgagagccagagcaatgttggggaagaagcaagttgactttagacttagagttgggagctgagcgtgccttctcccctcaccttcactctgttcttggatctcaccctcttcagcccccaaattttctcatctctaaatagttaagaatatcagtgtcttctctagcagaggtcatttttagggcttttataatagccaatatatataaagcacttagtttagtgcctgacatacagtaggagcttaataaaataattacttaataaaacaacataattacctatctctgaaggaattaacctttttatattttccattattttttttctaatactaacaacctccttgtttttttcttcaacttttaaaattctggggttcatgtgcaggatgtacaggtttgttacataggtaaacctgtgtatggtggtttgctgcacagaccaacccatcacctaggtattatgcctggcctccattagctattcttcctgatgctctccctccctcaacctacccacccccaaaaggccccagtgtgtgttgttccctccatgtgtccatatgaaaaaactgccttttaagagaagaatacatcagtttgtgtatacacacacacagaaagaaacgggagcgttatttcctggtttagagtttcaagaaggttttatacatactgtttgcccctggatgcaaatggatacttatgatgtatggtgtgacttcatggagagtccattgtactcaatggtaagtgataaatatattcagctatattaagaggaagaatttaaaaggcacattaatttaaaagaatgcatgagatccacctaaaaattctgttctgacaggggactaatttaggctacaaccctgaatccccagtatgtttagcgcttgtgatgtttggaataccctataactaaagaatgaatagaaaatatttaacttgcaatcatggtaaaatataagtctaataaactattgtcacaagttggcaaaactattgtcacaagttggcaagaacatgagaacgatttcaactgactttcacctctccctacacagagattaatacagtaataattttactttgatgtataatccatattaaaaatacactgagtgatttaaatggttcctatgctatatgaagcattaggtatatcaaaagcccctgaatccaagatgtaaaagccttggaactttataagaagattgacatgtatttgtgagattatttttgtagaatgtaaaataggaaattttatctagctaaatttaaatccccactaatacagattatcatctcatttaaattatgatatatatgttgttatttaaattaattacctagatattttatacatagatatatcaaataaaattaatgtatcaaagtatgatagtagaaatgacattttcagatatttgaattcctttattttttctttcattgtagcaatgttctatatcaaccacagaacctttgaaacatgcacgttatgttatgaacatataaataaataattttattcatttgaaaggccacaataatttcaaagaactatttgcagttgacattgaccaaaataaaatacactgaagtgataaaacagattttagatcttaaagttgtagtggctgttaacattgaatagatccataaacatgaaaaatgggccatctgtcctttgtgctgactcaaggataatactttaaaaataagatcagtacttttacatagctgctgattgttatggataacaatcttaaattcaaatttaagattgaatttaatcttaattcaatcttaattaatttaaggagaatcttaaattcaaagtacaatattttctattattcgccagtgagtcattgttaccaaagtaaaaccttcacttcttcaatagcaaactttctgctctttcaatgagattaagcatttgactaatcctcattttatgtttaatattaacttattggtcctataggaaaacagcctgaggatttagtatatagacatttatccaatgatataaaatctgtgtatttggacaagaaagaaagaattatgcaaattacttatttctttttatattatatcagacatctgcatatttgggacatctggatatttgacaaccacgaacctcaatatgattaactgagcatttcattttttatctaaatgatttggcaccaggcaaaacagatttaatgattattaattaaccttcaggtccaaggagagttagagaaagttctgctataaaatataagaaaagccattcactacactaaaattattgtccctaaatctgaatctgaaaggaatcacaatggattttggtggatatacatataaatacattttcttcaatctttaagacaaaaaaaaatcacaaaaagatggtggggttgaatatataggttttataggctaaatatcacaagcaaaaattgatgagaatgtactggctccaatataaattagcagcaattacaccagacaatttttagactctattatcttaaaggcattcagatcttaccaagtccacaagccatctacttggatataacagctcccgagaggctgcctagcagccacaaggatgctgtagactaactaggttagtaccttccactttcaatacttcgtcaaaacagtttaagatgacagatgggacaaggaatttaggaatcctgtaatggatgtgagattggagagtgtctacagccaagacatgggtttatgataaaagcagattaaagaggatactattgtgactagatgggggatttaggtcatgctgtaaaactcttcagatggtatagagctatatgttaggtcagtgcagaggctgagggtggtgggaatgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatctataaagaaaagaaaaaagcaaattactacatttttacctccacagtggaatctgagacactgttatgtcacacaaattcacttttttttttttttttgacagaatctcactctatcacccaggctggagtgcagtggcatgatcttggctcactacaacctctgtctcctggttaatctgattctcctgcctcagcctcccaagtagctggggttatatgcacctgccaccatacccagctaatttttttattttttagtggagacgggtttcatcatgttggccagtctagtctcaaactcctgctctcaggcaatcagcccaccttggcctcccaaagtgctgggcttacgggtgtgagccacggtgcccagcccaagttcactttttctacaagtgacatgtgaggcctattctgtatctagtcattcgtcctcatttctctctgtattccacagtttcttcttcctatcaaatttaaaattaacaatttgtttctctgatggagcatattctctgtcaattcaagtacttctgctctgctttccccaggagcttctaagagcacaagtgactgctttaccattgaattcatctcactgtaaaggagtatttgtcacaataagcctcttattttcaaacctgaaataaatacaaaaatatatagaaaaaatagaaaattatttttctacaaaatagaagtagtacatacattgacattaaaactttttcctactgaaactattgtggccaagatgaataatgtagtaagctggacctcaaatgcccatctattgaaaggcttgtgtgaattcaacacagattttggaaggaattttgaccttttatagatgctttcttagagaggaagttatatagccttttttcagagttttgtcattttttaatcttttattatttttaaaaatgtttgtgggttggtgtcctttgtcttcttttctgtatgtttccacaaaggcttagagacccatctcccactcaacagtctgcaagaagtagcttcaataaacatcacaggatagcaactttccagggagaataagaaaatctaatcattcatttattagttcatttaccataaatttttgtgcacctactatatcccaggaagtaccctaagcacaagtatgttagctctgaacagacatgatccctatcctcaggaaactggtacaacagagcagaagtcagacaataaatgaataagaaaataatatatacataaacatataccttataatatgtgttacgaagaaaataagttgagcagtgatggaaaatagctatcagagaattatgggaagaggatggcttgaatatatccctgaacccttgctgcttgctgtatctgagccaatcagctgctaaggcctcctgccctgctgaactattgaaagaaagagctaaggcaagaatttttacttcatgagccaaggaagaggcagggaccagttaggggaggtccaaggtgaggccccagtgcatgtgttagattctgagaaaagcctggcctgaggggtatatgagctaaacctgcctgtgagaatggtccttgccaggtgaacacgtcttctcaggctttgagtagcttccaggtaaaggaaaaattttttaatgaaaaaacaaaaataaaataagcaataaaagaaatgattgtcaaagataactccaagaggattaaaagaaacaaacagacacaaatgaaaaaaaaggtaaaaaacatgaaagaacaagtcaagactaagaaaatatatttaaaaaacaaataaataatccagaagaaaaataggtaaaagataacatcagatatttcattgaggaaaaaattataatgtcaataaatatatcaaacgttaaagctcactagcaacttctgaaatattaataaaggaggttgattgaaattaattaatttttaaaaaccaaggtactagtgaagatgtgaaaagataagacttatatacattactgactgaagtataaattagtaccactgcaaaggagagtatcttcaaaacacctggtgaatttgaacaggcttatgagctatgactcagcagttttagtagatgaatcccctagagtagctcccacacatttccataaggagttatgggccaggatgctcaggtcagctccctttgtaaaggtgaaacatagcaacaacataattatttttagtaagaaaacagataaatagtattggctgaaaaatactatactagccatatgatttttaaaaagcaaattgctaaaaataagagtattaaagtatttaaagttgtaaaacgtatattaatgtaaaaaatgcatttatatacaatctttaagtctagaaaatagcattacatatattgtttatatagatatccatattttatgaaatataaaattatgtggagatgtaatatacaccaacttcagcaaaatgattgcatttgagaaggaagggagggcaaaataatagaagaagctttagctgatatctaatatttgattcttggagagagagaacactgatgcaaagatgtcaacacgaacatctttgtgttcatggaagtggacatcctttgtaatattatttttgtatttcataaaatcaaaatcacaatggaagattcacaaatgagcatatctcctaacaagaactaaaacagcagtttgtcaaggagagaggcaggttgagggtgtcctatgtcacagaagtgcatatgtatagagtagctgttggtgtgctttgagatcaggtgtggagcagttcagatgtaactatttaccagatgtgaattttttaaaagagttatttctccttttaaagattcattattttcattaataaagtggaatctacttcacagtactgtgatgcaatgtactaatattgcctatataaaacaattgtcactatgcctagaataaatattccataaatgttgatggacacatagtttattcattcatctagatattattaaaatttcaggaataaaaacataattagcataaagatattatgagggtaaatggtactttaatagtgagaattagttgaacatacactagtctccaactaccttacataattaacctgataccctccaaataaccatgcagtggtgactccatcattctatgtaaggagaccgagactccaagaggctcagtgctttgcctaaatctgaggtccagattaaagtccatatctgactgctgcactctttcacttttagtgatattcacactggacttgcagaggatatgacagcttaaaaacatttgagaaccataattctacactacatgctctttatgaatactagtagatgttttctaaggttcagaggaaggcctgtacaattggccaatctataactttgataccagtgtaatatatcaattatatactacaagtaaaattttaaaaagaacaaaattgtttaaccttaagcttatgatttaatttttttgatgtgtattatagaatttgatatagataaagtagttaatcagatgtataaagaaaataatacaggttgagtatcctgtagccaaaatgcttgggaccagaagtgttttgaattttttgatttttttcaaactttggaatatttgatatacataaagggatatcttgggtttgggacccaaatctaaacacaagattcatttatatttcatagagtacttatacacatgacctgaagataattttatacaatattttttaaaatttttgtatgaagcaaagtttgtgtatgttgaactatcagaaagcagaggtgtcactgtctcagccacctatgtggacaacctgtagttgtttggcatcaccatcattcctgactctgaatttatatgctaatgataagcaatcattttcttgcagttactcacacataagtattagcagtaagaaatatgacataccattactacagtgaaaaattaatgtggcagaggtggaattttccacttgtggcgtcatgtctgtgctcaaacagtttcaagttttgaagcatttcagattttggatttttgtgttagtgatgctcagcctatacaaaaatgactcttatgcttgaaaatcttagtccgtctcttctggtttttaagtcatccaggaagtttatatgtggtggaaaatgcaactggccatgtcccagggcagacacctcctccagtgctcacagtggaggccactgaagtgttatgaccatgttctgtcagtgatgtgtacctttctttgggctcacaatggcatagaaagatgtaaccaaagtctagggaattgggtcctaattagagaactgccagtaaccaggagtaggaccataacacctgggactctgagcttcacctctccaggctccagtttcctcatctatgtaaatgaaaacattgaacaagaacaatacagcagttatcaggtctgttttgactcctacagtcctttattcacttgaaattttaagcaaatgttaaatatgtaaacctgagcctgagatgggactttgagtactctccccaaatcctcagagacatttcaagaagcactttggaacaactcagagaaatctttgtaaaaattagtggacaagatgaactctaagattaaattaattaaggagaaaattgagggtcccataatatgatcaccaggtttgaatcccagatcttccagttactagtcagtctgaatattgactaaattacttaactactctacaagcagtttactaaccttacaggattattgtgaatattaattaagataattcatgtgaagcacttagaaaagaatctagaacataaagaagaaatcaataaagtgatctgtgatcaatttaccatcaccatcatcatcatcatcattgttatataaatgtgatcaaatacatgagaaaaacctaacacttgtctggcacaagggagctgtgtataggtatatgtgtgtgtgtgagcctgtgactaattttttagcctccgtcatttttcctactttcctgtcaagatatctactctctatcaggcactagaaatataaaatgtgattagtttagattaaaagatactgaggaatgaagtaccaatctcagaacacggtgacgaaaaatattttctgcagattaaaatgaatattgaactaatagcatttttgttagaaactttctttcatccccagaagtttagtattcccttttctggacattttagtggttgaatcattcctggcttcgcaggatgtgaaatgttcattaaaagaagcatcatggttactgccttgtaaagatgatcctaacagcttagttctttgtgaactatttgtgtgttggcttgccgtgactttgcacaagttagccactgaagcagaaaaatcactgccggggttgtcaaatatcattggtgcaaggtgcctttctgtgtgcctggctgagcagcttccaatgacatgtgatgtggggttttctcccaaggctgttgcgtgctgtgtgcagcatatctaagctgaaaaactaatgcatggccgggtattcttggtaggcctccaggcatttcacattcatttataaaatgccttttttctacttcaaattaatcttatgttctttccaatcaccattgtaatactcttttgactttatattctgacaagcttgaaatagcctgataggattgaactaaagtataaaaaaccagagttacaacagtcagaaacaaatgaaaaactgaaaccgagtctgcagcgttaccttcacagctgtgttagtacacaattcgggccttttctagctttatgattctaaaatatgtctttgttttgaattaagttgctggcattatgtttgcagagcagttaatccatctccaaaatttgtaatagtcatggttattctgtgactttcattgcaaatggaacttcagtgtcaggtttatgggacagctattaaaaaagcagaaggagagttatcacaagtctcttatggaactcgttaacttatggtaattaatctaaataggacatttatttgaattctatctcaggaaaccaaatgaactttctcttcttgaatgtgcagtttaatgctcatttatgttaatattatatttctttaagttgttagtcacaatttgtgttgctgtctcatctattcatctaacaagcatgtatttggcacctcctgtatgtctgacttgtaattgagtgatgaataggactagttcctgtcctcagagagttcctagtctggtggaggggaagctttgcaggcaaagaatgagtaaggtgcatcaagcccagtggtgagtaacatacaccaggcagagggataacagaagagaatggcattaactcattctgggagttgaaggaacactttctgaagaaagtgatgtctcagctggatgaaaaggagtaaaatagtgacaatccatgatagaagctcaggtatagtaatttgttaaccaaaatattccaagtgaaagtaattgaaatagggcatctgaacaatttgcatggggctttatatttaacactttcctgctttcaactgttcattttttcctccctcttacagaaactccctgagatacacaaactgatattcctctgagttttcaagttggagaactggcccttagggtacactcagtgactattagttgaatgggataacacaaccaatatttattgagtgcctactgcctctctgtgccttaattctttatttgtaaaattagcataataaccaggcctctctcctatgattatggtaaggaaaaaatgagattaatatgttattaacatagactagcattggtctcaaaatcagggttatataagccagttattattactagtaactgctactggttattaattagttattattagtaactggctagttactagccagttattattactagtaattttctagataacaagaagttggtttaggggtgaagggaatcttccttacccccttcggaaggttcaataatttgagtctgtaaaacaaactgacaatagacaggttaacaggaaacaggcatacaaaacgatactagtaataataattagtagagacatgccacgcactgttttaggcactgaacgtcagcagagcaaaggctggctttcatgcagtttaaaccgtgtggccagagcggagtggctgaggaagggagtaaataaaaagaaacgaagttgaaagacttgctggaggagggaaaggcacagattacagagggatttataagccatggtgagacttcaaaattttaagccaagaaggaacctgatctaacttaggttttaaaagaattacttatgcactctgaatagattggaggagcgcaaacatggagagaacagaagaatcagaaggttattcagatcacagtggctttgggcctgtgtgtgtgtgtgtgtgtgtgtgtgtgtgtgtgtgtgtgtatgtgtgtgtgtgtgagggggcagagagaagtggtcaaaatctggatatattttggaggtttactaggcagaattcactaatggagtagatatgtggcattcaacaaagagaggttccagaattttggcctaagcagaaaaatagaagcttccatttcttgagatgggagaagatttatgaggaagaaaactggcttcaagaatgaaaatttccattttagacatgttaataataaatcagtgaatataatatggtattgcaaaagaccaaggaattaacctgggttaggaaagatggatagagataaaagagaaaagaatgtgagaaagatgttactatggcttcaagatccaaggtgagaaatgggagacaataaggctcataaaagagaaatctgtttggatctgaatcagaaagatcacacagtatagtaatgagaattaaaactgcacagaaacaatcagggtttagaaggctaaagtggacaatttgaactcatttactagtagcttggcaacagttaaaattttcaaaacaagctgatttgagctaagtctcttagcattcaccacattatactgagttatctatttctgtgttttgctatcccaccaaactgtaaattctgctgtgttttattcatcattttactgcctctgcctagcatggtacctggtacatgcttgccactcagtaatcacttgtggaagtcaactgaaaaaaaaaaaaagaaaagaaaaaaaaaaaggcttgtgcccaaacaaggacacaaattgaaataacaggctccattggttcaaattcaaactattcccttatgcaaaggattcaagtttgctgagaccccagatccaaggccctatatctgtcttaatatgataacaaggggtaacactcacctcacatatcccaaaaataattttcagtatcctgctactacctcattttgtctcataccagaattgagagcaaacactcaatgtttctttatctcttgcgtttaatttgctaaactccaaatcaaattgaaccctggtctatttgaagaaaatacactgtagtagtttctcctcccctgtgcaggttcatttatctgtaccctaattcactcaaaactcagaggaaaaacacatctgtattgaaacatttttgtggcattgattgctccccatgtgattattccaacaacaactatgtaacaacgtgagggtgaaaataatctctgtagcttgttttgtgtgggctaacaccctagtgagatggaaaaatagcctaaaactatgtctactttttcctgagacttgtcttttcaataagagcttatttactatacctcctgcttgcttttagtcagtaatatgttttgaagatagaacaaatgatcttttctacttgaaaacacaatttatttttattgtagtaaaactatcccattaaaaagtttttaagatgtggagaatagatctcattgtaagttggtacagcctgttcaaattttgatacaataaatcaaactgaaggtgttgaaggtgtaggatagcaaacttttttctccagtcccacttaacagccaaaactacatcactccaatatatctgcctccatttggtttcttgctctttcgtatcttccctcaattattatggtatctcaaaacacctctcacactttcctgttttgcccatccagccaatactccctcattcctgaagaattcgccccatcagagacccataagcagtgctggggttcatgtacatcataattttctagataataagttggtttaggagtgaagggaatttttcttaccccttctgaaggttagataatttgagcctataaaccaaacagacagattcacaggaaaaagcatacaaatttattacatgcacgtgcacagggagctacacaaaatacaggactcaaagaagggcctaaggtttttatatgatacagaaagaaaaagaggcctgaagctcctggaggctgtggtgacaggttatggaagggtaaggggaagaatgcactgtgaacaaaggctgttgtttcattgtgcagagaaggtctatcaggtaatagccctcaaaaagagtagatggtaacctgtggtaatagtttctctgtcagacctttaaaagtgtcaaacctgtctttagtcttcttttcctgtgagttaatctttcctagattcaaataaaaggacctcagagaaaccgtctgcctgcatcccttgtttgctttattaatatatacatgtaaatttattttacaaaaggataaattttcagagccatgctttgtgtctgcagaccctctgaatagccatctcaaaatatgccaaagaggcacgctttggatggcatattttggtttcccacagtcccctctttgaaatttattttcagaaagttttacatattaaaataggattgataactgtggaaaatttgctttagacattttgagataagacattagcaaagggaagaaaaacatatattggaataagtagaaaaatgtctcattttaggaagtggtgttgcagggttcccacagttaagtctctacatggtgtaagcaaacaagtttttaatatgaggcttctctaaagaaacaaaagaaagacaaaagttaataattgaagcagcatataaactagttctgagtctagcagttgaaaagatttctagatttggcctcaaaacatcttcagttgaagtgtggatagacagtgacaatctgacagattttaagttgttattgtgatttatctggagtcaaccagcttcagctttcagggcttcaagaaaaaggcacatttaatttcagtgattccaagtcagaaaaaaattggagaaaaaagtgaaaatgttattttggagagttgcagtcagacattagaggaaactaacaatttcagaatccagtctaaattgtaggtaaataataaaatctcaaaaaaatgaacagagctagaatctaataacagatacactgtagttttcttttaagtcataatttttctctctcgagttcccccctttttaccaaagttaatcacaataaaactaatttgtttgcaaaataagttttaggcttgttatactttgcctaataatttacagaagtacagcaaaatgatgattaatcatataagctcattttcaattttgctttgctggaacttttcacaaggaatctcagattaaacttttgaaagcctcttgaggctgggaagccaatccaaggaggagtcaccctcaaattgtgcctgtaatacctttaaacttgagtgaatacttctcttctcaaggttcccaaaaatatattcaggttccagggcctctcaggaagtgacattttttctcacctgtaaatcaaccatgttaattatttatccaagatatcaagatagattttccaaggggttttaattggctttataaagtcaactttaattccttagagcaatctggtcatatctcagaataggacatgtcaggcaaagccttggtaatatggccaatgtttccaattgtgtcctattagaaagagaatagattcttcttaaatgtaagcaaataactatattgttattgaaataagaatactcacaaatagtctccaaactctggagggatcaggtagggagaaaaaaaaatttcaattctgcacacaaaagtacaccttcccatattcccgtaaactgtagatagctgaaagaaaaaaaaaattaatgtggaaaatgaaacatgaaagaataagccatgtgccaaacaaaaaagtcataaaatcataatctttcattgctttagtcccatgtaataattcttattctgcttgatgttgggttagtagttttttgagttcagttttttcactgaagttcggaattcttacccagtcaaatactacgatctcaaaatcatcagaaaactatattcaatggtacttgtgagagtcttttctataaatttcattgaagaaaagcaatttggggctataactgactgcaagatgcttttagagaagaagcaaaaccactgtctgtcaatgacaaaaacttacaatagccatggttaaaaacctaatgagaattcataacaagtcattgacaaggaaatgtgttgtggcacacaacgctttaacataataaccataattattactgataatgtacactaggatataaatttctagaaatttcatacaattttggaatacatgtgaataacatatctataaaattataactcaaagaaggttaaacatacatgtgaataacacatgtataaaattgtaactcaaagaaggttaaacatcacttgctatttggagtgcttcccatataacttagcgtattaaataggcctaacttgtttaatatctctcttttgtactgctaggggtccttctggaatgcccaaaagttagtctgaggtcaaaaagacttaattttgatttggagaaggttgttaaaaaataaaggttcgaagcattcgatcaaaaataagatcacaggttactgttaaattcatttaaccagaatggcaatttaaagacttcaaaataaaatgcaggaagttacataattatagaaacagtttaattctttaacccagtttttctaagtaatcaaagacctaataaagacagtataaagcataggaaattattttgataaaatgcaaaatctatcaatactcttgtttttaaaagagaagaccaaagtttagttttttaccagtgcactttttctattaaagctcatttctgaaacctttataataattttattcaactttagtcagtttaaccttacaatattttctctcactctctttacccaactctcttgaactgtcattcagctttttatgtatcatttcttcattctgaaacaacctttaaactagaataattatttttcttcaacaacaaaaaatccttatgccttccttataactttcctcaccaaaaacacatcctagtttccttctacacttacatacagaattttttatcttatttctagtagttttaattacatatattaattagaatttcaattcttagtaatcttattttccagtgaaaatctaggaagtaaacaatcttgaactggcattgtaccaacatgttatcaatagatttcataatttctagaaacaaaagctttctcataaagtaattttacaatgtggatcaggacatatttaccagccaaaccaaatatatttagttctcttgtaacaagaagttaaaagtaaataagctaaaatgtatgattaacaattaatgttccagtattatatcttatttggaaatgatctaattatttaaagaatattcattatctaatttagtttagcaatactttaagggtgtagttacctgaaagatttgagaaacctttgaaagtatatattataaatcataattattgttaaaaattaaatttataaagttttatctcacttacatctatttaattactttaaaaccaacagcattaagctagtcctatttgtgaaagatttacccaagtcacatgaacttgaaaagcctttgagtttgttaccatatttctagcagttttaaaagtatttaattcataagaacaaatttttctttaagccaatttgaaattcttccaagaaattttatcccatgtagatacaacttgcaccatacatgcacacatgtataaacatatacaaacatacagataggacacaaacaaaaatattatagtttttattgtaaaactttagacagatacaataatataaaactcaccaatttatgaagtattaaccaagttaacactacctgtttacaatggtcaaaaccctttatcaatattaatagaaaagacctttaagatttttcatttgttttaaatttttaaatagctttttttccctgagtatatagttccattttagcttaggagagaaggcaaagaaattcttattatgctctgagtatgaaccacagccctaaaacaaaggtatatctacaagaaactcaacagcaaaaataattctcatgacctaaattaataagccttttaatggctttaaccaagtgtctaaagttagagcaaaaagatacaggctgctgaaaatccaaagccactcccaaaagaaaggcagtcaaaaagaaagaaaagctttgcttgccaaaaatggggtacaacccatatttctgtccagccatatttgtgggtctctcaaccttttggtaggccacccatacatgagggcctaataacctgtgtgccctcagtagacaaaatgtttaaaaaagacaacagttggtaagacaaacaggaaaacaaaagccattcatgagagggaagaggatcattatcaaacgagtaccccaaaagtcaagagttatacaaattcaaaacaaataattcaaataaattcttataaactaattcttacaagtatttatctcctgagctaaagaaatgtactgaaaaaaatggaggtggattcagagaagggaagttttaaactttggagcccagagatccaaaaacttttctcatttaaaaggattttaactttgttctaaaactgatttttattattttaatattgccaaaggagtctttaagggtaacagttatatttacgtgtgtctcttcttttttttaatttgatcttttcatagatagcaatagttaagatgagagtttttctacatataaccaatttatttattacaaaagtgattcaaatcaataaaagacttcatttatagacctgttttcaccagcaactccaaatttgaaggaaaaagagacaaggagtgactcttgccactcttactcaactgggctctaaaggcagagatctgggaatactgaccttggtaaaaattcttacctttcttggctggcttttttgttagttgtcccagggtcccatttacagcctctaaactgagcagagtgacttgttctcctgcctgggctcaccaaaactgttagggacaaaggcaactttcctccctcttccttctgaagattcaataatttgtgtctataaaaccaactgacaagagacagattaacagggtaaaaacacatacaaatttattatatgcacatgagcatgagagtcacacaaaatatgagactcaaaaaagagcctgatggctgacgttttcatattgtacaggaaggatagagtcttggcggtcctgagggctgtggtggcaggttatgggaggatgaggggaagaaatgcactgtgaacaaaggctgttgtttcattgtacagataaagtctctcaggcaatagcccacagaaagaatagatcataacctgtagtgataatttctctgtcagacctttaaaagtgtcagacctttctttaattcccttttcctgtgatttaatctttcctaggtttagaaaaaagggacctcagaaaaagcctctccctgcaacttttgtttgctttattaatatagatagatgtaaatttcttttacaaaaggatagatttttcagagctatgcttgtgtctgcagcccctctgaatagccgtctcaaaatatgccaaagaggtacactctgaggtgatgtattttggtttcctgcattggtcaggtggaacaatataccagctagcagggatcttttgatctcctgagagacactttgctaagtgtgattaatgctttaacagatgtagtccagaagatacgtttcttaacacttcctggggcagctgaggaatattacactgcagagatgttgtttagttgaaccttgaaggatgagacagagtttccccttgaaaggaggcattttaggtgaaataagcagtatgttaaaaggaacagaggaatgcaacaatatgacccatttggaggaaagaaactaggtgtgattggaaggaagaatcatgaaagatcagggtagatactggtggggcagctattaaaggagtttgagcaggggcatgacatcttcacattgaaagcaatatgggagtcgaattaaatttagtacccagttgagataaaagtccattgccatattcacagtgaggtgggacaaaagcagagtcagagagattaagaggctgggaaagattgaagtgatttttaggaatcagaatccacatcagttgatgacaagtacagaagggcacaatagcaagaagaagaagtaaatgataattcctagatgccattagtcacaatcaagtacggaagagacattattgactgaggttgaatcagggcagagaagataatatacctgattttggaagtgttgcatgtaagggggcttcgatttcagctacttacatacttgggaatctttacaaaagcaggaaggctgaagccacagatgtggatgtaattactaaaagtagaagaggtagagtgaaaagggacatgggatgaagcaaaagcaacatttgagactgtccaaagaatacaggtatattcccttactgcagtagtcaaagtccacaagaccctgaataggcctagtccgtcttaactagtctgagggctatcagccatacatccggtacataagcatatattccttggtttaaataattaaaataatatattgtcatcctctaagatgcatgagactgccagaatgacctgttagccagaggtcattgatatcatctatccacaagagattaaacctctgaggtattagaaagcagtttttggagggcctatagaaacacatgtttcccttttcttatgactccctatagcagctggtatcactataaaatactgtgtaatctttgaaagtccctctagaaaaaccaacacgctcacaaactaaagctaagattttgtcaaatgaggccttacccagctttattcaagaaataagcagtcctattgacctctggaaaatgacctatttgtcttctcctccaaggaatagtagtaaaactataacaactgtacatttatatttaataatgatagaaaatttaaactttcaagtatcctgcttagagatggaaagccaggactcccaaagcaacactgcttgttcctaactagggaaaagcttagtttcttcgccttctttagtgtgaaacaagagcccatttcgggtgtgtgcatgtgagcatgcatattactcacacatacacatttacctgaaatctaccagacattgcatggtcttttaaaaacttgttttgttctcctgaaatgttttctattttgttttctcctagtctctctgggcttatgttttatctcagccaccatttaatgagtttctatgctgttcaaaaccatagaagtttcacattcttcatttcattttatttttcaatatttatatgaatgagatgttaacatccacttttatacacgaatctccctctgcaaaaggctcaacaacttgcccaaagtaagtctttctgacactaaagccatcacttcttccacgacactgtcatctccaaatgagctggggagaaagtggcccctaataattctaagttaccttgaacctctttattccagaattcatcatctactaacaaaattttttgtatgtaaataataaaactagaaatgaaaaatctcaaagtattagcaacaagagcccaataagtatgaaacacccagcaacagaaactatttatattggctagatctaaatttgtctatgtcagttaatattatttatgttacctcatctcaaagggtatactagaatttcaagttataaagatgtggtttcaattaaatatattaaagtagttctcaaaacagttattttacagtgtccagttattcactaagaaaaaaacatttaatgttctggttagtggtgacttagtacgatgtttccatccttgggctcttggccccagtccaatcataaacatgttgtaccctgctgtggtacaacaggagaaaaccacgtgttagcagaggctcctatcaggacctttgaggaactgaatctctttgtgaataagcagctcctaagaaagatctgatctaagcataacatgatctgaaaatttttgcctctccacgtgccattttagaacctgtgaacagcacactacacagattggtagcagagcaacttcaactggtccaatgtatgagtatcgactttttatcctttagagctttactgctgccactcaagggcaaattgggaaataattccaaaaaatgcagccaatggtaattttctacattgtaagcacaggaaaggaggaaataaaagaaaagataaataggttaccttagtgctatccttagtaactctgttcaatcttggcaatgacaaacctatataaactttaactaaataaaggcaatgcagccagaaggtgaattttgctacttggcttacagtcctgatcctgagaaaactgttaattcccctgatgtcactaaatactccctacaattaattactccctcaactaatacattgagaaatgtattaattcaaaaaatccattttccacataaaagagaagctttagcacaataacgttttgtctaaacattatttattcattgccactgagagttttaaaacaatgcaatttggaataaacatatgcctggttaatgttatcctttagagagaaataaaaattaataatttaaaaccacatagttgtaaggcatctggtttgatagaaatgtactcttgaggtagaacagtgaacaattactcaaaaatcagaaatattggaggaatcacaacttctcagatggttaaagtagtctatctgtaaatacaaagtagggtttttaatccttaaatagcttgtcatttctaacaatgtgaagaatatattgataaatatctttaaaagaatgagttttttttttaacttctgtgtctgtgttaaaaacaaacactggtatactttgaaataaattgtcagtaatgtactgtgtgattttataaaaatagcatagacactaattcctaattatgacagtgactggcttactggattcaattggagattaatctagttcacatttttcaaagcacagcactaatactctgtactcctaatccggatcctctaaattagaatcccaggggaagcatttccattcaacattccaggtaatcgtaggcatgctaaagctttagaatcacagtaaacatattttgccatagaaatttctgaagatttgtcaaattatttaacacttgattaaataattgtacatgttctttgaactttaaagtaatagagtaatatattattcatacgttatatataagcatattcaaaaatagatgtatgttaaataataataacgaacatttggagtgcttctttggaggtattgttttaaggaggagttcgttaatattattttgttgagtactcacagcaactgtacgaagtattatgtttatcgcccattttatgatgaggaaaagaggtaactaatttgaataaattgcctgaggtcacacacctagcaagtggcagagccaactttggactcatgcaatctagctcccaaacctcgtcttaaccaccaggtcatactatatcttaaaggtttttcagtgaaaactggtctgctaagaagtcataataataggaaatgcttttaacacattattagttgaacaagaggaaccaaggtaaggaggagagaggagaggaaggaaaagaaggaaaggaggaggaggagagaaaggatcttacaaaacaatatagacacaactgttttgcagtgaaaatatacatagaaaaaaaagactaaaaaggtataaaccaaaatacttattatcagatgatggggtggcagtaatttactgtgttttctctattttccaaattccctataataagagaatgaatgatcatgtattgctcttatagtcagaaaacaataaatgagtcattttacaggctgattacatatgtcttagttgacctgtttcgtaaatataggaattgatttagatttttaattatacttattacttagctacctttagaacacataaatgtataataactgttttttaaaaactttgaagaatggtttaatccttatatgtaaattctatatttttatattatgtttaggtgctctgtgaagaaaaaaatgcaaaccacattgtggctttaaaataagtatgttatttctacctcactgcaatggaaaacattccaatcttattttgttctccaatattatatacataatgaaataaataagattatttatcaatacattttattttacatttgttttattattctgatcagaatttattttgttagaattcagaaaaactgtaccttaaaatgtaaggtaagaacagatatttgcacactggcgttcatagtaccactattcacaagcatcattcacaagccaaataattcatagcactattcacaagtaccacttatcagtggataagtgaataaacaaaatgtggtataaccgtacaatggaatatttttcagacttaaaaaggaacaaatttctgacacatgttacaaaatggatgaaccttggagacattatgctaagtgaaataatccagtcacaaaagaacaaatattgtatgatttcacttatatgaagtgactagagttgtcaaattcatagagacagaaagtagagtgctgaaggaagggaagaatggagagtcagagtatacaaggtacaaagttttagagaaggtgaaaagttctgaagatggagagtggtgttggttgtacaatgtgaatgtagttaatggcaaagaactgtccacttaaaatggttaaaatagtcaagtttgtgttatatataaatttcctcaataaataagcttggtgtggtggcttatacatgtaatcttagcactttgcaaagttgaggtgtagaaaccacttgagaagagcctgggcaacatggcaaaaccccatctctacaaaaagtaaaaaaattagccaggcatggtgatgcatgcctgtagtcccagctactcgagggctgaggccagaggatcacttgagcctgacaggtcgaggctgcaatgagctatgatcatgccactgcattccagcctaggtgacagagtgaaacacttcctcaaataataagtaaaattgaaataaattaattaataaaataaaagatattaaatagtatttttcatttgttattgcgttcaagacagatcacattctcaaaatcttaaaattacctattcataagggttgtactcctaaagatgctttaatagacatcttttttagaaaccttgcatttatcgcctcctaattggtctttgatcataatatatccctgcttattgaactcctcctgtgggtatcattcacattataaataaaatccaaattctgcaaaaaatgctttataatattgatttctgtgcatagaaatatacctacacatatgtcccctctccctctctttccttctctctctctctctttctctctctctctctctctgtccttcctacagctgcacaggcttcttgctgttcctggtacataccaactttttaactttgacaaagacatgacactcaatacttccacccctggaaagcttcccctagacttctgttgttccttttcagcaaggtcattcctaagggccccatccaaaacagtgctgcttctaagatgcagccactctacgctttagccttctctctgtgtttcctccttagcacttcaataactaaaatgctgtatggttcacttgtgtgttttctttctttctgtagtggaatgtgagcaccaggacagcacacatctcaactgtcttgttaccactgtatctccagtgtcacagcacttagcacagtgcctggtacaaagtaaatactcagcaaatactgcgtgtgcaactgtttgtataaacatattcgaaatacctcattggctgtcattgatatttgtggtatagataaaatgagattgaggtttgcagtagtaaggatgagccatttctgaatcaacaaattttaagtaggtggtcatttgttctctgagataatatcctgattttaggtaatagaatttcataaaatggacccaacttttttctccactgagaaataatttgaatatgagcatttgtcatgtattttcttaaatgctttacattcattgtagcatttcatcctcacaacactataaggtaaatattattattgccattttacagatacagaaactgaggtacacagagccatttaccccaggtcaagtaagtattcaaattggatttcattattagcaatgattcccaagctaatgcctttaagcagtattgactgtggctttccctaaacacagataagttttacttatcgtggcaattttttattacctattacatttaaaatgtgtgctcattcaaaaaagtgaagacatgaatattcaaataagaaaataatataaaaatcatccctaatcctttaattagacattaccacttttaaaataaattttccttatctttgggctttgcatagacaacttaaaataaataaaagtgaaagaggaatgaaaatagtgaaccagtaaaattccagaataagcaaagtcctaaaagatatttttttcatttaacatgttaaatgtttttttcaattgtatccattcatcttttactttatgatatggaatgaggagtgaaagtttccttactaaaaattttttttaaaaaactgacctggcagatagtaggtatattcttttatgtaagtaaatatgaaattatttaaagggtattcaaaaagttttaattgaataatatagcataatatttattccataaaataaaaatattttaagtagttataatattagattcatagtggcttctaatatttttagggaaataagaatgatgtgacctcttagtgtccaactcaacttccctggttaaactgtatctgtgataattaaccatattttgaacagatttactctgagcaggcatttttcatatgtgtgaaaatgagccataagagcttcaacagataatgccagaggatggggctctcttaagaatatgtacttacccacaccagcagtgcaaccttacccttgggtctgtaaatttcacttgatagatattccacatgcatactgtaagaacataaggcaggaaatatagaaaaattgaatgctcccacagtgacaaatagtaaaattatactaaaaatagctgcacagggattgttttacagtattattatatgctgttgtcactggaaaatagtgtttttcttgcaatacattgcaatgttatatgatatgttattataaaaaaattatgttgacatcattcaatggagtcaatttttttttttttgtaatttggtctactctatcagacaacactcatctcaatgtgtccttcaaaatacagagttcttttttcaaatttaatagagatttagtgaaaactgtagaaagtatataaataaggatttctgttgcttacaaaactgaataaaagatcatacctctctttagggaacttacaaattaggagggagagggatttttaaaaacacagtacatgatatatatatacaatacatatatagcatgttccctaatcgctacaaaatcctaaggcaatttagagaaaaaagtgaccataaaaattatgattaggaaataatggggagatgcataagtcctgatgtttcatcaggataatggctttaatttggatcctgaagtattagtaggctattaataggcaaggatctctttattccttacacacatattaatttagcatcatactatgaacttgtccaagggctagacagatcaattgaacagcactaagtaaaccctactctaaaggcttctggtaaacgaatactagataaattaggtaagttcagatactgataaattctattacaataataagataggataatagcaagttgcttgaaagagtaagttgcaagcaaacttgaaagttgtttgaaagaggagagaatggggcctttttgtgaggtagggctttctggaaacacagtatctgaataaatattaaaagccaatctcaaatagagcatttcagaaaaaggaaatagatttattagagattccgagattgaaacaatattggtcatgagttcaagaaacaataactagaacaaaacggcggtgggacagaatgaggtcagattagagaggtagacacagatcatactgtgcaggatcaaggagatattcaagacagaaagaacagctagagccaaaatacaattcaaaacacatagagcacaatggttgaacataggtggctattgggatcaaatggcttggcttcaaattctagctcttccacctcctgtttgtttagcgttgaccacattatctattttttcgagcttcagccttctcatttttaatgcaaaaataatgatgatgcccagcttcccatgtgtgatgagtacttcttggtatgatgcatgtacagggcttagcaacgtgtccagcactaacaaagtaaccattctagagtattttgaagaacagaattgagtccagtttaattgttacatataaggaagagtaatggaaaatgagtctacaaataaaacaggaactagagttaagcagaatatgaaacatcagactatttcataatcaggagaaaatccttgcactcctttaagcagggaagtgatgtgtcagcagtaaactttgggtagattaatatagcaattgttgacaaagtattttggatattggagataagaaaataagcagtttggccgggcgtggtggctcacgcctgtaatcccagcactttggtaggccgaggcagacagatcaggaggtcaggagatcgagaccatcctggctaacacggtgaaaccccgtctctactaaaaatacaaaaaattagctgggcctggtggcgggcgcctgtagtcccagctactcgggaggctgaggcaggagaatggcatgaacccgggaggcggagcttgcagtgagcctagattgcgccactgcactccagcctgggcaacagagctagactccgtctcaagaaaagaaaaaaaaaaaaaaggcaatttaatttgttctaagatagagaccaaagagaaggactggattgaagacattgtagaggttaacttggcaggactttgtgactaaatgaatgagtacaatctcaggagcctgagagaatatataattgaaatacagacggtggggaaggaaccagtttgagtcagaagaaattgagtgaactgtagacctgctgctctgagattcctgcagctatccagcaagcagttggaaatgcaaaagtaaactaaggggaaaagtactggctggaaatgtaggctaacattcagattttagctgcagctttcagattgccggttggattgtcaagagaaaagaatgaagataaaagagcagaatactaaggatataaccctaaggtccaagtatagttcactaacaagactagaagaatgagtttatgaatgagataggcgagtgatccacatggtcaaaggaaagccagaagaacagggatcatattctacatgtcaattgctggatataaatgatacctaaataatgaatttaaacattttaactcagatattcagtttatggcatggcaaacaactgatttaaaaattgtttataatgctttttttttttttgctcataatgaaaatgatgtaaaaattcctgaactctgtgtgtttttcctgtatatatctaatttacttacaaaactctcatagggaacttttttttaatgttccatttttaaagcctagaataacttcctaaggaaagtgtgaaatattcagacccataatagcttcctagaaagtagttcttactttccatatgaaaaaaaaaaaattctttgacataatagctaaaggtgatgaaattgtttcttctttaaatgactctagtcttatggtggcatttagaaatgcatcttaagtgaggggttatcacaaagtcttttttatctgctagtttttcctctactttacctttaatcatagtaggaacaaagtataaacaaaatcagcaaatataaataaaaattgtatacattgttctattttatttgttatccaacatatgtctcactttgcattgtgtagaccagaattcgggttcatagaaaaaattctttcttcaaatgagcatgcttatctatataaataaaattataaatggaattaagaaataataaaacttatgtaaggtatttaattactatgaccaactatatattaataaacttgcaaatatcagtgaaataaatatctcaaaagctagaaatgatcaaaattaactcaagacatttaaaacataaagagttcaataaaccaggaataaattttattttttatccaagaactttagggccagagagtttactaatgttattttgaaattcaagtaataacttgatatagtgtttgtataatataaagtgtaatggttatctattattgttcctgatgattacaaaatttgatcaacaatttgatcaacagcatgaaaaaatgtagtacaatgatgcaactattaacatagatgaatacaaaagtataaaatatataccaacaaggtatttccaataatacattaatgtattgatgacataagataggtttgttccagaagtttaaaaaatgttgtcaatgaatttgataaagtttaatattcacattaaaagtattaccgttaaaaccaaaatatagcatacttattctctccattattttggaataagaaaaaattattctttgcagagctcatgcttatatgcatagaataccccagagagttatctgaaaactgtcagacattattcttaaagactttagctacaagaatttagatacaatataaatagcctaaaaaccagtaacttgatgttgtatcactgatgactgcttacaagatggaaataatttattatcaattaagaaaaaagctaaaacatacccagaaacaatcctaacaaatctgtgggaactttaccaataaaactataaagcttcatttaaaaaacaaaaaactaaataaacagagagatgtactagatgggctactggatggaaacaaatattgtaaaaatataaattctaaatttagagatttaatgcaatcttcagcaaattactagaatattgttaagaacttaacataatcataaagtacatttggaacaatcaaagtagaaagacagctacaattaaatgacattacttttttttaatacaagaaaaaagagcaaagatgaagatatgcaccaagctgataacaatataatctcttgggggtggaattaaaagggtttgatggaggggtgaggctatttctttttttctatatttctttagtgggagtgatttttactttcttctgactgtatttttttaaaaagttgttaaagcaataaaagctgaaaatctagggaaatatttacatccaatataacaaatgtttaatatctttaatatgtaaacatatgtatcacttataataaaagtattctaatagaaaattttataaatattatcaggtaattggcactgaaaataagaaattaaaaattcaatataacaaaaacattttaaaaatagagaaagcttttttatctctgtaattttgtgatttaaatgttaagactgataaggatacagtgagagagaccctcccatgccccttggataggaatgcaaaaggggaaatgaaaatctctgattgctgaatcataatgcatttttactttccttctcatacatttgtggattttaaaaaattctataatactacacattatttctatattaaggaaaataaaaagtatttcaaattcaagaaagttatgttttatgtaaatgcagcaagctagaacttttaaatatagtacttctttaaaacactgctttttaaaatttatttatgagtactgaacatggttatggtctcaatttctctccccagtaagttcatgcctaacattttagtccttgaaatggaaatacacaatgtcttctcataaggatagtagatggtatatatagtaataactatcataacattagtaacgttgcgggaacttttccttagttcagctaaagatgggtgtccacaagaaattaggcttgcagacaatttgaagcatgaggagggcagggttcaaggaaaagagggaaaacagggactctccacaaggccaggggccctgctagggtgcttccagcctggcagattgaatcccaggttctactcaggaagaggagggccaggctcctccctgctgcaaacagcacaaacttttatggctccaacccagtgcgcactcctcccaatgttcaggccagttggaggctctgccagggagcccttcccacctgtctcagtaatagtcaaaatattgaactttatcatatgccggatactgtgttaagctcttcagaggcattagcccagttaatcatcaaaccctatgtgatggatgttactgctttcaccattttgtagataaaagaatcgagggtcagagaagttacatgaatgtccaggatggtgggacttggaggaggaatgccaacacctacgcccagctagatcacttatttatttgctatcttccctgagaggccatttaacttacttgagccaaaaggttctcaactcagctataaaatggaaataataatacttggcaatgttgtgaaacccaaatgatgtactatatgtgaacgcaccctgaatagcaaattctataaattcaaagcataatagagattaagtatttacagtttccttctttaaagtatctttcttattttaccacttatctttgccccaaactttaaaaattgtgatatttcataggagaaattatttttccttattgaatccaatatctgaagctttgtctacccagtgttgctagtcagtgttttattgcagactaacctattaatgacctctttaaaagtaaattccaaccacagaacctgtcttcctgtgtaagactttaggtgcagcaaatcatcatgcatctacagcaagttttccactctatattgctactgccaaagaatctcagatgagatatgagagaaaataaattagtctcatatgattcaaaatgtagtgaacactttgcaaacaagtattttttagcatcttaaataaattttggttgaattacgtctcatttacaatatcacatttcatcctaatttcagttgttttccatattgtctcctattgacttctactccatttctcaagaagagtaaaccttactttaatttatctccgaatagaagattgaaggaagaccctgctataagcatagcgtcctacacaaggaatagctagagatgtaggaaaatttttattgattggaaaaaaaaaagtgagctgacctccaatattttctgttaggttttctctgtaatatggcacaggaaaaaataaataataatttgaaaaaagaggcagctttttcatattgctatggagcaatttatgaataggacataagtccttttttcctcctaaaatagggactttatggggttttcatcttcttttttattagtggttggattatctgatcatttacattataagaaacacacgaaaatctagaaaacattttacattttgttacagatttacaaatagcatgttttcactttcattctaaaactaattattgatatcagaaatttgtatcttacctagatcattggttaacaagacagatttttaattcataaactttaattcttcatatggcagtctgattgaaccaatacattttttaaaaatttatagctaattgaagtataacatgaattaaacacacatagacttcaaaataaagcataaatagaagtgcatggaaagatgtaccgatgattggttcttaggaaattaataataaaggctaacatttgttgaactcttaccaagtacgacctgcagttataatatgcgttacttcttttaatattcacaataattttataattaagtaccattgctactttatagtcaaactattaagtgatttgcccaaggacatgccacaaaaaaagtgatgaagttggattatgcaggcactggtcgaactcaacaagcagtgttcctcacctctcacctacactctgggtaacatttatttttcaaaatcttaactatataaagtatagcaatgaaaaatgaaggatgttctaaatgtaaattgccctcacttaaaagcttaaaaagaaactagctacaatgaaaggagaattcgtatatgtcagcgtgatctagcgcagtatttgtaataaagctgaggtggggggcagtggaataaagaagggaaaatccctaggggaatatattagaattaaaaaggagcattttaatactatgcacacaccacctcccaactctagaatttcccaccagtttttctcctgccttacgtagcctttcaaatactctttctcttcctggaacaccctttctacctctccctcacttcagggctaagttctgcaagttgatctcttctagactatcagaacctttcaagcaaggaccatgagtttttttattcatcttaacataataataagttgtaataattataataaattataataagttataacaacttttaaaactatcacgatgcctcccacagactcaacactcaagaagtatttgttgaatagacaaatatgatatatttcaaagtatctcacagtttgcaacgcattttcttataatacctcattctattttcatgataagcccctatggtgagtatttaaataagaagaaacctgagacacagagaagctaagaaacttgtctagattcacaaatcctgcaaaaaaaaaaactgagactcaaactcatgcctttcagttctgcatccagtgttgtttccctcacagctcagacaagaaattggtcttctggtaaattataaggccttcctgtcatgtacctaatttcatgttctaaaaaattttactacaccgaagtgtttacattccacagaaattttttaacttttcatttcaacttaactgtttattgcagagcgcagtggtagtaaataatagatacaatctttgcccttgagagaacttaaagtttagttagaaaggatcaggaaaaaaaaaaaaacacaaagaactgcaattcaaagcaagaaagacatggtataagagagtcaacagttagttggacaaattttattaggtaattaatctatgcaccagccttaatacaatatgctagtacatgaggaatttaaaagaggggattgtggactcaaaagaaagagatactaacagactcatgggtatggtagaatctgagacaaaacttgaagaactggtttacttttagaagacaaatataaaggtagtcattctgagataataatgagacgttgagtaaaagctacgatgtggagacgtgtggggcatgttttggagagagccagtttagtaagagtgatacaaaaaaaagttctatttcttagaatataagagtgaaatattaggaccttaaatgccagactaaggaattcattcataatttgataagccatgtggagccattgagagttttgagcaggggaatgacattattggaggtggggtttataaagattgacctaccagtgaatacaggatgctgtaagaagctcaaagtagggacactagtcaagttttcaaagataaaaatgataaagtagcatcacttaattacaccattgtatctcagaaaatatttaggtgatctaaaataaacatattcttttagtttattccctcaaatagataaaatgagtttaagagagtccctgatgatgagtttttatactaaacaaaatgcttatttgggtgagagattgcaactcagtatggttaaattagatttgttatttcttagaactacattccctttggtacttgtagagaacttctatttctgatttaaaaagaacacaaggcatatggcaatttttcatagttattacaggtgacatctaaactggcagagtgcagacaaaggaaaggcatataaattagacaaataaaagtttctttagactcatacacaaacaccaacagaagtgtacaaagagataatgaacttgcctaggatcactgcaactgaatgaacaagcccagatatctatcaattccaaaatgtattcgacataaaagtcaagttatgttttttattgctgttttcaaaagcagccatttttaggatatttgtgtttctgatatgttaaccaaaatgttttatgtatggtgtccattttaatggtgtcaatactgagtatattgtgctaataatgaccataacaattggcatctctaaacaacatagaaggtcaacttcattgatttaacttgaagtttttagcaaataaaataggaaagtattttccttgatgctggctattgagtctggcacttactggcactgaataagcagttttttaatgataactatcttatactagagagatatgactttgaaactacgttgtattcgttgaccaaaaaaattcttagagttataaattctgtgaaatgatctagaaaaaattatattgtcaattgaattttggaaatttgtgtatttttttcttttggagatacatactgtgtagtagcatattaaagtctaacatgtgctacctaaaaataaaacctatttaactttctttaacccagtgctttccaaacttatttgaccatgaaattgattaatcttccttgaacatatattcagattccatgctgactttaggaaattttgccagagaacaaggaaagcagcattatataccagagaaatgtgaagttttaataaaagatctgctcaccactaatcccagttcccacaaaaactgctatagtgtcctgtaacctcacccaacacctcaacccaataggtgttcaaatttaacctaagtgtttacaggattttcatagtcctatctaattctgcctcaaaaatagaaaattatctctgattattttatctccccatctctgctgcctccatccgttcattcaaccaaggctttctatgttctgactccacaacaggaagcatgacatatgttgaaatgaactcatgagcagacctcatggtcctcaccttcactaaacaagcagggtagtagaagaaaaagacaaggaaagagcctgatatgtctttgctaaggaaaataccttgggttgtgggaactgccttggtggataaaggtagttctgtgaataaaccaaaatctgaaggatgagtaggtaagagggaaggaagagtttcaaacaaggtctttgtgtgggagagcacggctttatggggaaaaataagtgcagtaattcattccattcatgcagtacagagcctaagggaaaatattttttactgttggatttcccttgtcaggaaagcttagaaacactaagcaaaccctggtacatgtaggataatctggaggcagaatgagtggcatcacacctcttacaagctttacctttggctctttaatcaggtagctacaggtattgggaggtaagggggctgatgctcaattcctccaacccctaactcccatgtcttaagcccagagttgcaaagggtgacccacctacatcataactcctacagtgctttacctctggggttttatccaactttggagaaattccttcatgcagactctgggtcttgattgcaatcatatcttcaggccagagcacttctttattgagatagaacacagctctttgaagtatattcccaaaatacaatatatgttagaatacttctggccaggcctatattgatgtgtttacttcttgtcaaaatattcatttgtctttgaggagaagaccccccagattttgaaatcaatgtgtaagccatatagaagcaaaattagagtttctacaattgaaaatttcagcatttttcacataatctcaaaaataccaaactggcaacattccagtaaaatgaagattaaaatgttttaaaaaatgaaaaactggaatatgttagtatatgcaattattctacatttttgaaaggaaacattcacaggacaatgtgctcatttatcatcctgaccagacctctcccactcttttctctttaaagttgaaaatgctgcaattattctgttatgcctcataaaatagtaaattatctccaattactgtacagtcacagtagcagtaaaaagcttgtgtagaacaacatactccccatagtcatcttgaaatttattagaatatcataaaattataactcagaaaggagtttcaaaaacatgtctagtccatttttattacctctgggcaggactgagttgcacataattccaggaaactatctaaagagaagattcaacaattattcttgttagctagagggttcaatcacacttacatagtgagaaatatttttcctatatgatacatttcttaaatgtttcctcatgttcatatgcagctaaattctcaaaattcacttctaccacctcaacccaagtgaatggcatctgagcaatacataaacaacaaattttacccttatgaacttaggaaaaacctttcatttatttgccacaatattttcattttcatctgaaagacagcactacctagacaaatttttaacccccttaagtgaaatatcaaaaatagtgttttaagagcaggaggtaaccttgcctctgcacaaaaacatcttgttctttccacagaaaccataaagtaagcacagctttcaccactgatattgtagaatattaagtaatttttttaaattataattactaatttttgttgggaatcagggcaatgccagatatcctttgtaaaattttaacacagtcaactgttcctttattgctcagcatgccatccaggctccattccagggcatgcccttccacagtttagggttgctttgaatatttctacaggatttttcagacattagcctgtcaatcaaatatgcagtaagttctcataaaatttctcacttccccacaccctgaaagctataatgagcaaacagagtagattctaatgatgtgaacaagatagcatacaacctttgaacttagatatttgtttgatacctggttctgtcactaactagctggatgaccttggaattatcatttgtcttctctaaatttcaggtaccttgtcattaaaatgggaatcatgatggttgcctcataggttagagtaggattagttgagataattaatggaaaacaaataataggtggtaaagaaaactggccctcagcccatgtttgtagttactatggctgatatttttgttgttcttagtactactatgtctattgggagtgccagaggatgatggcccaaaaagcctaacgaagacatttaggattggtattagtgttcagtaggagaagtgcttggggttttacactggcagggatgtacacaatattcaatggaggaaaagataggtgaaaattaggaaggcaaagtatttcctgcacgtgttggtgaggtgttgacttaggatccacacaaatcaagcaaaacactctcttatttgtgtcttatttcataagtgaggaactcacagcatagggtattaatataacatgcccaacgtgggtgaactaaggattcaaacttcagatttcaaagtccaaagtgaatgctttgttcacttttaccaggcttgccctctgccatttacaagagcagtctttcccatattcttccctaagcagacaacaatttagcccttacctatattgaattctcatagtatgctatactcactttattataggataactatttgctgtattctgtcactttctgctaaattgtgagctctgggaggtcaaggagaattttccattcagctacatatctcagagcctacaccaaaatcctgagtttcacctctgaaggcctgagtaggcaagttgctcctctccccctccagtgaggagggcaagtaagattctatctgggctcctctgaaatccacgagcagctctccaaatagagaagcactgatgtagagattgttgggtaataaaattaatgaggaagccatggtacaaaattttaacacctttcttttctgaactaaagttaaattcttgagtgtaggcgttccttcttgaaagtcctgttactggagagattaatctaccagcaatatacaaagacagattagtgagagatggtggtcccaataaaatcatttataggctaattacattccttcttcactcagttttactacaattaaaatgtaaaaggtctgtttacatttttggtgcctcaatatgtattgagaaatacaatattgttaagcaggttttcactttgcatttctctgctttaatataatgaagtcattatccatgcggacccacaatgctccgtgttaaattcgccaactgctgttctgtacattccctcagccaatttatttcaatttcagaaggagcaaccaactccacagtggatgactgctgactgcagttccacaccatcactcttcaagagtaaactcaaatcaaggaaaaagcttccacatgtgagcatgggtgtgctcaatctcctgttagctgcagccacagtttcaggcctgatagaccccagcttctgcccatggggtgcagagctacagacagctcacctgcctctaccacaggacagatcacaggacaggctgtgtgtgtgtgtgtgtgtattacatcatatatatatatatatatatatatatatatatatatatatatatatatatataaaataaataggttgcatacagaagattttcaaaccaatcattaacacatgtaagagctaggtcatattatttatggcactgttggtggtagccagatatcataaatgcagtgtcataaatacttttgtatgaaattatataattcttagggtaacaccttaaaactcataatttgcagagttccagggttagagcctaaatgttcagaaattttccacaaatggctatcatcaatttaaaatagctatgtttaccaaataaatttgtactgagctagacacgtggattagcaaatctgtagcacagagccgagaaaggaaccccttggtccttttgacctccctgctcttgtctcttattttctctgtttgctgattccatcaaataatttgatctttttagagctgatctagcctgttgtttgacaagacccttttttcttgaactacattatcacttaacccattaccttgtacttgtgaacagcatattagaatgaatcattttgccatttaacatgtgtggttaaaaattattggttatgtattgaactccactaaaactatgattttaatatagaagctgatgtttcaagaaatcagcagtctctactgggttaggtttttcaaagtttgggttgtgcatgatcataaggttaaacatttttcaagtgtaacattaagaacaaatttttcatgtaatttggatagataagtcatttcattcaagtctatatacaattttcttgtgctaatcttgatgtaaaaactaatggtagactgtctttttctgcttttgttgtttaaaatgacagtaatcaagtttaccatctccaccatttaataaagcaaacagcactagtatagaaattagaaaggaaataaaaggagcatttagtgaatgtcagtgttgatctagtcaatcattgtacatgtgttagctcctctagtttccacaaagccaaaatgaagtcgttattatctgagttttacaggtgttaagaaattcaccaaatgtgccctggtagctctttaaatgttgtgttccacaggctccctatcctgagcactctaattttctatggtacataatttacctgggtgatctcatctctttacttggtttcaattgctacttatatactctgattactctcaaatccattattttccactgttacctttcttctcaacttcagatccagatatccaactgcctactaaacatctcttccttgtccctagacatataatccttcacttacccacttttgaattccctattctctatgtttcctgtggttgctggtaccatccagccaaagtaggaaagggctggtcgttttcttcttctccattacccctaatatattcctacaaattttatctcctctataatgtacaaaagcaactagagaatctgtgcctgtcctctccactctcactaacttcttattgtgtctatcatcatatcctgcctgaacttttaacaggtcctcctgccttcagttttagcctcctgaactttgtcctccatactactgctggagaagtcaatagtaaacaatgcaagtatgccattttgctttttaaaaacctttaatggttctccatttcctggagaaaacaggccaagcttcctaacaagtccctccttgatctggttcacgctttcttctataaaactttaccgctcttcagttttttgacccctgacttttttctccagacacacaactccttacatattttctcacataaggtgttttttttttagtcataacttttcttcagctgagaaggtccttcttatctaccctttcactttttctatctaactcctcctcaccctttaagattcagtaaatgtcactatcaccagaaatccttttctgacccagtcttacaaaaatttgtaagggtcttatattttggaatttgttaactaaatgtctagagagttgacgtgacagcaagaaagatattcttgtaaatgaactcaagaaacccaggactcactgaaacaaagaggaacatttcaaatcattttggaagattcctttacttcctgaattaattcataagttgttttttttttctaagctaaattacttaaatagctttattctccccttgagtaaggacagaagctaattaggcattctccaaggcacagatgggaaaaatatcatctcccttcctcttttcttaatccccagtatagccagatgtagtgaaggtcccagctgcctcctaaagacctgctgtggaacaacaggatccaagagactgagggagccaatcaagcttaacatttgcatgcgaaggcctcccagaagcaaggaattcagctccctggctccctatctgttctgctgcttgtgggcaatagcaccacacaaagaaatgggcctgtgcttaggaaaaaatatatatatatttacccaagtcagaatgttcgtatgcggcgatgagaacccaatcaattcaagaggacagagcaattaatttatatatcagttataaaaatacaaattgatataaacatgggaacaataagacactgtggactactagaagggggagagagaaagggaggcatggattgaaaaactacctattgggcactaggctcactacctaggtgtaatattcccatgtaacaaatctgcacccgtacctactgtatctaaaatcaaagttaaaatttaaaaaaaatatataaaaatgcaaaatttgagagggagagctgcttaaaacagcttcaaggatttttatctttcttgaatttctatttagcagtcaatgtttcacactcttagtatataagttatcaaaactaacacattttcagtaaaactggacttcaatgatgtaacttatgcaaagtatcctctaaaacatggtttttcccttatgtagatcagctgagtgaactgtaagcatcaaagaaatctatatgaaaatgtatgtttatcaaaaagttatatgatgtttcatgtgattaaattctaagaagatgttcctaaatgtctcattcttacagctgcaaagcagtgttgacatcatccgatccaaattccctgctttacagctgaaaatccaatgcatgtagcagttcagtgactttaatgatggcacagccagtgttagcctagaaacccaaggtgcctgaccttgaaggaagttcatatgtatacacatatttgtgtatgtatatatatctatatatatatatagatatatatacacacacacatttgtatatatatatacacacacacatattcgtgtacatatatacacacatatttgtatatgtatatatatgcatatgttcatacatctatcaccaatcacatacatatatgtaacctgaatatatatatccaggttaggaatctgtttgtcttccttcagattactcctaacccctgccttctgtcttccttctcctctggcaaacccattttccaatcacgagcatcccattgcccacttacacactgctcaccacccagaatgtagggactgagtcttactcccaagagactcacttcaagccacctccttcccagccattgctggacttggcatctgaatatgttttgttctgcaggagtagatagcctcatatactaatcaagggtgaaagttttctttgtctgtcaggtttcctctaacatcttatgaataatcttaaataaaatgtagggaaagctttcagtaacatcaaatagatctcaaaagaaaggcagactgctattcaacattgctagcctctctctgattctagaagcaaagcctctgaataaagggttcaattttacacttttgttctatccccactcaggacttgctaaccacaatcaccccctcaccccataacctgctcccatgcccatttcttagtgtgggtataaagtcaggccagagacagctaacgagcaatgagtcggctgcacttgcgtactgagccaccagaggtgctaatagacaggaaattttcttattagatgctttcaaaaaataaaattctggagcccaagtattgtctttaatgtcctaagggcagatcttgtatagagaactcaagccttgtatttgtttaaatatcaagaacctgtcaatgtattgaataatatacaaatagtagatgtaattcaatttgactagtgtttattaagttcctaatacaagatagcctgatatatacaaaaaagtgaaaagccctgcttctgtggtaaaggggaactaagaaaagctgaatttaaccacacagattaatgaaaatattctgctcttgtcattgctttcagcactttttgaagtagatgtcttctgtttatcatatttcctggcaagatttataagagtcttcaaattataaatctttagcacatcttgagtaaactctcatttcttcaaactcttcatcactcgtataattagaaataaaagactgtagaaaaatatgaaattcctttgaaagaagtcaataaagagattcatatttcaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagattcatatttcaaatgcacatgaacatttaactagttattaaaaatttccaataaattgagctattactaaactggaatatacctaattcagattccaaatgtgatgagtaagacacatttttctggtcaaaagtaagttccattcattttattgcctataaattgagtctggtaagtttgagtgagagatatttgagcattatgatttttaaggtaatgctttgtttccatcaagttcttagtaaataataaattctcagttatttggagaaagatggcttttattttccccatattgcctaagcctccaagttataattctaactgttcatccaacttgctctattttttatataaatgatgacaccttctaagtaaagtgatcattaacatccatcatttttaaaagcagtttcactgaaaatgaagaatgataatgagaagagagcctagttttacaaaagggaattttaccttttctgtggagacaatttctacagtcacccacagaaacttgtatgtttaattcagttatgatggaaagaataaaatatctcttaaaagcttcaaactaatttaccattttatccgcaagtttctagtaggctctaacactaagcaaaccagaagccagtggatttctagacagaacctacctaagtgcccatctatctaaaaatgtgctttaagttgggtgcctcagcattacaattcctatcaatgggtccagtactcggtaacactctgttacatgtatctctaaaaatgcaatgtgtgtgtgtgtgtgtgtgtgtgtgtgtgtgtgtgtgtgtgtttagctatcatctcagaaatcaggtaagcaagtcacccaggaaacaaaataggtaactatgttaaaaataaacacctaatgtttatttcatttggtcctctaggtactaacatcatctccattctaaagatgaggaatctgaggctcatagggattgagtaacttgttcaaggctatgctcttaaccacagcgctgcattcttgtattgaaagcagtttgttaacttacaattcagaaacacatttactgcataaatccaatactgttgtgcatagaaccttattatacttttttcctctggctaaaataaaattgaagcattttacatttccttaattgccagcaggtgtctaaaggttctgttttccattttctggtgttaaacctgaatgagctcaaattaatgattcctgataaatatggaataaacagaaatgctttttaaaaattaacaaatattagttctttatttcattgaccagtaaatcagcaaaaaagaaaaaaaaagtcttaaagagctttactcttccccttaagtgaagaggaggctaattaaagactctttaatgccaataggagaaatatatttcccaccctgcttctgttttgttattgctcttgtgtttttggctaacatttatcaagcacatactatgcgccaggcactgtgacaaaaacctgcatctaactattcaatgtttgtcacaaccccatgaggttttcctgaaataagccacattaaaattgtcaaaaagaaaaacctcttgcaaatagctgatcaaaattcatcctctaaaagctatcctgtaacttacacattttgactctgccctaaacatagccagaagtaggttgcctttcaaaattatgtggcctgccatgggaaaaaattctccagcaccaacatgatgtaattggaagaacatagatgcctagtgttttaatatacccttcgcaactttcttgctgtatgatcttggagacaataccaccaaagctctcagaatcagaatatcacatattatcctatctgaaaagggactatgataccaaactcataatcttctgagattacaacttacgactcttctttggcttgtcgtgaggtagaatatagataatatatggataatctggaaaaaagcgtgcccaataaataacagggtattactctcaccatcatcatcatcatcaccattgccatcatcatcatcaccatcaccattatcatcatcatcatcatcatcaccattatcatcatcaccatcgccattatcatcatcctcatcgtcatcatcacctgatacattcttagattctttgggagaaaaatggtaggaaatgagtagaaaataagactcttccatgtggtagttgtgtgtattgtacatatacaacaatatatgaagtcatttcatgtttggtaactagacaattgtatctctactcttttttttaatattattagtcagatgtccagtccataaaggtttaaaaagtcaagtatggactaatttgagtataactgaagagcttcatttgtttcaaatgaaatgaaggggaaaaaagactggaggaaaccaggaaagaaaggagggaaattgagagatggggaaaaaattggaatgtcaaattttttttttccattctctgctcttgtgggttttgtttggtttggtttggtttggtttgatttggtttggtttggtaggactacagtataacatatgcatccttgcgtctttttatttctcatgacgaataatccatccattttttggtaagcatcttagggctcagcagattgctttatcacagaaggttaaatcatagaatcctcaaaagaatgggtagaatccattaaaaactgtgcaaatggaaaataacgtacctatttatttttctgttttcttcttgctacttcagaactttacttttctttggcaaacattgtaaagaaagaaaaatgttcagaggctgggcgcagtagcacgtgcctataatcccagcaatttgagaggccaaggcaggaggatcactttaacccaggagttcaagaccagcctgggaaacatagtgcgaccctcactgtctctacaaaaaaaaaaaaaaaattagctgtgtgtagaggctcgtgcctgtgatcccagccacatgggaggtggctgaggtgggaggattgcttgatcctgggaggtggagactgcactgagctgtgattgcaccactgcaccccagcctgggcaacagaacaagcccctgtcaaaaaaaaaaagaaaaaaagaaaaaaaaagaaaagagctcagagttctcagcatatttacacaaaatttaaaatataaaaactatatttttcctttgactgctctaatatcaatatgcagcttgctaataggcatatcacattcctgaataaataacattcactcttcctggaacaggtagcccccaagtttcttcatgtctttgcacaaaggcctccttatcaaagaagactttcctaacctctgcaggaagtaagttccccggctcatcaatcactactttccttatttgtttttttctttattttcttcagagcacttcttgcaatgtaacatctgtttatttagtgtcgttctcagtccattagaaagtaagctccatgagaccatggattttctttgcttcactactgtatgtcatggcagaaaacttcagcaataattatttcaatggtaatgcagtgattactgaaaagtgaatattaaagacttatcttctggaagagcaaagtcctaattattaggtatcagaaactgataaaaattaatatcagcacatttaaaatacatagctgatatcttgagtatgtaacccatatatatggccattaataaaagtggtttttgttttgttttgttttgttttgtttttgtttttgtttgagacggagtctcgctctgttgccaggctggagtgcagtagcacgatcttggctcactgcaacctctgcctcccgggttcaaacaattctcctgcctcagcctccagagtagctgggattgcaggcatgtgccaccacacctagctaatttttgtatttttagtagagacgggatttcaccatgttggccaggatggtctcgatctcttgacctcatgatccacccacctcagcctcccaaagtgctgagattataggcgtgagccaccatacccggccaaaagtgtttaataatatgctagaattgtcccttaaataactccagtgaaatagcgactttggaggatttatatatgcagtgtcaaataaccccatttaaagtatctatctggacacctcaaaatggtgttagtaagaattattttcagacctacaataagacagtgtcctagatgtcctggattagtaagtgagcaggtttaaggggtactagagagtagggactcccttattatgtcttggactcaagattgaaattagggtagggtttaccagtgacgtgaattctgtgcttatttgtcaaccctatggtgtctatactgaattcagtaaaactctggctttcaacttgagaattaacacatcatgcttgtttccaattttatgtcattgacattggtgagagactcctatgtaggaccatagcccaccaggaagagacacttgggagtctctggcagcatctctcagcatctagtctattgtctcacactgttaaaatgtgtctccaaagtttcatattttattccacaaaatgaaaacccaggaattatctggactgatcttccactgaaagcagacaagtggcatttgttacttaagcataattttagagcttcactctcttcaaccaggttgctcatcagagtgttcctcccagaggcataaacaagctctagtagatgcaattttctccatcttctaacattccaaaaataaattttagtgcccttcacacattggctttctggcaaatgcctgactggcccacacttaatctgactttgacttaacatagcactggttgcaaaagatgtgaaaaacatgggcagttcttacgaaacagattgtggttctagagcttagtcatatttaagagcaagagttttgaagccagtgtaggtggtaacagccatctgaatgtgggaaacttacttaatgtttctaaagctcagattcctcagttgtaagataggaataatgatagtacctagctcagaggagtgatgtgagaatatgagtaagcactgaacaacgttgtcttaaggcctgagcagaatagtgaacatgaaaatgactatcacatagcagttcaacatgtctgttgttttcatgtgctgccaacatcctgcatttgtgtgactgtttctgtttccagctgtctttatccagccacacagaagacgaaaagctcataggagtcctagaaaacaatggttactttgtctttatttcaagcaatagaaggggaccttctttaggaatgcatgttggatcaagttggagaagttgattaatattgtttaatgttgtttaaattcagctgtttaggaaatggaatgcctgtgctgataataaaaaagatcatagatagatagatgggtagataggtaaataaatgcatgatggatgaattaggtagacagaaaaacagaaacagtcataatatagatgagtggataagtaggtgggtggatggacacagagataaaaacatataagggtgcatagatggataattagatagagagattagatagatagaaagatagcctgggcagagtggctcacacctataatcccagaactttgggaggccaagacggggaggatctcttgagcccagtagttcaagaccagcctgggcaacataaggagaccgtgtctctctaaaaatgaaaaaattagtcaggtgtactggctcacatttgtagtcccagctacttaggaggctgaggtgggagcacctgtttgagccaggaggttgtggctgcagtgagccacagcactccagcctgggtgacagaatgagattcagtctcaaacaaacaaacaaaaaaagatacacagatagatagatgatagatagatacatagatagatagacagacacgtagatagaaagaacaaatcttggaactcccttcctcttctgagttacagctgaacacacttatgtttaaagtctatgcttttcaggcatggtgcactcaagttgcaaggaaaacctggcagattttcctagaacttctgattttgttgataccctattaaaatcatcaacatgcccctgcaaaatttgataaaatcccaatttctttatagaacataaaaacccattactgagttgatgggtgcaacaaaccaccatggcacgtgtatacctatgtaataaacctgcacgttctgcacatgtatccctgaacttgaagtataataaaaaataaattaattttaaaaatccattattatcatacttaccttactaacttctcttcctgtcagttcttcctactccttgagccaagctggacttactggtaattccctgaacacttttgatttctacatgatttctatatgctattcttactagaattttgtgtttgtgtttcaaaaagtgtagatataagacaaaacaaaaaatatatatttatattttatagaacaaaaccttaaagaatcagtgtcattttatgttagaggagcatggccttgggttacagtcccctagaccctcctgatggtatcccttccctctcctttagctttatgtgtactttggtgaaaatttttaaaaatgcgtggttaaccaaaggactgcaataattggtgtggcatgactcataaagcctttgcaatttttgttttattatgcttttattttagcaatgtataaattcatttttgctaatactaaatacacatgctattaaggtgatgctcatcagatgatattttcagcagaaaggctatgagatgcaatggaaaacagaacacagtttgctatgagcagaagataaaaggcatagatgcatgctaagccaaagaaagatcaaatgctcaatagacccataaaactttccctcatgggtctatgaaagagcacagtcaagctgataaaagttatactgaaaggaagagtcactgttgaaagaagatcaattgagtagtgtattgaccatggatgcaattttctaaagctttgtagaaatattgatgtaatctaggagggattactttgcaaaatttgctgtctaattcaccatatttgagtattttaaccccactaagtatgagtgtcagcaaagacttagtacttgaaagtgtgctaagagttcaaaatggttaagaatctctgagttaaattttgcattttaaatcaagagacttaccagtaccttttatcatcaaaccagaaccagaaaatcagggttggggaggaggcggtggcttttaatatagtaaatctaagtataaatgtataaaattccatttaagtcatagtgcttccatggaatgtaaagttgtaacaaagatgattcaaatatgggtatattataaacatttacagagatgtattattttgaaaatggtaaagacctctgcaaatggccagatggagagaattacacatatacaaaaaaagtaacatttttagattaaaagtttgcagatctttatcagaaacctttataaaagcaagtaaacttttttcattgtacataaaaacatggaaaatttgctaagtttcagcaggtatttggggtatacagttatagccaccaaagaataatttttatgctcatctggaaagaatattttttcaggaataaagtgttttttcacagtgagctgtaactgagtgattatatatgtattcatatgagacacttttgagagaggaggtgctaaaacaaatttaaaagtattagttgatctatagcaggctttgtccaggcttttctatgagcaaactggaacacacagttaatcgaggaataataactaccttcttaatatcatttgccatcctatgcattatattgtccaccatctctaaactctctgagtctcaccatcgtattgttcataagcagttctccatggatgtctgtttccaaacatcttgagagcacaggaattgtctgccttgattccagataatatattcaagaaattttgtatggcaaagagctttggaagctagaaatttggagcaaagatcaagtttatttgtttgcatcttttgtaagatttggattttctaagactaggatttctcagttctaacttcaacccattatgtgaacatcatctgcttgggccatgccataattacccgcatgggatttgggacttggggtgtcaaggggaacttgcacaaatataaagctcatgctgcttgttatgtcataaataatttggtcctttgtctttgaaccaggagtctcatgtcttctgctagcctccatgaatttatagcaggctaacttgttagcttacaagtaggtcagaacctcagtcccttcatagttcttaacacacatctacagggcaaaagcaaaacaaataaacactataatagtgatattcaatccagttgagcatgagacagggcattgaacagggatttggaagtaaattgtaatcccactgcattacaaccattttttgagttactctgtgcaaattatttcacttctttctgctactcaatttcttttttttaataaaggaacttctgctaacatgcaaatgtgtgcatgtgtgttttctttttttttttttctttgcccattgttttattatactttaagttctgggatacatgtgcagaatgtgcaggtttgttacataggtatacatgtgccatggtggtttgctgcacccaccaaccagtcatctacattaggtatttcccttaatctataaagtttttttagagagggtggtggccctataaggtctaactctaaattcttaaaacttgttaaatttttttcagtgtttttcataactctgtcccttattccttcaacaagggtttttttgtttgtttgtttgtttgttttgtgtgtgtgtgttgtgataacttaaaaatcagaaaatattacatatgggaagctccttagagatgatgtactttagggacttccacaattatgttctgatcaatcctaggtttcttcagagaaaattttgggtctctgaaatgcttgattgaactttaattttcatatacaatttaattaagttttaagctaataagacagcatgtataatcagatgtgttataagccaagtgctaacacatagaagaccatcaatgagtcaacttatatattcactgacattaaaaatgcaaatgccataaaattcaatttctaaaacaaatctatactgataatatatttattttgactgtttttctatggaaagttaagaacaataaatcactttgaacagcccattttacaaatcagaaatatgaaaaactaataggaatatgagtatgatgaaagaatgtggttaattcgagtaaagagaagacagaggaggcaggaagttagctatacatgtatggagctatgataatttagttgaagttttttattccttttgagttaaggatcacgttttgtttcttttgagtttctatagttaaatgctgcaataccatggagtgtggttaaccagagtgagttttcttcctattagaaattgttattaaagactttgttacaactaaacagaaaaaataaaggaataatcccattaaaaagtatgcaaaggactaaataaacatttctcaaaagaagacatacaggccgagagtggtggctcacacctctaatcccagcactttgggaggccaaggtgggtggatcacgaggtcagaaatttgaggcaaacctgaccaacaaggtgaaaccccgtctgtactaaacatacaaaaattagcctggtatggtggcacgtgcctgtcgtcccagctactcaggaggctgaggcaggagaatcgtttgaacctgcgaaatggaggttgcagtgagccaagatcgcaccactgcactccagcctgagcgacagagcaagattccgtctcaaaaaaaaaaaaaatgcaaatggccaagtatatgaaaaaatgctaaccgtcactaatcatcagacaaatgcaagtaaaagccgcaataaaatcatcttaacccggttaggatgtctgttatcaaaaagacaataacaagggctggtgaggatgtggaactctcatacattgtttatgggaatgtaaataagaatagccctcatggtcaacaatatggagttttctcaaaaaaaaaaaaaaaaaaaaaaaaaaaccctgaaaatagagctaccatgagatccagcaatctcaatactgggtagctatcgaaatgaaaggaaatcagtatatcaaagggatacctggattcccatatttattgcagtactattcacaatagccaagatattgaatcaacctaagtgttcatcattgaatgaataaagaatatgtggtatatatacacaatgaaatactatatagccataaaaaataataaaatcctgtcatttgcagcaacatggatggagctgaaggtcattgtcaagtgaaataaaccagaagcagaaagataaatatcacatgttctcactcatatgtggaagctaaaaagtttctctcatggaggaagagaatagaatgatagttactagaggcttggaatgtggtggtcagggtgggatgaagagagggtagttaatgagatagatagatagaaggagtaagttcttgtgtttgatagcacactaaggtaaccatagtcaagaactgtatattgtgtgttgtatatttcaaaattgctagaagagggtcaggtgcagtggctcacacctgtaatccctgcactttgggaggccgaggtgggagaatcacttaagcccaggaggtcaaggctgcagtgagcctagatggtgccactgcactccagcctgggtgtcagagtgagaccctgtctcaaaaaacaaaaaaactacaagagaagatttaaaatgcaaagaaaagataaatgcttaaggtaatggatatcctaaataccctgtttggataattataccttgtatgcatgtatcaaaatatcacctataccctgtagatatttacaaatattatgtatccaaaaaaattaaaaggctttaaaatgtacatttcttccttggcattgctacctctaatgatgagatgacagacctaaacttgggagaaaccaaccagaatgaaaaagagatatgtataaaagacaatatggaagaaaaaccacagaacttaatggcaggtacaagtacaaaaaaaattaaactttgctcttgcatcctggtgactgggaaatgattatattgttgacagaaatatgaaagttgaacagagcaaccggtttgggaaggaaaaaattatcaacacaatttcagaaagttaggagtttgaagagatagcagaactcctgctctaaatctccagtgaacaggtcagaattgaggagaaaggcctagatagaattagagatttggcagtcatctgtgtccatagattgcaggcttcatatatcagattttatctgttattcttgaatcttgaagtgctggtcatgtggcaattttctgccactctttccaataaaaagtccatattctgatttccctgtgactcagtaaattgcctcaaatctcatacactgtttttcttgttactgggtgtcaaaccaaatctgcctttactttaagtgtaaaagttttaaaactatgttgtgtatatgcaaactggataattacatattcatttactgagaatatggaagcatggaaaaaaactaataaatcattttcctcaatcaatgtaaggaatctaggtttacaaaggcatatttgaattactataaaagaaaaggagacctgacaatttctgtttgattgtgagatgtatagcatcatcaaaattacaaggtaaaagctgaggaacatttttctgaatgcttgaagaattgactgggtattcagcagaagctgaatgaaaatgtcaggctaacaatgaagattttgtactttatcacaccctgatgactggtacatagcaagatttgatcagtttcataaaagtaggaaattgaactttcaaagacatcgctagtactagaatatactagaatgctcctttagtatgcattcaagttttttaatagtatgttacttggttaatatttatgtctgtctcatcccttaagtctacctacatttaaattttatttcttggtaagtataaaattattctaagcttacctcagacactaacaaataagtaacaagggctcgatgggtatcaattccatgcctaacacagggctgggcattatgagaagtttaagacattctaatagagtagaatggtggtctccaggggccacctggagatggagaaaataaggagatgttggtctaagggtgcaaactttccattataagatgaataagttctggggatctaatgtatagcatggtaactatagataataatattgtattgtacacttgaaatttgcaaagaaagtagatcttaaatgttctcaccacacacacacacacacacacacaaatggtaacaatgtgttaactaacttgattgtggtaattatttcactatatatgtgtactaaaatatcatgttgtacacattaagtgcatatacttttttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccagtgtgtgatgttccccttcctgtgtccatgtgttctcattgttcaattcccacctatgagtgagaacagtgcatacacttttatttgtcaattatatctcaataagggtagggtgggaaagtgagccaggacttctaatatcctgctagtcaatgcatttataaaatgttatttaattaccatgttcctattgtaaagactcagtttcaatagttcataaattatttattcattattggtgtccctgacaagataaataaatatgaaacaggcttgcacttaagaggggaaaagcctatgaaaaaattacaagctacttgggaagccttttggatacttgtaaagtaggttactccagatttattctgtgatgaggaagaatgacagacttggatggtttacaggagcatcttgctttcgatagtaaaaggcactcattggaacatcagcttattcaactccatgcctttacttttagggccacaggaaacaggggtcaatgatggtgaatgcgtgctttttctcttgacagaagtaggaggattgaaagattctggtgcccttaagtgtggttgaatttctgaacaaatatgatccttgcaagagtaattaaaataagctgctaattaaaagcttttgttgtttaaacttggagaagcaaatcaaagtggcaagctttcactccaagtcaactcagtgctctttgactcccagaagggcagcttgagacaacattgcctaaaaatttcttgaatgcctgaaaggagttgggttgagttcagcttagaagtttagattggaaaagatgtctatgttagaataaatcgtggatttttagatttaacatttagatagaaaattacttaattttgattattctaaaaataaatctaccattccagttagtagaatagacatcctttcagctaccatctattgaactcttattaacagtctggcacctggtaactgcataagcttagttaaatctcacagtagtattatgaggttgataatttagttatcccatttttataaagaagggaaaaataatgaagatgttaagtaacattcaagattcattagctcacaagagtgaggctggaattggaacccaatgtactgaccccaaagccatcttctttactaccatattttgccaaccttgaccagctgtaaacttgaggaatcccatacgcatgtgctgggtaaaatagtttccaattacaaaaagacttctaatctccatttttttgtactacatattactattatactattttctgtagcttctaacaatatataatactctaataacgacattgtaattattaataaaaatgactaatgcaactctgtaattttcacttttaacatgttacctaaagcactttttgcttaaatgtttcttcttggtcaataatttattgctcttgctaaactgaaaaacaatatgtttgatgaagttatttcatgtaaatggtaaatcctttacatttagaaaaaaatcatttctcttgtgtttttcattaattataatggcagtgatcaattttaaatatggccttacttgcatattaaaattgatttccttcccagtttagttctgcaagtattacttatttaggaaacaagaaaaattataaaatgtttttactattccatgtttgcaaggtatgggtagttatttctatgggtcagatatttgttccaaaatactattcctttgcttccacaaacacaataataaaaacagttaggtctaacatttattattcaataaattgatatgttccaaatactatacttggaactttttttttttttcctccccaagatggagtttcactcttattgcccagcctggagtgcaatggtgcaatctcggctcactgcaacctccacctccctggttcaggcaattctcctgtctcagccttccgagtagctgggattacaggcgtgcaccaccacgcccagctaatttttgcatttttaatagagacagggtttcaccatgttggtcaagctggtctcgaactcctggcctcaggtgatccatccaccccaacctcccaaagtgctgggattacaggcatgagccaccccacccggccagaacttttttatacttggaactttatatctattatctcattaatactcacaaccatcctataaagcagctgacattatacacaataatacaagagcaatggggcttagataagttaaataactctcccaagtcataaattagaagagacaaatgattttctaaaaccaagactgcctgcttcctagtactaattttttaccctatcaacttgctgcattcaaaatacctttgaaaatattaaaaattaaactataagtataaaataagaccttgagttcatttaatatttggtttattcataaacattttaatgcatatttttaaattttagatgaatagaatttgatttagctgtaattctataatgcatttctttacataattggtatcatgttaactctttgttagccttgttgacctttcctagcactggtattcatgtatatgagcctgcttttgtattgacagtggatatttcttcctttcctctttctctgcacaaatttctttgctgtcatgttgttagcaaatatttattccattcctgcaagcagtcatgcataaaaatatgataatagatattcatgtcctttcttaaaccccagcacatacctacttaaccatcacgtcattcaataatacttatttcaccatgacaagaagggcaacataaataattaatattgatttccctgatcttgcctctaacccatacagctttctcaagtactgattgatagaaaaatactttacctctgaagctgtctgacatttaaatatttaactcccatctcatagttcatgaaatattactaaaatacacagaaaaaactacttaaaaagcagtaattcaaactaaaaacttgagaaagcaactgaaaccaatgaaatcatgtatgatttttaaaagatacctctagaaacttaaattcagggcatcaaatttatatttttaatctccatgaaagaggcaagaacattattgctatttagtaatgcaatattaaatgatattttgctgcatttcccaaaggcagtaataactattactagtagtttattggtttataaaaaagtactatcttaattcataaatagattactttctctcacttctattcacctcctgcctttgacccgtcagctctgcaactttgggtaaattacctctttgagctttcctcactttatctataaaatgtaatgcaattcacaggattaaatacaaatacacatacatattatttgtgtgtgtgtgcatgtgtgtgtgtgcatgcatgcatatgcataaacaaacgatgcctggcatacatgtagtaggttctcaaaaactgtgagtcccatcctttttttccctttttgtatatttacatgacctacctgtgtacacacctagttaaataccttatattttgcaaggctttcacatatggtggggccagggtgaggcaagtgtgccacttgccttatgcacaaaatttaaggtggtaagaaaaaaactcagtaattaaggtgaaataaaaatttaggcagtatttttaaaaatcagaatttatccaaaatttcctgatgaacaaaacctcaaaatattaaataaaggcaaggtccacaggactggcatttccttcgcctcagcctccagtgtggcttagcccagctctgctttcaccagcgttgcctacacatgtcccgtagctctggcccccacacagaaacaacatccaagatgtctgcgtccttagtcgcaggcctcctacataaggcagctcacagcctcattccttattctcggtttgaggttgaaaggtttaaatcttgaatttggagataggaatgaaggcaaaactcaagctgagaatttgagagaaagcaagaatgagagagtatagaacgtcacaaagatctagcaatgagggagcttcattctgaactcaccatgcttgaaaggctatagatgagcactgtctgttccctcagtctgcatcagcttcatccaagaatgatttttgatgatgacattgaataagtatccatgtttctgtaatagttttaggaagcacaaaatgaacttctggttcctcttaggcttataaatataaaggagtattccatagttattttatcttcctattggccttgaaaaaaataccctattagttatctaaatcctcatcatgtgtaggtgtagagtcaatgttaatggtactttttgataaataaaaatgatgacatcctccttctataatacctattcccaaatatttaaatacgcttctactaaaaccaaatcatagactaagttggagtgcttggtgttacttggttttgatttgttctctcctgagacaggacacatttttgtctttgatttaccccaagagaaagaattgtcaccactggataacccagtgagcagaataatcaggccactgagcagaatgagtgagtcatggtgtttctagtcctccattaccaaattgtgcacaaaatatatcgcagctggtgctgccacgtatgcagcattttaggtgggctatggactgctgggaaaagaccatacaaacctatagaaagtccctgatttatttaacaagtatcctgaaattaatggaacaggggctctccacagcaggaaaagataggtagtatatggcctcccctttgcccctgggctcccagaggggcacacagctgccagaaactcgcttcatctgagaagaccatgctaatgttgaaaatatagccaagttcttgctatgccacagtcgcttaaaatatgaggcatataataaccatataatattccagtggcatttaggctaaaaatctgcatgcttccattatagaagcatttacaaacttcagactctacaggttcttctgcacacaagaatcccatatcctcttctggtagataacgcagaatcatgtttccctttactgcgtatctgcctttagaattcttgtgtctataaaaaactcttttctaacagaacactccttgatacagatttagtatgcctttacctaggtgctttccgtatatagtgtgatcttaatagtcacttctctgaaatatattgtctttactgtgtgcaaacttaagtatttgttggggtcttagatcaaatgaatgtgttttaatccaggcctaactgactataaaagaccgtgtgcttcgttaccatgcagggttctacagattgcatacatcagaatcatctggaatgcttatcagcacctcattgcatctggtactgaatctttgtctttgggtatggggcctaggaattgttagttttacaagctcctcatacatgctgaagtttggaaatcattgctttaatattatactgcatcctggttgcactgattccttcacaatttgaagttcttgttgtcttaggaagagaagcctataggctaacagattgccagcacccctgtgaccattactgtttgcttccctcaaaaaaaccacattgttgattggcataagtcctctagtcactacctcaccctgagctcagcttgccgacatctgaatgaactggcagtcaaagccatacagtgccaagagagttagcttcctaagagttcctcatgaaaaatggaagccaggttttgccccttgctttctatcttgaattttgttaaaacaaaaactatttttatctgtggaaacaagcatgtatgccatctgttttctttgagatatcaaagttcagtattgtttttaattcagcaacaaatatttattttgcccttccatatgatgtttattcatactcgtctccttcaccctaccagctttatctgattaaattcagtctatacattggtacattaatattgtctgttaatttttttcctaattaaacctaaggaattgtatattttaatatactgtgacactctatgtattctttatttcttcaaaattatactcctttggaaatgtacaaataatgcgtatttgtatctctgccatttcttaagcttattatttaggcacataatatatataatattagacatgctggtttaactaaaataagctattcattttgttttcttccatttatattattgtggttatataggttaatatatttgaaaaacatgagaaatatattataattaaattattttgaatttcatagtccaaacaagtaaaactaatgttgttctagcactgacaatgagacaaagaggagtcattgaataattaggaaaaagataaaaaatatctagattagcaatgattatttagacatgaaaaacaagatgatatctactaaaatgtatataaactgatattcagacatattccacttgtcataattaatttgagccttgtgtatgatattcattgcttctaatgctcccacaatttttttctgtcttatggagcccatattttctaagaaacgtcatagggccataaggacaccttgccttcagatgcataattcattaggttaaacagtgtatgtcattggcttgggtttctttcttcagggtgctgcccaagtgcatcagaaccctgtttaactggcagcaatttgagatgcagaattagcatattgtttcttggggaatgcccttgaatgtgcttgagtagcttgttgtgtaaggcatgaacagaattgccaagagccagggaagaaatgggttccaagcatcatgcagtaatcctgtgtgcctgtgcatatctcaagaaagctcctcaggaaatgtcagatcattgctgaatgattaacgcacagacattgcagaccagagttatacctggggactcacagctcactcatattacagcacacctgtgcaaaattccaaagcgagggatccctgtggtgccaggtaagcgtctcaccttcactactaatgctctaaagttacagctgagaaattattgagaagttaagctacaactttgctacaacttgaaaacttacatttttcacctttgtggggatggagcttaatatatttgtgtcctgggagagacaaaatgtagaaataaatagagggctggcttggataaagtatactaaaaatgtgaccataaaaagatgtaaagaaaaacaaatcaacttccatgtggaccaatcatgagagcttagaaatacgactttttattaatctcacatgccaagaaaccatcccttactaaaatgatggaatggaatatttccatttggcaaaatgcttgcaggtgaagcaaaatttaatcaatcaaattcaaatattagtaaaatgaggagaaataaactctaggcaattcataatttcataagaactctcatttgtcttttgagcaaagaataaaatagctatcattgcttttaatcactggagaaccagaattctttttagacttccatcacttactgttgaatatgcttgtgtatgagtcctccagtgttctgaaccagagaatagtttctttatgggatttgtgtctgctgcagaatgcttggaggaatatcatttttgcttgcagaaaattgaaataggcatggtctatgtctcaagtgcattttaaagtaggaggtcaagtacaactccttggcaagtgagaagcagacataataacaaaacttcaaaccctagattgtcttcatgtaaccttgtgggtctatgattctaagaaaatcctacatttaaaaaaaagatgggtgattaggtatagagagcaatatacagttttctctgatgatactccaaaaatggattcttaagaacagaccctgttaagatctttccatgttgctaggagcaattgttaccataggaacaatggtactagtaagcatcatttatacacacataacatccaacccagaaagtgatttaattaaattacctttacaattatatactgttgtcttttgcagcgttttcatgtgtatagtacaacttattaggccctcttttaggtaagcttatgtaaatttgctcactggtaactttcactggtttatatcctcaaccattttgttacattgaagtttagtctttctttggcatagaagaaaaaaagattcaatattctgagctcaattgtcatttttgtagggaactttgagtcacagcagtgatgggtgctcagccctgatggggctgctataatcaaataagaaaatcaaagaaaatgttgacactgctgcagatttagattgtgcttcacccacaacccagtcattttatgttgagtattattttgaaaacataaaatcagaacaagtagtcatcctcaaattccttaaaacattctttttttaatttttcattaaaaatcacattctctgatgaaactgaaaagaattcagctcgagcaacgttggaaaatgctcctctacttccccccttaaaagaatagttaattagactatattacagatactgattacaggcctgtggtttgctgttgaaagaatatgctagctcaggttacagatctttctaaagccgaaagaaagaagtatgaattcaggttgtaaattgttaacatattgccagaaaacaaattgggagatgcggtcctctgctgtgatgtggatttgtgccatgattgtggatttcctgaaatactcttaagtagagagtcttaggtactggggaagataaagcacaccacacttgactgcaacaggcttcagctaatggcacatccatcctcacctccttgatctgtcatttcctccaaaattagctcatttagtttacaatgcatcaaattacttttcagtctctatcaataaagtgtgccatctattattacaactgtggaatatactggcaggcaccagacttatttctcctgaatctcaaaagtggacaggaaaagcagagtcaataacacctattagcaaggattatgcattcagcagtgtatataaaatactgggttctttaaaatataatagagaacagagctatcagtcccagggctcaaatcccttccctgacatttttcagtaagacgcttccttttttaccccaccgcccagaagggcatgtctcagcagtttcctcagcccacattgggataagggaaagaggcttctgattttctgtgcaaggaccctttccaagagcatccagatgccaggcatccatggcccaggatgtacaattcccatttacaaacaaactgggctagacagcaccaggaggtagatggctcttgcaacaagacccatcatctgggtcagccagtgcaactattgacccgacactaggaagaccagaatacctctcaaacctcttcacaccctggctcatttcgtttaagagacttatttcccaagaaattggcgtgggataagcttctaataagctttcactttaaattaccaataattctgttttaccttttcaggggagaaatactcttgaatccatctgcactgtcaaaatcaaaacactgtttcatcctatttagctatagcctgaaggcactttctaaattttgtgtcatgttagtgtttaacacattcagagcttggtaccctcagtaacgaagagtttcagagtctgaccttgccctggacaatttgtttttttcctacaaacatcatagaaagagcaagaaccttggtattagcaactttctaagcttcagtttacctgtatagaaaataaagaacatcactttactccataatattggaatattaatgaggatcaagctagataatgcatataaaagtacacaggacagcatccaaattactactcttgttcatttctactcttcccttaaatgctttagatggtaacaaatccacttaatattctggaatgtgtactatacatgcttaataatatattatctaattttataaatctctatagctttgactcatcttgattaaaaacatatttttctaattttatttagaatattaacatttttaaaaaatatgaattaacaacctttgtcattttgttatatgtgaattttaaagatcataatcttcataactcatcagaaatatttaaattaatatttatttttatctgattctttctatgactttaataattttttatctaattctttacatgcaataattagtaatagctaacaagtgtatggtatgtatgcttacaatgtccaaaacaccatgaccatttttaatgattttacatattaaaatttactactcatgacaacaacccaatgagattgacatcattaccaacagcctagttttgcaaatgtgtaaattgtggcacaaatgttttatataacttccccaatataacacagctaatttttcaaacccaaatagttggaccccagaacccaagatttaaacatagtggtttttttttttttttgtttgtttgtttgtttgttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacatagtgttttaagtcctgtggaggagagggaaaagcaaaaagctaacagcacaacaacaaaacaaaaaccacttcagacttcaaggagtttttaatcatgagaatgtacagcctgtgtcctaaccatctttcagccctaaacatattcccacagacaggcagcacattcatacaccctcagacaacacactactccgtcctcacactttagagtagaacgcaagttacaagacaatgtcaattaatgttgttgtaggaaacagtccattggaaggactggaactgtcagctgtatgtcaggctctttccctgtactgtctcattcaatcttcgtcactttagagaaaactgaggcctaagaaagttcattacctttctgaagaccacacagataattatgaaagttttagaattcaaccctcattctgacttcaaagcctacaacaccaccacaccacagtacagaggccttaacccaaacttccagtttgagaagacaatgctttgagtagtgtgaaatgctaatcttctccagacattcacctcagaagccaggagacattaataattaaacaaaaaggagtgtctgtacttcaacaattctggaaaataataaactttaaaacatgaccttatgaaatgatatggtagaagaataaacagaggccattgaagttcatcaaaggatgttttctgaacgtttttagatctgacctgggttttaaaaaaattgtgtaaagtgtctacaaagtaaaggagataaaaggctaaacagcatatatctactacttttttttgagatggagtctcactctgtcgcccaggctagagcacaatggcacgatctcagctcactgcaagctctgcttcccgggttcaggccattctcctgcctcagcctcctgattagctgggattacaggcgcccaccaccatgtccggctaatttttgtatttttagtagagaaggggtttcaccatattggccaggctggtctcgaactcctcaccttatgatttgcctgccttggcctcccaaagtgctgggattacaggtgtgagccaccgtgcccggccagcatatatctactttaaaaaataaataaatcttcagaatgtacacattgtttgtaaactgaatctttgtaatcattaccaaaaattaagctgtctactcttcatatttgctctcttcctccacctcttagctaatataatatttattcttagctattatctcctttattttctaagtatatgaaaaggaaagacaggcctttagaaaatatattcttagtgttcccctaatcacaaactttcttgaaaattaaaagacaaagaaaggagctgaagtatgtttaaggtgtacagcctattttttttctagacttacactgatttttaaaatatttttgtgaattttgaaactgggggaaaaagagtgttacaatgttcgttacaataattgtaacttaaatttggacaattttaagtaggctttgtgaggttaaacagtattaacagatcttaaactcaaaagtttgataactataactacatttcttacaatacattcagtaccaaatgcaagtagctaataattaacttgaacagtcccatcacaatgattaaaaatatgtcaactgacacaaaggaactgttatacctaatgagttcataaaagtctgagattacctacaggaagaaatatgaaatatcaatcctgaatattttaatgttttagtatttgtaagtcagggtgagggtcaaacgtaaaatttttcaaggatgtataagggaatttgtatttggtgaaatagtaatgaatttcagcactaacatataattggtttgaaataggaagttttgatgccacatctggagaacagaataatataatccacaacaggtagtaattacttactgaaggtaattgtaatgcagcttgagttgtaaacattaatgaaaaaaaagatttctaagcaaataaaatctcacgcatcaaaaagacaaaaagtttgtgataaatggttcatttaggcatgcagtgctgtgtgggcaaaattggattgcaatcataggcatttcaaaaaatgaaaacattaggagaaaagaaaattggacagaaatggcagggaaattacagcctttgatccattccgaagaacttttttttgaagcatcattatgagtgggcagcaaactccttccaatcttctgttaaaacttttatgaaaccctggagaccacaaggtaaaaataatcaatttaggacagaccatggaaatatttttcagtgataatctttttttcccgtaaaattgtacaaaactaattccaatgttaaattgctatctggtcttgaaattgacacttttaatttcaggagaaggtctttcctgaatcatttttgacctcttcaactaacgatcagttattagacacatgcttcacggtaaattatatggagatggcacaatttcacaaaaataaagagtattgtaatgctcttactgatatatcattgagaatatcatgggtccaagaatcatacctttaataatcacaccttgaaacataaatgggcactatgctatggaaacagatctttggctattgtaaataatgcactatagtttccaaagggctgaggtgctatatctgtatgtgcaaaaacttaaattaatccctacagctttgaaacaatgatgatgatagacttgttcaattgctattaaaatgtctgtaatttgattgtaaaccattaatattcgagattaccgattggctttccttattaaacactggtaattagtcatttcatgaggatttttgacctttattgttaaatctaggtttttaaattagcgtctcaatatcgtttaaattagttcttgtatataagattattttaagttattatctttggaagaatgttacatcctaaagttaaaaaggagaattactggcaaataagtataagaacattactttatatttgagtaaatagtagctttattcttctgagagggctgtttaaatcagatttacaatgcctgaagcaaaatctagatttatttttttactttatttgacttgactacattctgttttcattaacattttctatttgaccttttgaattatagaccccttctaacctaaaaagatgttattatgaaagaagaatgtgtttgttttgtatctttgaaagtgaatactggttttattgctatttgaaaatattacttaaaatatagggaggtgaaatttcaaatgaaatgactgaaatatgttttttctgtcaagatttttaactcaactatgggtaaagtagtttctaggatttattaatctgcaagttctataactaaaatgaatcatttgcatgacacttttaaggttgtaatggtaatttttctaaattatccctaacaatgtttagcatcataaaatagtttcctaaatagcctttttcttaggtcattgtaacatataacatatttttttaatctgaaagagatgaaaatccttgcctttgcccttgaagaatccatactttatggaaaagattgataagtgataaatttaaaaatagggtgatgagtgctgtaagggaggtgcttaaacatcactgcctcagggactgctagactagattatatcccctgtgatagactgccttagcacactgaacttcccctgttaaaatgatccacattctacatggcaattacgtttttcaaatctgtattcataatagaccataaactctacactggccccacaccttctctcttgctcactatagtatcttcaatgccaagcatcatttctgacacatagtagctgacttatacatactcactgaagaaataagtaaatgagggtgaatgaatgaaaggtctgaaacggtgttttgttatgtaacccagattagactagttttgaattttttatttttaatttataaatagtaattgtatatgttgatggggtccagtgagatgttttgatatttgtatacaacatggtataattaaatcaagtaattaacatatccatcagttcatattctagtgtttcatggtgagagcatttaaaatctactcttttaacaattttgaaccgtacattattactaactgtagtctccaacagatgaataaagaaaatgtggtatatacacacaatagaatactattcagccattaaaagggaaattctgtcatttgcaacaacatgaatgaacctagaagactttattctaagtaaaataagcaggcaccaagagataaatattgcatggtctcacttatatatggactcttaaaagtcaaactcacagaagtagagtaaaatggtgtttaccaaaaggtgtattggagaagaggggtagtgggactttggtcaaaggatacaaattacaattagacaggaggaataagtttttgagatgtagtggacagcatggagacagaccatagttaataataatgtatatttcagatcagaccatttttaaatgggcactgaactgtcataaaagaaattccaagtgaacatgatgaggagggcacaaaaacaagatgatagtcatgccaaggtgcagaggtgagaaagagcacagagcaagttaaatcaactgcaaggaatctggaatgattgggcattcatagaatagtattgcagaataattgcttaagatattatattgtattttgttgttgccctcctccatttcgagcaagtaacccattacttgtctaaaggcattttcttttcagagaagaaaggagaaacagccaggagtcattagcagttcttgttttttatgagagtttaaatgtattgaagagatacgttaagtgcctagaaaaaaggaaaataaaggggagcatgattttgaggacaaggagggaataagaagagcgactcctcgagataagaaaggggagctagtttgtcaggaccgtaagacaatggtaatgactgtgccacagacccagaggctgctggcttcacctcagagtcctgtgtcccaatgacagaatgaagaaaagggaagatggggtgataaacctattgaagaaaccacactggctgagaaattgggcatgtcagaggtgtcaagggttggcagaggaattatgaccagaggaacttccattcctgcttggcattcagtaaattcctgggacttcggaacaacctggagattataaagttccatatttactaagattgacattcccacctgccaggaagaatgggaacttggagtcagttttaagatgatttatgaaaataaataaatgcagtagttttgtcatttgaatttgcaacttgaaattcatatgtgctacctaacctagaaagacaggttagaggcacatcactgaagggatcatatatcaagctaatacatttgaaattgattctgaagagagtcggccattaatggtttttaatcaggagaataataaaaaacatcaccctaatgatgacaaaaggttggactggacagcaacaagactagtgggaagttgaccaggtacagccaatattgcagtcgagttgatgagctggaccaaagattatgagtatagaaaggagctgatggtttgagagctatttaggctgtagaatcaccttgattagatgtctgtggtgaagtaaaaacaaacctcagagcactcccaagttcctggttcacagcagggcagtacagaggagatgtaatattatcatttgtcccaaaaagtacgagggatgtgctgacgagagaagggagaaaatgatatggagttcaggagagagaaattgggggcttatcagcaaagttgaatgtcaaaccacataaaagagacatggcccagaaatgtatagatagtaaaagggctgagaaaagaactgtgtgtattcaggaagtttcaaagaagactgaggaagagtgagcacaaagctagaagaacagtagagaatgatgtcacaggagaagtgagaggagaaattttctggaaggagagattagtcaactgtgacagatactactaaagggagagaaattaaaataaacttaggaaatttgaacgataagactttagatgacctgcgagaaaagaatgtgcagatgtagggggataatgtggaaaccagacttcaatgggtcaaaaaggcagttctaagtgatgatgtagatatgttacagaatttgatcaggaggagagagggagatgcaggactctgaatggtttttaggacataggaagttggcagtggaaaggagtgagatacaaacagacatacctcttctattggcatggaagggtggttggaatccttatgaagtgagaatcgttttgcactttgtatagggcagttagaagtggaagaaaagtgccagctatcacggagattgttgtttgtttgcctctattttctgaagggaaatgtatgagagaggaattatctgttatatgaggaatattatgtgaggaattatatattcctcatataatctcatattacctaaatatttatccattatatctattctatgagaaattgtgtggaggtatctctataaaatgagaaaggaattgtatgctgagagtgaggacacagcttggaatattaatggtttagaagtaagcatagtaagtatttgaagaatagaatggaaagggaagcttgactagggacaggtgaaaggggtattatagaaatttttgctaggagcaaagctttcattttgggtccaaactatggaaactaattaactgatgatgcttcataaaaagcaagaaaaatgtaaaaaaaaaaaaaaaagtaagagaaattaagacctaggagaaaccttaggttttacccattattattatccttctcatttatataagaaaattattacccttctcattatatataagaatattcaagaccctttaatttaaggtaagctacattaatcttgacaataagctataagtgcctatttcccaagttgtcatcgatgaccaaaaaacaaccccaaaaaaggcattaaactcaaaaggaaccctcactgggagaggttgagggaaacggggctgagttctagcccaagacataggtatttccaaaattatttaatttcacaggtttctcagcttttgtcatctggaaaataaaaaccttaaatttaatagtacttatgatctctataatcaattggatgccaatcagatcaaattcacctggtttcaaatttaacaataaacctatgcccctagctagctatctggaaaattgtaggtcggaagaagagccattgaacatgttagaaaactctgttctgtttcactacctaaaagaaaaatcgagttacaattttgatggtttattggctaccctaatgcaatctatgttataggatggctgtggttaaaaactcagttgatgaacaatacagacacattaattatgactggaaaaaataaacataagcacagaggatataatgcattttgtatgtaaattatcctgccttatgataatcaaactatgcagcaatggtaacccttcttactataatggttattttcaaatgcttttacttcgttaagtggacttcatagatgataatctctgacataaaaatcattcaattgtcatcactatttcttcagaaaatttgaaagttcataggtctttacttaaaatgagtcattacgatggtgctatttttctttctactgtttgtctgcccatgtattcaattagacatttgaggttcagaaataaaatcaagttgaatgtttatcagttggatataaaacatgtacccacatggaaatcactgttgctaataatgttgtctctattttacagtcagagaaattgacattcagaaagattaaagaactatgaaaaccaagcagattttagttgacaaatctgagaatcaagcccctgactttataaacttaaagtccattgatgtccactctatagcttagacttcagatacattctgccaatcattagtgtgaagttaggctgagacctactagctcatgttactactaacctgattcttggttaaatttctgtggtgtatatcagagttaaatattcacaggtatgttaaagagccactgaagagctcttcagaagctcttcaatttcagaagctctaaaatttcagaaatcacaagaaaactattattttagtttagttaaatgttaccttaaaatattggttaacatgtattgagtacttaccccattgttatgagaacattatgggtaggaatttatttaatcctgaaacaactctatgacataggtacgtttttttctccttttttttttttaataaatgagggatctgagggacagagaagttaaataccttgacaaggtcatacagcttgtaagttttggagctagattaggaagcagtctgaccccagaatctatgctttacaccactgtcaggtagagataatggggggaaaaagagcaaaacattgaattcaatgattacttacattttgatgagaagcaggaaaatccctgtagagtgaagcatttagaaaataatggtgttggggcatgtgataactaaatgaggaccacatagtaacaaacggagagaacttcaaacacttcgtgaaagggtcactgaggacatattgcttcatagtttcacctggaatgtgtgaagataagtttagagggaaaagcatatggacttgaggccttggaatcaacatgacaactaaggttttgggggaaaaaaatgctgtttcactccactgaaggcatattgcaccacttagaggtgcttattactgaatacatctaccaagaaacatatgaaagagccaggaaattatctctactcccacatgaaacagccatatggccatggcaccacaatttcactcttctaagctcttaagctcaggatctgatgagcaagaaaacataaaaataaatatttagctaaatttatgagccaagtgtagaaattaaaagtatatcaacatcaagttaatggaaacaatgaaaatatattataaaaacagaaaaatacatcttgctaaaggacaagctaaagaactatgttcattgccatgaaagaccaaacaaatgtaagagagataaaaataaagcaagagattataaagagatataagaaaaatcattttattgaagagctaatcaaatattagaatgggctgccaagagggattatagaggctctgtctctgaatatcagaagggatgctgttcatcctcattagttaaaaattcagatgttggaaggcagggactccctaggatcccagtgttaatatagaaatccatactcagctgtaatcattgtctctgaggcattaacaatccaaacatgcctgagtttctctgttgacattatattcttttaaaatagggtaaaactttcttctcatctaggcatcaaatcaactgtaaagattttgtttaaaatctgtgagtaatttagtagtgtcctagattcacagtgatgtccctaaataacacaaaatatgttttaatgtactttatatatcagaaaagacagcctattacagttatgtttccatcaatgcattctttatcacaattacaaatatctagtttcacttttaaaatgtgcattaaaatggaacaaacttctctgacagacttttagtgatgactccatttcagaagggaaaaagccaaagggaattcttctgttgccttccggcctctcttgtgtatttcctcttcacagagtagaacttgaatactttcaaccaaccaacgtgagatgggaatttgttaacaattacataacctcagtggataacttgattgcctaatcagccattgttacatgtgtggagcaaattactaaatcatgtactcagtctctaaccaatcttcctagaggaaaaacatattaaaatctacttaggtctaacatctggtcattgtatatctatcaagtaccgtatgccaagtgtgttacatatacgacttcatactaagaacaaccttggacaagatgagtattattattattcattttacaagtgacaaaaccggaactcaatagggtttgacagaatgaactgacagaattgtgaagctaatccagagaggtttatctgacttagaaagcccaccatcagtgagcgaggccgtatgacctcattttaatcagggaagctcactggtgttccttgtatacacagatggcttgtacgggtaaattatctgtgtatgtgtgtaaccctttaaggttgtttgccttcagagactattcttacccccaaactgcctgaaaactgtaggctgttcagttaattgttgtggttgttgctgctgttgttgttgttgttgttgttgttgttcttgttgttgttgttgttatggagtctcgctctgtctcccaggctggagtgcagtggcatgatctcagctcactgcaacctctgcctcccaagttcaagcaattctcctgcctcagcttcccaagtagctgggactacaggcacatgccaccatgcctggctaattttttgtatttttagtagagacagggtttcaccgtgttagccaggatggtcttgatctcctgaccttgtgatctgcccgcctcagcctcccaaagtactgggattacaggcgtgagccaccgcacctggcctgttcagttaatttttaattcaattatttaatcaaaaatcatcaaaatttaacacaacttaaaggttctgattagatgtactcagtgacttcactcagagaagggtcctacttggcgagcatgactgtcacttgtcacaagcaaacacttccaggtcacctttcccctcaccaatacaggcaggaagtgtccagagcttcacctctagaattggcttaggcaagagagagacagactgatggggaggaaaagaggaggagggaaaggcggtgtcagggtgaggtgcagagaagaggaacttgtagagttcaagtagactgcctagactgatcctgggtctgggtcacccatccctgctcctgccacctctgcacctgctgcagttagtaccctctcctttccactgtcaggcaagcttgtcacgcaagacaaagtgaactgcttgccgtttattgcaagggaactttttagcagtgacctttaaaagcaccacatcctataggcatgactatcattcaccctttgcattgatgcaggtggctgaagtatgacaccaggttatgcaccttgggcaattaaaaattgcaaaagacagactgacactaggtgaaaaaaccaaaatagctacttcagaatcaacctccatcccgtcgctatttagagacttcttttttgaaatagaaagtgacaaaaagtcccccactttaaatgaaacctaaacatgtttaactctgtctgtacaaagaacctgacaaaaataatgtactcatttgaccttatatgataaatatgtgcttccattccatgttggtttgatggtactgttcatctaataaatacttatggagtattggacaaatgtcaggaactagattgggtattaagaatataaggaaaaaacaggatattgtcactgccagtgaaagactggctttataattggaaaggcaaacaattataggactttgtactaagagctttaaccttactatgccctggaattcttctaagtgatttaagtatattaacccaataattctcccaacaacttttcacatggttgctattattatcccccattttactaatagagaaaataaagcacagagaggttaagtgacttactaatttatttattaatacctctgaaactaggactcaaactcaggcagctgactccagagtccacatttacatccaccatggtataaaggagcagtccccaattttggcattggggaccagtttcatggaagacgatttttccatggaccagtggggaatgaacggggtggtttcggggtgattcaagcacactacatttatcatgcactttatttctattattattacattgtaacatatatacatatgttacaagtaactacatatgtacaagtaactacataactcactatcatgtagaatcagtgcgatccctgagcttattgtcctacaactagatggtcccatctgggggtgatgggagacaatgacagatcatcaggcattaaattctcatagggagcacacaacccagattcctcacatgcacagttcacaatagggttggccctcctggaagtatctaatgtcactgctgatctgacaagaggtggagctcaggtagtaatgtgagcgatgaagaggggctgtaaatacaaatgaagctttgctgcttacctgccactcacctcctgctgtgtggccttggtcctgagaggccacacaccagtactggtccatggcctgtagtttggggacccctgctataatcacctaaaataagagagtgaccctttcaggggaaccaggaaatatttctgagtaataataatagatgataaaaggccaggcatggtggctcatacctgtaatcccagcactttaggaggctgagtcaggtggatcgcttgagctcaggagttcaagaccagcctgggcaacatggtgaaaacccatctctacaaaaaatacaaaaatatctggctgtagtggagcacacctgtagtcccagctattttggaggctgatgcaggagaatcacttgagcccaggaagtcgaggctgcagtgagctgtgatcacgccactgaactccagcctgggtgacaagtgaaaccttgtctcaaaaaaaaaaaattgataaaagataggttgaatttatagtcaaagaaaagtatttcaaggcaaaacatgtagcatgtcctgaggcaacacagtttgttcaaggaaccttgatgaagtctgtaaaaaatggcatttaaagtatgtcagagaaatgaagaaaggcggggaaattacattaggaccagattggaaaaggcctcttatgctttgctgaagagtttgcactttatcctgcaaacaatagagagacagcaaaggtttccaaagcaaggaaagagaggtgaacagtaaggtggagcataggctggtggattctctccaaattatagaaaacgcaaaatgtagaaattaggtaggtttagagatgatgcatacatatcatattcagcattttgttttctaagacttatcctgaggactgacaaagagagtactggggagtgaagacagaaagaggaaacagaagacagaatggctgggaaggttgagtagtccccccttatctgtggattgctttccaaggtttcagttacctgtggtcaaccacagattgaaaatattacagtattttgagacagagagagacagagagatagaccatgttcatgtaacttttattacagtatattattataattgttctatcttattatggtaattgttgttactctctcactgtgcctaatttatacgttaaactttatcataggtatgtatatgtaggaaaaaaatagtatatctagggttcagtactatctaaggcttcaggcctccactggggaaattggaacgtaacccccatggagaaagggagattactgtacacagaaaaccattagcatgtttcatcaaatctaaggcaccatcgactgtagagcacattaattttaagaaatcctaagaaagaaaaatacttccagttaaacaccgtctgttattagatacattccaatttctcggagttaaaatgtagcagggaatgcatctcagaatctatgaaatattgtataataacttaggcaaaagtagaattgatcactggttccagccactgagtaaatgagaacataaattaattgcaaaaatacttattgagtgttgcaaaaatacttactgagtattacatggaaatataatggagatgttgagaataaatggcggttgtgattgaagggaagaaatgatcatgttttaagatatttagaaaatagaactattaggctttgttgtgctactgaatgcagatggtgagggagagacatttaagtgatgtctaagatggctgatgaggtaatgtctttaagaccaaaagggcaaaaagaagatcatgttgggctatgacatcaagtttggctttggacatgctgaggttgaaatataagtaggacttacatgtgggatccccagcaggcagttggaatattggccctagctcagaaaagaagatagaactagaggtattgattttggatgcatctaagtgatgtggtcaatgaaaccatggaagtggatgaagccacttacaaaataaaaagtctggctaagaagttatgttcacgtgaactaagggaaagcattagaaataaatgaaaggagacagattcaagacatactgtgaagatgtcatttctaggtcttgataactgatgatctttaggtattgagagaaaaatggtcccaataagagatacagagaagttaagaaatatagcagtttagttggagaagagtaaaaatttcagttctagatatgctatgttgaaagtgctgccaagacatcaagtgaaaatgacccaagaatagttgaaaatgtggtctatatttctggagatggggcaaatctagagatgtaaatttgcaaatcatctattcatagtgagaattggtgctgtggcataaaagattgccaagagaaaaaatataaagaaatagtaaaggtttcaagcatagaaccttagagtaagctatacttagcagaagtcatgtggtgcataatgaccttttgatcaatgacagactgcatttatgatagtggtccataaaattataagactgggccaggcgcagtggctcacacctggagtctcaacattttgggagttccaggcaggtggatcgtttgagcccaagagctcgagaccatcctaggcaatatagcaaaaacccatatctattttttaaaaaacacaaaaaatattagccaggtatggtgggtgcacctgtagtcccaggtactcaggatgctaaggcagaaggatcacttgagcccaggaggcaaaggttgtagtgagccaagattgtgccactgcaatccagcctgggcaacagagtgagatcctgtctcaaaaaagtgggggattataagactgtatttttactttaccttttctatgtttaaatacatttaaagtacaaatacttaccattgtgttacagttttgcctagagtattcagtacagtcacatgctaggtttgtagcctaggagaaaaaggctacaccatataacctagcagtgtaaaaggccataccatctagatttgtgtaagtacactctataatgtttgctcagtgacaaaatcacctaacaatgcatttttcagactgtattccatcgttgttaagtgatgcatgccttatgccaaataatactatttaataaaatactaaaactactactatataatggatgctgacatgtgtaagacattttacatctgatttaaaatacttataactgcataacagataatcaactgtctattttacaactgaagaacatctgaggtttagtaacattcccagggtcacagagctagtaagtgactgagtagggatttgagcctgaggctctttcttggaagccctcatgtttcatactgcacccagcctacacaaagcctatcctcctttaatttttatacattgctcttacttctttatagagtataatatcaaacccaaatgcttacagaagacacaagtaagtaacatatgagagaccctagctgggtctttccctaaggatatctggaattgtatgcttctgacactggcatgcttcttttaactatgaagacatattgttcgattccacacacaaagaaaaggttttcttgaaatatgtgatcttcttactctattctcatttttctgtattttgactgaaacatggaaacaagtatttctctaccataagaaagcaacaatgtaagatgatgttaagagcaccagatacttgaattcagttttgtgtacaataaggaatggtgagaactattgcaaaatggagagtaaaactccatctaaaaaggtggcaaacccccaaagctctgtgttgctcaaatttcagattttgtaagggaaggtggaaacttaaaatattaggtgaagcctcccattgataatgtgactcattattttaaatactatgcaagctaaagaaaaaatccctgtgggcaaaatgcacttcaaaagatgacaccacactgccttatattctcgaaatttaatatttccaattccttcaacggtttatgttgcttgatttacaaaactttatactctcctttgaacagagaccattctattcactgttcctcttaaaatatgacatctagagctaaacaaaatcatgcagcttctctctggccttctcagaattcagtgaaactgctactatttttgtgctgagcactatatgctaatgtaacctagtattgcattagctttttctttttttagcatttacaacattttactggtgcctaatgagttttagtccataaaaacccttagttattttttcacattaactgccgaggtaaatcttaactcatccaatacttacaaagaagcagcaattttgttttgaaattaaatgcaagactttacattttctctattaattttttatggtgtagatagagttgaataaactttattttatttatgtgggcccattattctagatttcaggcagagttttcaatcatctgtctctttccacagcttcaagtataaggatctacaattcattatatgtactgtgcacagatacaatgaatgttcctgagaaatctcatccaccaaggtgcacacaattttaaaaggttcaaatcagaattgatccataattagaatattacattagcctttaagaactatccccacagcaccctgcaaataaccacagcattatctgtatttgcctgccttatgtatatgcacccagagacgtcacactgagtgggacacctactgcacacagggtgtcatttcagtaatttcatctatttggctgcttctgctatcatccagaactccagccttaagtcctcttcagtgttcatggtaattaggaaattcctttctggcaactgtaaacatatgtttgatcatagagaacattctcttcctgttcctctgtttaaaagaactaacccataaacatcaatttatctggctcatgggggccttgcactccacatggcttcctttcagggaactgtgtaggctacagtatcaataatgaaagtagctcatgcatcctaaggggtcactatgtgccaagcactatgctgtgcactttatgtaagtcgtctcctatattccttgataacacggtctaaagaaggacttcacagccaaggaactaagatgtaaagaacttgagtagcctcacaaggtcagtaattgtcagggtcaattttccaaaaagcctgtctacactgaaaactctgctctttctattgccgttctcgttcctctgcaggtcagctgacccttcctttggtgtagtcaaataaattaccagttggacagcagcacccgccatcaccaatgaataccctgtgttctgtgttctaaagagctaatttggcaggcatgtatcaaaccctaaagcagagttccctcatagtccactactaagtctatactttttagcctttttaaatcaaggggagtatttttcaaacatttttctcattgtttgttaagtaggtgctttagagctcaacatacaccttcatttcttcaatcaggctgttggtaggatattgaatgagaaagaattctgggctgtgccattgttgtatgactttctatcttttttccaccatgacacagataattgacatacatatctgtatcatgttcacaatacccattgcactcctaattctgaagcttcttttccattaaaaaaataagatcacaagcataaaataaagtaagcatggtattatcgtagggacaacatcaaatcagttttactttttaaaggaagtaattaagaaatgttggtgctttaccatcggggataaattactggtgtcccaagacactactgcggaggaccacttagcttgaagcattcacagagaatttagtgggcatcttttctttaaaacttccattgttccaccaactattaattcatctaaactagattgccctctcattcttcatttttccatttgcttttacaaaaaatgttgcaagaagttgtgcggatgcctcactaaattaaaaagtatgtgagtacgaataaatatttattactttttcatccacatcaggctttgctgtcatgagatgagaataaagagaaagacctatgtccctttacctgccttagagcatgcccagaaaaaaacaatatagagagaaatccttagtaattgcttctctcagtggctgcaatctctgttgagcctcttgttttgtctttggaaatttaatgtttaattatttttaatatgtcaaaatattagtttctcaagagagaggctgtgcagtaacaggcatttggagatcattggttgctttgcaaagtggatagattagatttaaatttattttttaatgaatcaagaaatatccagcttttacatttaataaataagaaatggcaaatgaacaaagggaaatggtgatgtagacagaacccggcggatacctaaatttctgttgagggagatttatccctgtagtttaagactttgatataaagtaaaaggcaaatatctagagaggtaaccttttggctatcattggtcttttgtgaaggagttggacacaaattttgataagaccgtagaaagagaggaatcttatactggaatccctgtggaagtgagaggaaagcaataatagggttgttggttttttttcattatcttcaaaatttttgctgactagtgtcccattattgtttagaaacgtaatttttcttagacaagtatcagctaagctcatttaagagaagcttgctctgggtgacatttttgctgcatttatctttagaaacaatttttaactctgtttttctatgtcatttatggctgaaaattataattgaacagttagaaaaaatctctgttgattaattacatagcttatgtggtatttaaatagccaaatttattacatatttgtagcttgagagtattcttcacaaataaaagcttttttctgggctaggcaccatcccaaatcagatttagaacagtgttgcaaaggttttgttcactaaatgtattccaaaattataatgttctttaaggacggtatggttgctgattttatttgatggtttactgtgaagactcttcgattaaaatgtgtttcactgaaaatttattcttcaagcagacgccttagaaatttatcttgattgcaatggaagatggcaatttagaacaattatttatccttataataactcaagagcttttatcatcaagcacttgctatttgaagacctgactcccattgctaaataagtgaatattaatctgattgtttttagtccttataacataacttaatcttttgctaccctattgcatgaactgagtaaatattaaatgggagctgaattgtccaccttctccactgtttataaagatacatattaggtatgttacaatagaatgagtgctaaagcacattttcttttgaagaataatattctaggaaacttaaatttcattacttgctaaagatcacccatggaattcaattttttcttactttttctcattttgactacctgccttattgcacaaaaacatattactgtttacaagaaatcattatcctttattttcaaatggaaaaggcaaaccaaagacaataatcaaaattggatattatgtcagattcgtcaacttggaattctgagatttgattattcaaaacgtggaacagtacctataaaatttgtttttacctttgtaagccatctggaactcaagagccattagacctgcttttgcaaatcactgttttatacaaataaaacaatttttcagaaggcaatttagaattttgaaacacataccaattgtcagagtcagtctgtcaggttctgctcatcattaattttttaaaacatcaattatggtaaactctatcataattgcaatagaatacaattcaataatgaatataaacatttaatgcaatgcatagaatagaattcataagctgacaataatattggtctcttcatattctattcagggaagcccaagctctaaactgatatatacactgcagagactaggagacaaaggtaatattctgaagaagaatattttagggagaaaaaatgagaaaatgaatagccatctaggtcatttttagaccaaaattttatttaattttatttttatggtgtgatgcccaagtaatggttcaatagcatcacaaatagtcctaaaccctgggggataacatgctctccttctatttttagaaatgcaattgacatcaaaataggtataaaaatacctacctccctgggtcttgtgaggatcaaatgagatgatgtgtatgaaagactccagatgctatacaaatgttggttggattatacgggaagctttagagatgcctttgcacagtggaaggatccttggacttggtagttgaaaaaactcagttttgctagccatgttattttgagtaaatcatttaaatttaattcctctgtgtcatactttttacatgtaaaacgaggatataatttctaccacagtgctgttttgtaaatcacctcaaacaaaatgagatctataatgaaagtgctttataaacaatgaagcataatgctaatagtgtaacagattgttaatagagtacttattaaatatggcataagtaaaggaatgacatttacaacaaaataaatacaattgtttaagtgaaaaatctatgtagaaaggattgagaattgaactgagttcttctgttgaatacttaccatattgcgatctcagattccctatgaaaaggacaaagtcctgcccttgaaaatgttaggatttcaagaagacgtagggcatactttgggtatctacaagatataaaggaaataaacccaaaactaaaatttgcattataagccacttttatggttaaatctcattcctagcctgaataatactttttattgagaatcagttgtatagaaagcattgtcttatgtcctgatttctgggagaatgtgtgtgtttgtgtgtgcttgtgtgtagtggaaatggatttgaaaggtatactacaaaagaatgtaaatgtttacttctattccctcaagcttatatacttgagaaacataaaatttgataatacgaagaatcacagaataaatatcaaatgacttaccctagaatgtattactgaaacttattaagcctactatgtggaaaatggtctttaattatttttaccaaagaaacaagaaggtgaaatgtcagggactgaatatttgtggctatactttcccccaaaatctaataaattgcaattaaaacattaagaattaagaataattatgcttatagtgtaatacagcggtccccaacatttttggcaccaggggcttgtttcatggaagacaatttttccctgggggatgcagcgggctgggaatggggtggtttgggaatgaagctgttgcatgtcaggtcatcaggcattagattctcataaggagcgtaacaacctagatccctcacatgtgcagtctacaatagggttcactcaccacagggttcacaatcctatgagaatctaatgcctctgctgatctgacaagaggcagaactcaggcagtaatgctcattctccatctgccactcacctcctgctgtgcggtccagttcctaacaggccatggactggtacccatccctggcaggagtttggggacctctggtctaatacatatgtatgtacttaacttctttgtcttctagttattcctttagaaatgtaaagagacagggagcttaagagagacaactagatctggttagagccttatttgagtgaaagttgtcagattacctccctaagcctcagtttcctcatctgtgagggaagtcctaactcaatgggttgttgtaaagattcagcattataatcaacacaagtgaaccaaaaccgtgtcaggcaaatgcttgggtctcaaaaaagtgagagtttattaagtgtctcagtaatctttattcttaataaacccaccaagtgatagtttgatctggcaaagatgggacggcacacccagcactaaacttaactattctctttcacacagaatattgctagtttttactggtgacattttaattttaaatttacattttaaatttttctgatatagtcactgggaagacaaaggacagagtttgttacagtgagaaaataacacaattttctgaggtctttttcatgaaatgttttaaactggagctttgtctttggaaattcttgctcttggacatagttatcatgttgtttgaggttagcaaggatgtgattttgaggtcacaaccagacattgtttactgaatgtgtataagataaaatgagatgagagggtaattatctataggtttgccttaattagcagataacattttctaatttaacgaggcctcagtgataataatcaacagtcaagtttctaaatagctttcccatatctttgtggccattaattccctcatctttaagttttcgacattcttttcaaggcatctggaacacttgagcagcaattttccctgtttgcagcaatcaccagttgaatgcttttgtgaatgagaaattaaatgggttttcaacaatgtagatagttttaagtgagagtcccattgaaattatggatgaatcaagggacagcaggaagtctgtgattttctccatttgcaaatgtttttctaaaaaatgccatcctaagaacactttacagatattaacccattaattccagtgcctcatttttttgaagtaattcttattctttctttatggctccaaaaattcacagaagaatagttagcaaagcagcagtcaactatccacaccaaattttataaactgcattaaatgtactactattcactggaaaactcttataaaatatatacatgcatgacttacaaaagtataaattataaatggtatgaaaaatgcttcaaaatctagaaagaatgtaagaacttaggcagggaaaaaagaaatatatacaatcttatttagcgatctgcttattatcacatgaatttgtgagcagaatgatctagagaaggcctatgacatgtagtgaggcaaacaacattttaaaaactcctctggaagaagatggaatcaatgaagtttcaaattcacctgcaaaagttacaagcagatttgaactatgtgaccaaatctagctgcacctagatttgaaaggacaccatttggatttgccatatgcgcttctgagaaggagagaggtatgagtagagctttttttttaacttttaaatttaggggtacaagtgcatgtttgtttcataggtaaacttgtgttatgtgggtttgttgtacagattatttcatcattcaggtattaatcctggtacccattagttatttttcctgatcctctccctccttcacctacctggctccaaaaggccccaggatgtgttgttcccctctatgtgtccatgtgtcctcatcgtttagcccctatttagaagtgagaacatgtggtattcggttttctgttcctgtattagtttgctaaggttaatggccttcagctccatccatgtctctgcaaaggacatgatctcattcttttttatggctacatagtattccgtggtgtatatgtaccacattttctttagccagtctatcattgatgggcatttaggttgattccatatctttgctattgtgaatagggctgcaatgaacatacacatgcatgagtctttataatagaatgatttctattcctttgagtatatacccagtaatgggattgctgggtcaaatggtagttctgtctttaggtctttgaggcattgccacactgtcttctacaatggctgaactaatttacactcccaccaacaatgtaaaatcattcctttttctccacaaccttgccagcatccattattttttgactttttgatactagccattctaactggtgttaggtagtatctcactgtggttttgatttgcatttctctaatgatcagtaatgtcgaactttttttatatgatttttggccacatgtatgtcttcttttgaaaagggtctgttcttgacctttgcccacttttttatgggattgtttgtggggttttttgtacatttgtttaagttccttatggatgctggatattagacctttgttagatgcatagtttgcaaaaacttcctcccattctgtagattgtctgtttactctgttgatagtttcttttgctgtgcagaagctctttagtttaattaggtcctatttgtcaatttttacatttgttgcaattgcttttggtatcttcatcatgaaatctttgcccatacctatgtcctgaatggtattgcctaggttgtcttccagagtttttatagtttgaggttttacacttaagactttaatctattttatgttgattttatatatggcaggggtccagcttcaatctttttcatatgcctagccaattatcccagcaccattgattgaatagggagtcctttccccattgcttgtttttgtcaggtttgttgaagatcagagagttgtaggtgtgcagttttatttccggattctctattctgttccattggtctatgtgtctcttttggtaccaataccatgctgtttggattactgtagccctacaatatagtttgaagttgggtagtgtgacgcctccagctttgttcttttgcttagggttgcattggctatttggggtctttatttggttccacatgaattttaaaatagttttctctagttctgtaaagaatgtcaagagtagtttaataggaatagcattgaatctacgaattactttggatagtatagccattttcatgatattgattcttcctctccatgagcatggaatgtttttccatttgtttgtgtcatctctgatttctttgagcagtggtttgcagttctccttgtagagatctttcacctccctagttagctgtattcctaggtattttattctttatgtggcaagagtagaaatatttttaaggaagatgattcttgctcctactaaataactatagaagaggaagaatcatttggctttcacatgacttgtgtattataaataaaaaagttctttcaaattaattccatttactatgttttatatattccttccataattcacttattctattcagtaaaggcttagtctgccaaaaccactgcatgattttccaaaggaggtacacagtaaaaaaaaaatgattagaaccataagttctggagttggaccacatgggtttagatcttggctatactccttgctagctgtgtaacatggatgaactagttaatctctccaaacctcagtctcctcagctctcctattattaataaaatcggtttaataataatgtattcctccttattttaatgagaggattaaatgatagcatgttgagaaagcacttacacagtatctggcatattataaatgtccaataagtactagttattgttagaatttctggatttaaagagatcacttattttttaaaggtatcttgattgttactactatatcatgcaaatctttatctcttttaattatttatttaatgacagaaaaatactgtaaaaactgaaaaattcaaaattaattttccaagtgcctaagtaatttctaaatagagatataaacacatttaagttcacaataataattgcatttcattggagttttacaactactgcttggttctaaatgctttgaactagacagttaaacttctcatattttaaatttttttccaaacataaaatgcatacattgaataacctaactttaggtatactgagacttcattttataatgaacagttacatgaagagtgcctgctcccaaaaaaaggagttataatgcttcaattttaagtggtaagacatttactgggacacagagtaaaattatagtgaaaaatgtgaagatgctatctgaatagtgataagataattttattgtctatttaaagacaggccttggcaattggaaaatattagttaaatcttttttgagctttttgctgttattgttgtttttattatgttactagttttgctttctttcttctatcttataatattttccctaaagaatggggttagttatgtggggcaatctaatatgatggtatttataatgctctaaattaaatttttgagctaagaaaatcagtcacaacacttgagatttgtcaattttctagtgaattatagttatctgtaaacagttttgattatgaaacttctatgaaatctctcattattttgtaacttctttcccttatttattttacagactaagccattttctcttaagcctatgttagcagcatctccccttggaaatactatgatcatttgataatactgggtttcaaactctagatgcctttctcacattggcttcatagttcaattccataagtttgtgtcaagatactactacatgtaattcaggttactagagttcctgctctcaaaaaaaaaaaaaaaaaaaaaaaaaaaaaaaaaaaaagggagtttggcctgtccagaaataaaataatgtggcagaaaaggtatataaaacctcttgagattttagggaactgattaatagcatctctaccttttcacatcagagtcctgaaccaactaagaggtagaacaaagtatcaagctgctacagatcaggatagtagctttttgcattatgggcttaaatgtgtatccccaatttggttccttgaattgagcttacaattcagatcagcaatgctcccctgcaagttccctgtaagctcactatgcatctgatagagcagcatgcagcctcttaggaggtaggcagatggacagtaagaaccctaaatgtcctggactaagcgtgcttaatttcttcccccaaatttgtcagttaggccaagcatcctccccactgccccacctgggcaagatggatgaaggaaaggatcccaaaagatgtaaatgttgctccttttttcccctttagtgcatgcagtggaaattccccatcactcggttggaatatgaagagtaaaaataagtgttcccatcctaaaagagacaacatgaatttcaattcaaagaagaaagattccagatggttggaatgatcaggaaataattcagagagaagatagtatctgagaaaggcttaaaagaggaatacaaattaaacaggcaagatgaaagaaaagggctaccataaggagccttgtaaaacgtccagaagaaataactagaagaatttccaggcttcaaaaaggacccagttaacattggagtgaatttttaatgaatttagtcagtacgatttgagactttctttattaatatttaggaggcaaggataaggcagacatcataaagtgtttacagttagcaagtgccgtaatgtatatttaacttaatgtggcattctatgaaagtagtgtatcattacaatagatgttgtggagttcaggctctgttgctggacaaatgaaaccagtatctgtgtcagtctaggaggagtaaagaagggaaaataatgaacagatttatggggaaaagcagaagacagacgtctataatgaaagagaagttttggaaaatggattaatgcccagagataaaacccacactataattatgaaaatcattagaattttaacaaaaggaattttgagggccaaatagcagagggtcatcactggatgctgaaatcactaaggatgcttctaaaaatgttggcacaatgtggtgtaagctagtggagaaagatggatacccatcacagaagttgttggtgacattgatgaagaattaaatagcataaatacagaaaaaataagtggcttcagaacatgctgttggttaataatctggaagtggtattggctgataaataatatggtgacgtattctcctgtccttatagaaaaaataggctagaaggcatcagggagaaatcgggtttcaattaataaaaagtgtaacgagccttgaaaaagatttgagaatttattacaatgtgcaataaaatgtagctagtcagtaacatatgatttatgagacactagcaaggaaatgggccagagtatatatgtggcctgggaaacaagagagatctaggtaagaaaagggagttgggaactatcaatagcaaggattaagaaaatgggttgagagagaagctccaggaaactgttgacagtacagaaggtgtcataatttaatcacttcagtcctttggaatggtattgccaagtcactttgggatgttaaaaaattatattccttcaacactttataattaggaacaggaattggcatcatcctattggagcttgctgctaacaacgtgggagtttttagagacagatacaaggtcttgccaacacattctaatgtagtcacaatgccatccagtggttactttggttactttacaggtactttccattgctctttaagaatatattttattttatagttaatattcatcaaagtttcagaaagcttgtatggaaagtgttttattatatcttcaaaaatggcatagcagggatttgatttgctatgtacttctaagctaatggagttatatccagcttgttttctatatgtgttatgctctgggaaacatgatttagcctgtcctctatcaaaattaatgcaataaggaaccatgaaataatgggacttacactgtattcaattttagttctaatagaaacacaatggaaaataacatctgcgacataggcctggttgatcagaggaaagtaatggacatttgttgctgtgattttattggtgctatgggttttttccttcacggtatgctcatcagtatagggataatgtaataaatacttttgacttcactcgtatttagtctcagtttgtctgtaaggtcataatgagcaaacttaaatgggaaacattaatttggcagctgacaacataaaataaatctagctgccattagcaaggacccttcttaaaatttttataaaagcacagctttcaagtttattgcacatctctttaaaaatgtatttcaaagtaacttcagagacatctatttggcacactcaaacttttggtgatgaaattcccttttgccactaaaattcattatttgaatctccatggtaaattagctttatgagttagctattgtaattatttttctgtgaagcaaaggcaggagtagagacaatttcatcatcttatcatcatttgtatgtggaatcactaaagagtttacccatgtggaaccatgaaagtccctgatttacccctctatcagtaggcataaacatatctaaaccacccaagaaactgtacattaatattgcttctaagacctgggggttggggggtagcatccccacagtcaacaatgttaaagtgatgaaacattttaaataattttaatgttaaaataattggagccatttcttgtttgattattttcacactattggtccttaaactgtttaaatttggttcagaaagtacagagcgggccgggtgtggagggtcacacctgtaatcccagcactttggaaggccgaggagggtggatcacctgatgttcagagttcaaaaccagcctggccaacatggtgaaacctcatctctactaaaaatacaaaattagccaggtatggtggtgcatgcctggaatcccagctacttgggaggctgaggcaggagaatcacttgaacctgggaggctgaggtttcagtgagccaagatcactccattcactccagcctgggcaacaagagcgaaattctgtctcaaaaaaaaaaaaaaataccaaagtgatttggaaaagaaagtgatattgatgtaaatgatggcagtgtctgcagattttcaggggtgtaggagcaagagatctaatgttacccagaccgagtggcaaaactgaagataatgaccacaatagaaacacttcacagttcacaagagttatggtgttttatcttcactcatgtagctaaatactccatgttgatattcatttgtcaatactaaattaagctgagtaattcttttaactaaacactgatactctacaacctgcttcgtacagtacatttattgggggctttgttcttgttgttgagttctatatttttttaactttacatttgaaaaagttttagacttacaaaaaaagttgaaatagtacaatgaacacacatatacctttgcttacaccaaatggtaacctctttgccacatttgctttgactatcaatttattttttttggagtaaactagataaaaataagttgaagacacttcaacctataaccctgtaaaccttagggtttacaaccctacgtagtttacaatactactacatacttcagtagtatctcctaagaacaaaaatactttcctgtataaccacaatgtcaatcacacatccaaaaattgaacattcgtccaataatattatccaatataatctctaaatttaaattcccccaattctccaaaatttcactgataactccattgtaaaagcatatttctttttttttttatgtttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattcaccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtatacagtcccaccaacagtgtaaaagtgttcctatttctccacatcctctccagcacctgttgttccctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtagtttgcgaaaattttctcccatgttgtaggttgcctgttcactctgatggtagtttcttttgctgtgcagaagctctttagtttaattagatcccatttgtcaattttggcttttgttgccattgctgtaaaagcatatttctattcttatcattaatattctcttcccaggataccttctacccagtgtttttagcatagttggcccttgcctgaatcacttattatattgactattacaaaaaggtgattttctaattctatcatttcctttacattttgagatttttttattctgtgaagactgttctcttccttttacttaatagtatcactcagccacatagattcctttttatttcaatttttttgtagtccatcaccattatttttctttttcatgctcgtattgtctgaaatttagctgatgagagccaccagaaaccacccctgtgtctttctgacatgtctccaacagatttggggcatgttcttacttacaaaataaggtattctaggcccactttgtaccttgcctgttccagacatttgttttttgttttgttttgttttgttttttgtttttttcctatgggcaatgatatttggaaacctgcatatgctcatttttactgcaatattatttttctaggctcatttggtggacagggctatatttttcttaataatgagtacatagttatacctccaagtcaaatccaataccatagaatgtttcctcacttttctccatttcatatgtttatatcacatctcccactgtcaaaacagtaatttgtttatttatttatatttatttatttatttttgagatggaatttcgctcttatagcccaggctggagtgcgatggcgtgatctcggctcactgcaatctcctcagcctcctgagtagctgggatttcatgcatgcgccaccacacccagatatagatatagatatatctatatagatatagatatagatatagatatagatatagatatatagatatagatatatctatatagatatagatatagatatatagatatagatatagatatatagatatagatatagatatatagatatagatatagatatatagatatagatatagatatatagatatagatatatagatatagatatagatatagatatatagatatagatatagatatatagatatatagatatagatatagatatatagatatagatatagatatatagatatagatatagatatatagatatagatatagatatatagatatagatatagatatagatatatagatatagatatagatatatagatacagatttagatatatctatatagatatagatatagatatagatatatcgatatgtctatatcgatatagatatagatatagatatagatatatcgatatagatatccatatagatatagatatagatatatctatatagatatatccatatagatatagatataatctatatagatatagatatagagatatagatatatctatatagatatagatatagatatatctatatagatatagatatagatatagagatatagatatagatttagatatatagatatggatatagatatagattttttttaatagagacgggatttctccatgtgggtcaggctggtctcaaactcccgacctcaggtgatcagcccacttccgcctcccaaagtattgggattacaggcgggagccaccatgcctggctgaaaacagtagtttctaacgtccttgatctatttgccatttgctctagcctaagtttcagatttttaattattcatttttgtccttggacaatgtaccactaagggtgtctcacttaacaatgtatattgaaactaactttacacttgaaaaagttttagacttacagattatagagatacactttattcttttttatggctccatagttcttcattttatggatctatcagaatttactcaaccaatccctataatttgatatttgggattttccccaatattatgctataatgatgtactttgtgcatgttattttatattcttcaagacgtatcttcagggtgaatttctagaagtgggattgcaaagagaagagttactaaagataaatacttttgtcagatattgccaaatttccctctattagaaattgtaccattttgcatttccaccattgtccttcctaaaataaccaaaccattatttctttgaaaatatgaacaatattaattaactaatattaaaaaataaagagcttttctagaacaagcataagaattccttacacactatcctcacttcctgattccaaactcaaatttagattttataggtagaatatgccactgcagaagcagagaagactataattctagacaagcctcaacatatgtaatcatttaaagctttagtattggtattagtccattctcacattgttataaagaagtatctgagactggtaatttattttcttttttttttttaaaaaaaggagttttaattggctcggggttctgcaggctgtacagatagcataatgctggcatcttcttagcttctgaggaggcctcaggaaacttataatcatggctgaagtggaaggaggagcaggcgtctcacatggcaggagcaggagcaagagagagtgaagggggaggtgccacacacttttaaatgagcagatctcaagaaaatgaactcactatcatgaggacagtatcaagagaatggtgctaaaccattcatgagaaatcacccctatgatccaatcacctcccagcaggccccacctccaacgttgggtgatatggtttggctgtgtcccccagcccaatctcatcttgaactgtagttcccataatccctatatttcatgggagggacccagtgggagataactgaatcatgggggcagttacctccatgctgtcctcatgatagcgagtgagttctctcgagagctgatggttttataaggtgattttcccctcttcactctgcattctccttgctgccgccacatgaagaaggacgtatatgcgtcctctctgccatgattgtaagtttcctgaggcctcccagccctgcagaactgcgagtcaattacacctctttcctttagaaattacccagtcttgggtatgtctttattaacactgtgagaatggactaatccatcgtccattgtaatccattgtaaactaatccacgtttacaattgaacgtgagatttggatgaggacacaggttcaaatgatatcagtatttatgattgcatttttcttgagctaattaaaaatattaaataaaacaaagtcattcataacatagaaatttggagtggaaagaaatcttagggatttacttttatggatcatattagcagaaggtgaagtactgacaatataaaaatgattgaatgcatatcacattgtttcttagagtatggatcaatacatatagcatttttgccactttctactcaaaatacaatcttctctcccttttttttcttccagggcccccactcttctccatatcaaccgtatacctttctagatgtctaatatatttaaatagttcctgagaccctatgatctgatttctcagtttccattcccaagtagctaagtgtggcagaccaggtcatgtgactggaaccactgtggattctcctcatgagacaccaatgggctttcactgctactcagtactcctgctgctccaggcttcaaatgtctgaaattcccacaatgcccctaatcccttctctttcagttgataaccttagtttttagttcacatgaagaccaacaacatcccattgtgttcctatcaattctatcatcccttttccagaacatctttattttcactcttttttctctttctcctagacaaccccacccctacctcatcctccatgctcttcctctggagcactataagtcatctccgttttaatttataatgttttaaatctttctcacttctggtaacttctctttgtctacacacatgtataggtctgtaacattctaaagacagcttttcaccatgttaccctgagttattactttgtctttgtcctttcaactgcaaaattgtgcactgttttaaaatcacagctttttactcacttgtcaagcccttgtaatccagcttccacttcataatgctgttctcttaaaagtttctagtgacctctaaactctaatttcaatagtcttttactggtcttcatcctccttaaactcactttaatgtttggtactactgattggtctttttttaactccctttctgtgattttttgggacactttggtgtcatggttttcttcctaaatgctcttattctctcttgttcattagtttgtcccaactcctaaaattaagcatttcctgaaacatcttcataaagtctacttgagtaattgaccagatgaacaacaagttgaggaccatccatgagaatatacctcctggactgtgaaaatagcataatgcatcctggggactcaatcaacaaagcctgagagtaaaaggagaaaaaactatagatatgggtaggtccagatgatatgcgtatagttcaagaactttattttttagaccaacacatattgcagttaattgcatcaatagtttttaactgactgaaagcagagatctgaactataatttaaaagcataaatgtttacccttcttctagcatctctgctgaaaagattttctttcaatctgataacctaaagcaaattgcataatattagtgtgtctaaactgtgcttagttacttctcattagaaatcagttctgttacttctgttacttctcattagaaatcagttctgtttccccatttttaaaggcctaacaattttaaaaagttaaatattgtgtacagataataatattgttatagcttcatttgatgtaggtcaaattctgatgcaaactggtccttgtaataatcgttcagagtaagaaccaaatgtgttatattctttttaattaagaatttaagaaatatttcatcatacattcattgcctaagtcagcaaatgtttattgtgcactgactatgtggaattcacttttctgagcattagagattcaagctagacaaacttttgtcccctggagcatgcacattccatctgaatgaattaaactggctgagatattatggtatatgtagcttacacatgcagcaccactcacttcgggaagagacaagtcttctgcagtgagtggtgctgcataggatgtaccagcttttagtgaacacagtaagttgcgcagacaggaagatatttgtcttctgtagagaggaactggttcatctttgccagtggttctcaaccagggatgatactgcccccaggggacatgggcaatatctggagatatttttaattgccacaactcagggaaaagggtgctactggcatttagtaatgctgctaaacatcccacaatgcacaggagagctacccccaaccaccaaagaattatgtagtccaaaatgtcaacagtgtcaaggccaagaaacccttctctaggctaaagggtctatgtggcttaattactgggttctttcttagaagaacatacaccatgctgttcccacagcccctctcctccctcttaccgtatagatggtcctttcaagctaatttttctggctgttttttgttccatgggtaaacagagaatgttcaggttagatatgtaccttctatttgtttttcaagctgttctcaagggtcaatcaatgcttactaaagttttcgagcaagcactaaggtagtgagttctgtgcctgctgggcataattacaggaaacaactttgtttttaaaatctcataacaagaagcacaagcacaatccacaaattacaattcctttgcagtgtgtttgtacccttagcagctcacagcagggccacatcatcgtctccgccagccaccatttttctagctaccttcctaaaatatcagaaacaacaaacttcccagggtgaggaaacatcctgtagttttgcccacatggatcagtatttttcccattctgtcattatgttgctatgaagtagacaataaattattatgaaaatatgaatagaaagaggaagtgagtcatgtaaatcattattagtattctatttcacgtgatggaaaactcacagggatcttggtgttagtccagaattcactcatgttttccctttattttaaatgctgaaaaaaacataggttgtaatgttatcattgtacttgtagaactatatgactagatatgaactaagttacttggcaacagttgagctccaaatggaacttatgcctttattagttatgtaacattagatacctcacttaacctttcaagggctcaatttggtaatatgttaaataaataaattgagctagtatctggcatgagaatcctgggtttgaatttggcatcatcagtttctggccatgtgaccatcagcaagccacccactgtgcagagagattataatgagatgagattagcatgggcattacaaagatttttgccattgctgttgtcaccaacagataattatcttgcatgtgtcttctatagcacaactgaaaatcactgtaaactatattaagagataatatccagcattcagaatatctaagatggtcagaattaggtaggttttaaaactcttatgtttcagctctttccaagtcaaatatgaataactataatccacatctaggagtagaagtaaaagaatggaaatctaatttgcaccccagtggtttgtgacatcatctttattaacatgcacgctctgagtattttagattcactgggaaactgttgatatttagaaagggaatatttctctttaaactggtaaagcttaagcatctcctctgaaaattcttctatcccaggatctctttcctgacataaaactgcatgagctgtgttcttaccgcaagagcatcttcattagcaaacagaaatgtcacctagcaaaaggaagtatcaagaagccggctctctccactatgaattgccatcttggtctgtactactgatcctcaggagcactagttatgctcagaaattgacctaagacattatttacagattctgtgaatttctaattacctttgttcacaagaagtcaatcatcagtgcttatgaagagtcacctatttgaatgacaaataactaagtgctggagatttattaaaatgaaattaaatgctacttaaattatctttcacctatccatttgcatttctatttttccgactgtttttctagcagttctattgagcctggtaaggtcttcacctccatcaggcacttttagggttgaatgcacattggagtgatctagtgtgagattttacagaacaactattccacctttccaatatcccttctgtgttagatttctccagagtacacagataataagtggccacattatatcttgttatataagtttgcactgcagaaggaatggtctgagtcttcaaggagctgacatctttattagagacaaaagacaaatatatgttaaaaaaagagtagcccattcaaaaaaagaaatcagtccattacagcaaatcttcattatatcagctaactactagcagtatggactgaaaatatggatcagtagtatgtatatagaagtgacttgaaaatatccataattacataccagttccactgaaccaagtaatgtatcatgtaatgattattttatagcaaagttaactatacaggctttttctataaaatatgtcctatatttccactaatgtccattagaaaatgagagatactctccattttttaaatcttcaacatttttggccaaaaaaatatttaaatgcaatcctgcagcatgttaagaatttaactgttttactttctgacattttaattctcaaaaatagttcatttggtgtcatagcattttttatatctttctttgttcaagaagctgcttctgtcaccttttcccctgacaccaaaggattttctttatattcaaggatcccctcaaatttacatcttctaaaactttcctctcatctttctttgcatgtgattttctggtatcttctggattttacttatttcataagtataaaatttttatgagtaatatgacataaagttcaattactttatcaattctagacattcaaattcctcttatatattctacctcacttgcatgatacctatgttagtttgtattttatttatatttgttgcacaaagccattactttgtaaaaagtattcttatactatactggaaaaagtgtagaaaacctgggttctagtcttacattgcttgacattttctttcatcaatattagaatgggaatattgtacttgattgtgttcctttgcccataactttttaattgtgtgtgttttttatattcatgggcatttcaatttattatcctccccaggtctagaaagcaaattgaacttttgaaactttttctttgagagaaaggaagtaattttattcatgatatccatttcagttagtaaaaatgtctttaagcagctaagtggctccccaaagattaaatgtccaataagtgaaaaaatcggaagtagactcctggccccctggtttcccacatcaaagactagctgccagatacatttcctcctaccagatttctcttgaaattgtaatttgtcatcttctgagtagtagacaatgaaggcctaagatttattttccttgcaagtgaataattagtgaatgtcaatttcatgtttttttcaatctgtgtgaaagtcaaaaatagtcacgttaattatacttagcaggcacttttctgtgataatacaccaattcctggagatgacaaatgtaaataatatttactccttaaaaggtaatctaatctggtattatttataagttcatttaacattgtcttccttatagataacttcaatagtgttttactaattagatataagaaagacagtcccctcatctaaacattattttatttacacttgcttttaggtttttattgtttctttattttcttctacacccccttacagcacaaggtatctcaaacctcaagcagctaccatctggcttgttttatataactctctcagcccattcaagtggcaatacaccagcgaagaataaaaagatatatattggatggagcccaagaactgcacccaaaatagctttttaaaagtcattgagcataacagtgggaataataggaaggtcttaagcggcagctgctcagagagcactggaataattctctcatcatcttgccacaggtatcgtccagaaagcaacgctcctagcacctccactttctttttcactttggtttttatgtctatctttagtttttatgtctatcactcaaattgcaacagctgacaagcacctgggatttaattcctgccggatttcatacattcacattaattttggtaatttcccaattgtaacagtgagaaccttccccaatttgggtgagcagctttaatatttcattgcatattcatgtatcacctcacgttatttttagtttctaaaagagatagcagacgaggcttcataaaagattagtaggagccctagaaatagctttatcactattccagtatatttcttttttcttttcctgagagggcagaaaaggattcccttcaaagaaggcatatttggtagtgaacaaaagggaaccttcccaagaccactagcaatctcgctgatatgttggaatgtctaattttgattctctcaagacagcctaccacaatgcccctgttcagctattgtagggcacaagctaatctttacattctgtttccttcctcccaattcttctcatttgaattatttaaggaatatgtcatgtttcattatttctacatttctttcactgaactatcaagacttgggaaagaaacacgtctttttaaaaaacacacacatgtacagcacaggttattccttttccatttcaaataatttattcgcattatattggtgtcttgtaaatttcatatttattgtgctgctttttaaaataattttttaaagtgaaatttcctattccagttccctttttcatccagagatttttataagatcatatagcatgtaatacagtaaaaaactcaacataccagaatatatttttagaatagagacattctacaaatggcaggagattttttccattttatgccttatgaaaaatggatttggaacttataaaaaatgtatctggaacatctgagtgcaagatttttgattggattttagaattcagatctatgatttaaaagcaatttcttcctttctgaaagtgtccatgtcaaattgatttttaaggagaaagaaatggtgtaatttggattttgaacccttttctcaggacttagattgttttcatttatcttgacttcctttatctttattgcatcctcatggagttggaaaagcatgtgttttcacaacttttttttacaagggttgaccacaggcaaagccataaataaggctttattctttgttccatttcacctttctagcttcacatctattcaatgccaatgtggctttctagctaatactctttttttctatcttgagggaaaagtcttaatattttgtagcatcactccaaaaaataatttgcttttttccccccacaaagagtaaggagagaaaatagttaacacaaatgaattaatcactaatggctgactttcaagtaaaaatccaatgaatgtggagtagttgtctaggagatgtaactggaaatttttcaagtccttgaaaatgcatagaagaatacagagtcccactttattattcttataaaaaccaaagatctgagtatcaaatcactaacctatttttttttatcttgatgctcaagctctgaaagtagctctttctcagtcaggcttctaacttctatgatggttgcatcaactttaatgttctaatttttagcacagctaatggagtaaactgtaactgagtaaaaagatgactagaccactatctagctttctgacttttggaagcaaccatccctttctgaatgttatttgcctcctctaaaattaggaggctcaagctatttcttaaaaaagagttctgcaataagcttcttgggtttgaattcagattctatcactttactagctctgtggtcttgtacaaactatttagtctgtctacactttaatttccttactgtaacatggagatcattgcagtatctactatagaaggaattctatcaaatgatgttggcctagttgactttcaataacttttagctattgtttgattcagaggtatgttcaagtcattatagctatgtaaaacaattaaaataactgaaaaatgtgaacaattcccaaatatttgtataatagctgacattttattaagtgtttattatatgagaaacactaagttcttgatttgtatatttcaattattcctctcagtaacacagtatagaagatataattatccctggtttacccatgaaaaaattaacctaggaaaagcatggtgactcacacctgtaatcccagcactttgggaagccaaggcaggcagatcacctgaggtcaagagtttgagactagcctggctaacatgacaaaacctcgtctctactaaaaatacaaaaattagccagacatggtggttcattcctgtagacccagttactctggaggctgaggaaggagaatcacttgaacccaggaggcggaggttgcagtgagctgagatcgtgccactgcactccagcctgggtgacagaacaagactgtgtctcaaaaaaataaatataaataacttaaataagcacacagtcacacaagtgaaaaagtgctggaagtggcatataaaggggagcgtgttttcccccagagttcactcttttaatcactggactgtattttgccttccactctggtggaagacctctgccttcagtctagatgactaatgcataattaactgcagcactacatcctgaagaaaatcaacctgtccatgtttcttgaatcatttttacaattaatatctgatttatatttcttcttttccgaacttgccagagaattttagaacatgatgcatatatatttttcaagcatgcaaatccataaagtcaaagagagtttttgaaccacagcttgttactcccctaccttctttcctgtcaaaatcacctgtgaagaatcaactttctcagaaagctcagcaacttattgagatttggcctggaattcacataaaactagataaaattagtgctaaaaggcctataagagcaccataaaataattgacatcaaaacacccacacacacacatacattttcatttcaaatgtaagaagccagagctctgaccccattgctttccatagctggcgaaaagtatgacttttgaaatcgatacattgcaatctccatgttaccatcctagtgcagtactccacagcaccggcgccaggaagaaacatcagtgtttcattctccagattaatgatctcctttcagagaaatgactttcagctattttagactatatgcccttcatttgagaagcagtttgtattcattcacttacagtcaatattcactaatatcatggattgatggagttaaaaagcttttcattagttctgttagcaaggctaatttttatagcatttgatcattttacttctagttgcccctctttttttcagaactttgtgtcccccaatcattcttttgatagagtaatatattacatgttttgtatctacaaagatgtgtccatgtccccaataatgagagcagctactcacaaaacaaggttcctgtttcttgaactaattatgcacagaaatttctacctctcacttaccaatgagataattaaaatgtgagtcttggagcagagaggattagaggtttagatgcttgtataatacatatattactggctagtaatttgtactgaaaaaaacataaatataaatatatatatatgtataaactctttgctccatttctcatgtatcttattatttgtttatttttgcagatgttattattcctaaattcaaattggtcacaggttcattcaagaaaaacactataccaacgtaactacataccaattataaaaataaggaatgtcttgatgaaacatagatatggggatagaatagatattcctgatctctaagtgtacatcaacagtagggttctttcctcattaagtttaacttaccaagaacatgtgtaaaaactctattttgctgttcaaagacattcacatgaaatttttttagtgaagtagcagatccaagtacatgaagagccttgggaataaaaataggcaaagccttataataatgattcctgctaatagaaatatttataattacactatgacatcctgtttttagttgctatgcaattaacattttctcttttcttctacttcctcttacacttatacacatgaggatatgtgggtttcattatgccaggatgactaggtagagacatttgttgatattttaagaattttaagacatttctagacttcaaaaatgcatggttagttgtttcttttttattgtcaaaaacttgtagtggacattgctatgcttcagggacttcacacatacataacatctcctttaatcctcatgtaacctctgaggacttgctggtctagtatggaatatgggacatatacctgaataaccacaacttaagacacaaaatggtgacggccatgagcaaggtacagagatcagtagccataaccgtgcagaagaaaaatgttgcttctacctgaaaaaaataaaaaaggttcctttaagtggtgacattaggagctgacctgaggggaaaacaatggtacttttaatatcaatccacccctataacttccccttaactttagatgtgtatcattagcattattcttgtgttaaaacattagggggatgctttggcaagaacctgaaatgaagacaagcgtgcaagtaaaaaggaaagagattgaaggtctaagaatgtcagaaatacctagcaaggactaggagtgagaaggaacaggagtgtgtgttttagtgaaaagagatcacataggatgaaaggaaccaaaatctattcctaaggagttaaaaataaaaggatgcagagtaggaaaatcattgtttgattctcctttgatagaattaccagttgatatcattaagacagtctagtttatttgttgcctgaattgacctatgcagatgccaaaggagaccttttgtcttcaggatgggtagggataaagtgagaagagtttaatttctgaccccatgtacaggacattggaggctcagatgctcattactcggggaatactgatgaggatgaaacaagaagtgcatcatctactgagggtctggaagtttactatcgttaatatctacaatgtggagggtggggaaaggatgcaaaggaggaagagacacttgttttgaaggtgaccaagatgacctttaccctatagctaagctgaatgaccttgctggtaggtgaagtattttgcgaaaccattctggctcacttaggggccagccttgtggattgtcattattcatagaaagacacagtgtctgctcccaacattgacctcacagtatgagagttgagtaatatgaatgaattatttattacttattcaaattttaagactcactggcctctaatagaaccaaaataagaaatttttttcttccttcttttccaataagttgatacctctatctatgcttctcacaaatggattctctacaatcaagtgattcctttcaatactgtggactcacaaactggctaattatacctgaattaagggcagttccattcaggtgattctacatttcattttacacaatgccatagccaggaatgacccaaaacaatttcttaatagcctgaaagagttccttaactttccaacaaacttcaggaaaaacacataggataattaaataaatccaggaaacaattttttaaacattttctttatactagggttgagctagacactacctaactctcaaggagtttacagtatgactttttgaagccttattttttacaaaaatgaaatagatgtataaataataaatataatgctaggcaataagacataagagatgtactagggaaataaataaattttgactgggctggctcagagaagaagaaaacagttgacttagaacttaaaccattacaaggattaggatagtaaataattaagtgggagtggaatttgggtagaaagtttgccaggactgaggaaaattgagctcctatcaatatggtgagttaattaatagagttaaaattcaggtgtgtaacccaataatttactttcatttcctggcttatcattacttatttccatactttcattttttactattattaagattcatcaaagctgggtattgtgcctcaaaccagtaatcccagctattcaagaggctgtggcaaaagaatcgttcatgcccagcagttcaaggctgcagtgagctatgatcatgccactgcactccagcctgggtagtgagaaccccatctctaagatccatcaagtcagcatggccaaaatatcttttgttcaatacatgaaaaatggatgaagctaacattaaatatcattcttatatatttcttcatcaaattccacattttttatttttaaaatgattcactttgtattgttttattttttcttacttcttaggtatttctaaatcccaatatgctctgataaataattatcatagagcatatgattttaagcagagatgctaattggctttaaaaaatacagactcatgattgtaatcatctaactgttgttgaaccccaaatttcaaattcctgctaagcactgcaactcgtataaaattattcagaaaagcagtgttttatgcagagtgagcctctgaggaaaaaattatctatagtctaaataacttttgcaaataggcctactataaaatttggtaggctgatttttcctgtctctcagtaaatctagtataacattgaaaaagatcaccacacttggtttgaagtctaaatgaaataataggcttgatttaagagccatattgtatgaaaaatataattgttttttactatttttttcctgagtgggtatgattggtgtcacctatgtttaataatgtaactactgcagtgggtctcaaagacaagccacatcagattcacctggagggcttgttaaactcagttgcaaaattctacactcagaaagtctgaagtggggcttaataattttgttattattattattattattattgtagagacgggtctcactatgttgcccaggctagtcttgaactcctgtcctcaagcaatccccctgcctcgacctcccaaaattagaattacagacatgaaaggatttttatttttaatgagtaaccagtgatgccaacgctgctggtccaggggacccactttgagaaccactgtgtacacacacacacttgaaacacataaatatatatatcttaaattaatttgtgatcatgaagggtatgtgtgtgtgtgtttaaatgcctgtgtgattgtacatcattcaaccagctacattttttaatcattagtcatttcttattatgtggcagtgaatataaccacttctaacctatagaactgttttgatgttcaaaaccagttctcagctgctgggaatgccttaaacgctaaggtcaaattgtcaatagaatcctgcctgcgtagacttaataccagtaagatagatctaaaattggcatttcaataagctattttgctaaactttaataacacaaattctgttaaccttgaagccctgattaaaacacaaataagcgagaaaatccctattgttaactgagcccattttgcatatttattgctacatcttttaatttgtaaggccatggcagactgtataatgaaatctgctctctagttgctaggtctttctttttgtcttttccacattatattacacgtaggtgctggatgtcagtgtagtagcagcttacctacatttggagaaaatataaaaacctttgaaaaatgtttgctatcattctgtcattcctttcttaactctttttcctatatttgtccatcatctgttttcagagtccaaaaattttaactagttttttcactccaccaaaatgaaaattctaactatatttatttagctatttattttttaaagaaatgctgcattttgttgggttgagtggtatatagagtctaccaggtgctttgattaattcagagttatcctttgcacaatcatatatttgaaaaaagagaggtaaccctgaaaaaaaaaaaaaaaaagagaatacagtatgaatgagctggggttggagagtttgagaataccgaagttcagaaacatggggactatttggcacccaagaaaataaccacatagtcatcatcaggttttgggactgcttatggggaggaaagaggatgcccaaagtagtttaatgaaacactgaaagtaatgatttaggaacagattaaaagatgccagattcatcacttcatcacatgatctgcctttctttgcagtctaacttgggataaactaaggaagaaagtatgacaatcaaattacctgcttttcctgtttttataaaattatgtaaaattatagaagacaaagttaaaactacatgtcgcatttcaactactgtatctatggatttcttactgagaactgtctccagtgacacaaataattttaaattgcatgcattgtttatatttaaagactacaaattctctttatttcttcattcaacaaatatttattatgcagcttctgtgtgccaagtgttagctgaaggaaatatagttgcgaacagacatctcttgcccagccaggtagttaagacatactaagaaacactaatagcaataaaatgtacatggagctatgtacatttctaattctgttgttgttgttgttgttgttgttgttgttgttgttgagatggaacctccctctgtcaccaggctggagtgcagtgtcacgatctcggctcactgcaacctccacctcccgggttcaagtcattctcctgcctcagcctcccaagtagctgggactacaggcacctgccaccatgcccagcaaatttttgtgtttttactagagatggggtttcaccatgttggccaggatggtctcgatttcttgacctcgtgatccgccctcctcagcctcccaaagtactgagattacaggcatgagccatcgcacccggctgtacatttctaattctatatctgggtactcctctcaaactcgaagaaccttaatttggaatttaatttcaattatatggaggaaaaggaattagtccaacctctataccttttcttttagtaacaactacagagcagaaatgtgtccctttaacctttgaaggggctattttccctttcaacacaacggaagaaagcttcagatcagaactaattgttctgtgattgattgatagtttccctcttgttgctacatacagcccaatgacatgcattgtacacacaacaggaggtaagagagtcaatcaattagggaaacaattagttccagtttctacaattcatttgatgttgtagatgaaattgcctgaaaatattaagagcattaaagatcagtggtgaaagctaagtaaatacatttatattcaaattttagaggcagatgcttagttgatgctgctcttctgcagataggcgatgttaatgcaataacaattacagtttggcagcaattaataaatggactgtcaaaatcagtcaagttgtgttcatggttttggaaggctgctgattttagctttgacaagatgtggctgaagtgttgctgaaaaactcaaagtgattaattaatttagaagatataattctgtgactccccttctatgggtagtagttggaaatgggggaacccaaacattcaatgcaacctgatgccttctttggggtccacatttaattagtatttatgtctagtaaatgcaatgtgtaggaatattctaagatttatgagattgatgaagttgtaaccaagaaaatatgacgcaacttggagtaatataattgatgagatcttcaagtcatacggaattctagatttagagcttttgttgcgatattagggtacaaaattcagggtggggaggaaattaggatggactaagagtgatgggctagctctaagtgagctcaaagctatgtctcatgcagagcaatgtgagagacaggtccctctcctcctccgggtaagaaagcaaaaagaaagttaataaaaataatcaagaacatttcatccaaaacagtagaaaagagaaaatgcttaagaattttactatatttcctcaaaagcaaaatataggaacaagtttaaagccataattccatcaaattttgagtttatatgttagcctattcttaataatgatcaaagctgcttaaacccagaaagtaaatcctgatcagtttcacattatcttttagtttgttcagcaaaagaataaagagaatactgatgttaacatgtgtatgtctgtagtatttaaaatccaacacactctggcagaaatgttctagagtgactcaaatttgatccctcagagaaaaagtatattttttaacaaggtaacactgttactttgatgaataaatttttttctaaaaaactctggatacaactaagacagctaagaaacatggaaagcaaataaaacatcactatcacccagaaaaaataagataatactaatagagaaaattaattctaaatattaaatccatttctagaccaaaacagaaaagaattcacattaccttattcaggtttttctaacctttcaataaaaatcttgtagaaatttgttataaaatttcattttgtaatttaatattaggaattaattaggagggaaaacaaattgatattctcagctccttatctttggcgttttagtacttacattgtctttcgtgttctaattaattttactaatccctttagctaatgaataagtaaatgaggaccaggggaaaaattcatcaattgcaagaaaagtgtagaaaattattaattcagaagtaacccataacaaccacagtgaacttgtcagtattgctttgctctcttgctaatattctaatttctgttttattattcttcatagagcaaaatgtttcacagttaatcttaacagtacttttgtttctaagccttctaaaaggcattgatttgggaatagccaaatatttgaatataaattgattttatgcaatacacagaaaacaagtattttattgatataagtggtttctttatttgtagaattacacttaaaattattttgaagcagcatgaactctctctggacggttttggaatttcatgcccaaatcaacttgaacattacttttatatgagctttttgtcttctgcagtagcataaatgcctatggatggaagtgtcaggggagtagagatggagataaaagcttcaggaaacaagatgtaagtgtgaaaatgacagaatgttcatgtgggaagaaattgctataaagcttttctttccttcattcctcttcctaaaagaaatacttaaattttaggacttcagtcattttctttcaatctggttgataatagcaggagactaaggcctactttatatattaagacagaaaatgctcagacattacagagacaggcatgaagaaggggaagcccgcatgaatttttggaatgacaaaccttctgtgctgatattctgatgtcagttgacattctgatattgattttcagacttccttcactgaggaagtagttataatctttaaccagcatggccaagaaagaaatctcaagggcagtagagacttttgctgttgtctaagttctttttatcctctttaatgccataccattcttacctctttggaaggctgtttgtcattcacaaccaattcaattcaattcagtgtctgatgatggacttctacaaagtgcatcttaatcagcagatttccacagagacttttcctctctctaacaccctctgcaaaatgctggctgaaatttttacttgttaccatgaataacagcatgattttgcagctacatgttcccctctttcaaaattgaatgctctatatccgtttttccctaccagctgccttccctctctccactgtcagcattttgtgatgaaaaagattcagttacaatatgtgccccatattgtgtaggctttattttcactcaggctttgagtcaggcctccattctcaccatagaaatgccctatcacctctccaaacaccaattctctctaaaattaaatttattctgctataacatgcaaaacctagaaatgcatccaaagcctgcttctgacaccagagaaaaatgaaaaatcacgagcaaattcacctaagtttactcacatttatgttttactcccttataacagagtaatgcaaaattaggtttatatcaatataaatacgtatcataagcactatcaaattttatactgtggtagggattgagacattgtgctgagtattgcaaatacaaatgttaataaaatcctatcccaaaactcagggagctcagagctgattgatgaaatagatacataagaagataatcatgatataattctagaaatgcattaattcctaaaagtcttgatcctttccctttcccaatataatggtgaggaactttgtttaagaaaatatgtttaagaataggtagcataaatttttttttattagaattataaagagggcttctcttcctggtgacatcttaaccacaagagattatttatgcttcctaccaaaagctactgaaatggtagaatagaagagagatgaaaagggtgaaggacataaaattctgtgcaacaagaaagtaccttaacaaatcagaaattctgaaccgtttccaagacatagaaagcattttataataattgataaagataccagatctgagaaaactgcaacccagaagtgcttggaagaaatgtgctgcagagagaggagccattttccccagctggcccttgatagtctaacaaattgccaaaggatttctgcttggagggtaattacagtggagtaatttattaaaggagaattgcctcctcacagctggacaactggctccagttcacatagaggtacttagagccactatgagggctctctgagtaatgtggacagggtgtaggagcaaacaagaagcaaagcacagtcctctgaaactcaaaagggtatgaaagagtaagaatagcccctctgccagacagaaaatgctgtccgctcccagaaaaattcctcctttaccttgaaaaatgagggaactcctagcttatctactggtacctgcccaggcacttagaaggaaagtctgtgtcaccatgtgtaatactctctcagtcaacactttcattcagagaagaagtaactggggaaagagatttgcccagtttagacaaaatctataccagtcataagattaatcaatattagattccaacatagagtttctagcttcagagtccatgctgttatccagataataactgaaccaatctacataattcagaaacataatctgtccaccctccctgtcatatatatcttgattaaaggggattttttgtaagccagataaatatctaattggtgaatcatcaacctgtacaaatagtgaaatggtaaggaaatgtattttggaatcagagggttatcacatgggtcagcccatcatttcatggagccatcctttgatcatttcccagctgtttccaattcccagagctttttacttccttcattgttgatgccatggagcctctaaaaggcttatagtaacgttcctaggatctgtagtggaacacccatgctaggcaagggtgatttccccatacgtattttttggaagttggggcttgtaaatagttgactaccttgactacctctaagtgtcatgcaaagctgagccagagccaatgagagattctagccagtttcacaaataatcctgaataatttatttggcagcagctatgattttatttaaaagttgataaatctgaaaatatctttagatcctattctataaagaaaggcaaacaggcttcatcaagaaattgacaaaaatactttcagttctgtgtaagtcaaatcgatgttgctataaggccaaaggatagtgaagtagggacgcaaaaagttagccatattccaggatctgaccttcaaaattataggctcaaaaatttgtttaaagtcatctttcggtgtgactgacactacccaattcacaaggggctaatatataagccagaattttaataattgtttagtactgcgtatctaaatacaaacatgttttcttccaacgatgcatcatagtttataactagactgatgaaataaacttggagtcctagtcatcaacaatcttgagctacacaataggaaaaggtgcagatcttccatatatctgttgctttgcagtaaggtagaaatgacttctacttaagaatcttaaaaaattataatagggcttttgataataaaagacatccaacaacttttaaagtggaagtttggcacactcagtataagcactttagatcatgttttagttttcttttaatgtcataatatcaaattattgatcagtaagtatgaaaaaagtctaaagaaatgagccaactgcctgtagaatgacttcatatcagtgaaattatagtatctataattactgaataaaacatgaaaaggcaatttagctccatgtattgctcttgtcagtaagccagcatgcctgtttatcatgtaaataggatagtagttacagatcatgctccaaatcagaaactatattctttctaaactctttatttgaagatctgagatgcaaactgtggtatattcatcagtcttattaagccactcagatggcaatggcattaagtccaggcattggccaaaatgaaaataaaagttaaagagccagagataatgaccttttattacagttacttacttcacaatgttcaatgtcatgttccaatgtgagatggtgactcaatggtattttataggaaatctgttcttaaccccgctttcttaaagtggtgtgttctgggtttgtcaagacgaaggaaagatgtgaaaattcgccatggacatatccctaactttattaaagcgtgacttgttgaagaaacagaaaataaattgtttcttactaagaaacaaaagcaaagaagaaagagaaggagtcagggaagaagcaaaagaaaaggaactcactaagaaacacatggagattatgccatgtaagaatcacaatagggcacctgcctttcaaatattctttccagtcctccaagtcccccggatttatttgtagagtactcctagtagatcaaggtgtacttgtccactgcttcctcacttgcagactttgatcaatgatggacacactaaaaggtagaacattcaattggaatgcaatatataaaactgaacccttacctaaacgtttcaaatcttttaaagcagcttaaaccaatcgcaaaactaattttcttataattcacatcaattcaattcatatttatccagctccacaggatgcagggtgctgaacttcaccataatttacagaatgtagggaagacacaaccctgttttgaataggaaaaaaatgtaatgaaaatctcttagacctattgggaatcaaaagctaggagtcagaggcacatgtaggtaaagagtattagcaacaaggcaagttagcttcgcctagtagataataagcctatggaaaaaaaaatttttttattgtgaaaatgagattgttaagtatttgtgtatgctcgtttttggcagatgtaatacaaactgaatcaaaccgtaagggaaatgtattattttccattacaagaagtcccaaggtatggttgtcgtaggttgattaacacagctgctcaacggcattgtgaggttatggttactttcagtttatagctcgctgtccatagagtatctatctgccttccctttcaccagattctctcatacttacgacatggctgcaagcagttccaggtaccacaggcaaacacatcaccacccagcaaaggagatactgcttcctctgtacgtctttttaaaggttagaaaaacatttccagaaatcacccaacagaattcctcttatattgctacacttccaaattgactcatatgcccttgcctaaaccaaccatcggcaaaaagaataggatttccatgatcaacatatagactaataagattttcttatgaaacagggataaggtaatctccccaaagcagtacttgtcagaaaaaaaaagtggggttttatcttaaattgaaaggaaggaatagctgttaggtaaaaaaccaacacactgttaggtaaacggccaacaatcttgcttgttattttttcgtagattgtagatactgttcattcttgtctcatgtccccaaattaattcattggcacacaacagaaggtagaatttggggagaagtctcctgtaattatttatactagagtatattttggattttaaccatctgcgtacatggctgtatccccagccattcaaatagtgaatgaattacttgagaattattcaaagcacctagtataatgttggacacattgtagacacacagtttattcattcgatcaacatttatctattcatttattagtaaggcagacttccatggactcagagctggcctgtttcaatttaaatcctggctccaccacttactagctgtgcaaactttggcaaattctctcatctataatagagagacactgtaataatattgcctgactcatgaggtttattttgtgagcattatatgagcttagatgtttaaagcacttataataatgtctaggtaatagtatagcttaataaatgttagatatttttatttattgatatattatttctaactggtaggttgcaacattttccatcatcctatttacctcagtctgaactgtgtatagatggattttaaagttttgcttcactgtgtgacaaaacaatgactgtttgaacacagtgtgataaaagagggctgtgagctgcaagctcagattttctgtcaagtgcctgcagctcagaaacagcaagagttcagagttgagtttcagcaaagcaacggagaaaggaaattccaaattatttatctgtaacttctataaaaaacactgagagccgattggcttgcttcaactaagctatatctcttcataactaccaaaagcatctagtaccatcttactatacaaaagttagagatcacttcaattaatattctatacaatgagtacagtcactaaaaaaagctatgtcaaattgatccatggaagatttcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcccgagttcacgccattctcctgcctcagcctcccgagtagctgggactacaggcgcccaccaccacgactggctaattttttgtaattttaagagatggggtttcaccgtgttagccaggatggtctcaatctcctgacctcgtgatctgcccgcctcggcctcccaaagtgctaggattacaggcgtgagccaccgcacccggcctcctgttgcaacattttttaaaacactgtaaaatacacctgaagtttttataatgcatttgaaaaaactcatatcttttcttgattatgaacctgccattcctactaaaatcttgggaggctttttagagccagaaaaattctacattattcagtggcacttttaaaataaatatggtttttgaaactgcaatgatattttatttatagagaaatgaatgcgtaataagtggattatcagcaaaacaatgttaaacttgtgaattcattaatgaatacgtttttagttacaattctgatgtaccatatttttaagattcacatccctattgtaggtggaaaatgttcaggtttgtataaaaccttctgattttctgtatatcactttagtaattcagtacttgaattttctcttggatatgttttgccagtttgtttccattcttttattctcaataatataggtccaaaggggaaaataacatagcaatgaatatagttttcacttggctcatggatttatttttattttggctagttcttctgaaattcatgttgactacaattgctaaatataattgtaattgatcttctgagaacgagaaacacagtttgtttaaattttttttaagttttccctttccaatacattatttataaacaatactcatattttctcctcattctttaggaaatacgtatttcatgtactctaagagaccattaactacaagatgcaccattattttatatagcactaaggaagcatgttgaaaacagtttcaaaaatggtttcatataatttgaattttattttgtattaaaagattatttagacttatttagacagatttcattttgtcactcttgtgcacacaaaaaaaacaaaaataaaagcaaaataaattggttaatgaatttctaaaatttctaaatctgttctcaatactcagatttgataatgctctttttttcagataccatttctgcaaatattgctttactgttgcctccaaaatcttccaaattgcttgactctcattctgctagttttgatggtaaagccaatattaaaaggtttcagacgacaacccagatgcagatcccttctttaagtcacctttgagtgatttgttgactggaacatcagcaggaataataactgtgttgagcgtacgttgagcaaataacaactgggcctggcagacagtgatagtaagataccacagattttaagaaaaatccccatttcaaagatgtaaaaaatgtgaaaaaaaatattgtgaaagaatgtattcagttgagtgtttaatccatcactcaaccatcagtctccatggcattttccttagcttccatgatgggatcccacatcactcaatgctctcagttctaacagtcttccatgtgcagttaggaatgcacagtgaagagttactgacaaaattcattacttctggctataaattcaaatgatccagaaactaacaagactagtgactccacacagtaggttttgtttctcataatactttcttgattacaaggtgcagatacttagatcatcatcaagtgggatactatgtagtgaaactcagatcgaggtgaaaaccaggccaacagaagtggagtaactgcaaggatgacattggacagtgatcacagatgtgagccctgggatcagatagccatactggaatcctggcttcaccacttattaactctgtgacaatgagcatgtttatttttttctctatgccttagtttcttcaaagtttttcatagtttaaattcctagggaatgattcttattgcctaactcaccttttcatgccaaacagtgtcattggcctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcgtccatcaacccatcacctaggtattaagtccctcatgcattagctgtttgtcctgatgctctccctgccccaccaacaagccccggtgtgttgttcccctccctgtgtccatgtgtactcattgttcagctcccacttatgagtgagaacatgcaatgaaaaacaaagtttaaaaaaagaaaaaagatatagagatgttaaactagttgggccagcttggaaacaaatctagaaaaaaatgacactttttgacacaggatgttattatgatttttaaacaatgaaaattaggattagatgggaaaatagctaaattcttaatataaccagtctccttccatctttaagaacgacggctcctaagcttttgctcaacttcaagagacagggatgggagggaatgaacactggagaatctagcaaactacataagaaaaaacaagaaagaattctcattaacaatatgaaatttgcaagttggtaagtcagttttccaacctctggaagtaggattacctagctacttaaacagtttaacccctggtttttaacacaaacatttgccttttaagctatttgttcattttgagaaacttacagctgcatctctctgcacgtatcctttttgggcccaaatttcctaattcctggtcctatttgctacttcttcttcatgctttcccacctgcttcctggaaatcagagtcatgttcccaattatctaacaatgtcaagaagataactatgagttgtaatttaccactattggtttcaggagatgacattgtgggggcatatttgagtttccataatgggaggaagggtcagcaagcagaaactcgtgggctgctttaatggtgtgaattgatgtcttattctcctattctccaactgcacacaaagcataaagctcactaaattctcattacttacatcaagtctttagtacatggtaagtgagacctaactaaaaatgattcttgttctcccattagggaaaaaaataatcaaagaaagaaaagaaaaagttaagaccaaggaagggttataagaggaaatggagactgaagcatttcgatcagaatgagaagagaggcagacaggagagagggatacgagaaggaaagccaatagggcttaggaagctgcggagaatttctgaagaaggaagagagaagacatatagtagggggaaaagagatatttaaaggggattcttaggaaaggcagctggtgagcatgcaatatttccttctgcttacattcttccaaagacatcttcagcataacacctctacacacctcttcaatgtttgtattgtgggatttgtgacattgcggaagaatgtttgttctcttcttaaagtaaacctaagaaggcccagttatattcaatttgcaaaagcactatgagaaatacttcctggaaggcatactctttaaaaaaaaatctccctacacctctgaggaaatttttgtgacttgttgaatgggtaaaatctggaggtaactagatccattttggaaaaaatggaagaatccaggcacctgggtgttttaggttagccaaactgctgtgcttccagttgttgtaaggtctgaaaaacaacctttcttcagtagctgtttctttggaactactgccataagtcagctctcatccatagtgacagggctgttcaatctcttgcttcccacttacttccctcaagagaaattatgtttgaactagacagaagatacacctcaagcctgacattcaaacatctgcaaacttatggaggattttgatatgctgctaggctttacttaactgcctaaggatctttggatttggaaagaatttaaatgaaagctttgacagtggttcattttttttccaaaaatatttcagagtaggtgttataggtcagattccctgggaacctgctctcaatcagaggtagtttactaggaaatgttctccatgtaagaaactgaaggaagcagatgtgcagaaggggagatgcttgctgaactgatatgccattacaacaggctttagctgatcctgcagtgtccttcagagatgaactaaatcgaggccagcatccaccactcattgtgtgaaggccattcctgggtaagggggtttaaccttcagcaaggcagctgcttttggtcaagggcaatttctctggagtgactccctggctgtgagcaatcagcaggcagcactgcctgaagctgggggaagaggctgaaatccttattcttgaaagccccagggcatgggaagaactgaatagacctggccctcacttacggattctacctatacccacagcagatcaaggaaaacttggatggaataaaatcactacattctgccctccacctcaaaatatactctaacaccttccataatatctcccagcttctttttaataattattccaagagttagtttcaatatgggacttttctgcattagaagactttttttagtaatattttttcgacctcctcctgtatgtgctttaattttgcatgctattgttataaaatacaatacttaaatagagatggaaataatgctttgtctaaaaatcatgatgctattgcagtatagtagactatcttactatgtaatctgagaaatctatattaatttgtagatctagagataggtataattaaagtcctactaagaagaataatttctaagaggacagagggaagttgtcatagcaatcaaaatcctgattttcctcattttataccacaaaactataaactttttttcatatctcatttttttttcatttttcgtaacttattggtgtacaggtggtatttagttacatgagtaagttccttagtggtgatttgtgagattttgatgcacccatagcccaagcagtatacattgcaccatatttgtagtcttttatctctcacccctctcccacttttcccaagtccccaaagtttgttgaatcattcttatgcctttacatcctcatagcttagctcccacatatcagtgagaacatacaatgtttggttttccattcctgagttacttcacttagaataatagtttctaatctcatccaggttgctgcaagtgccgtttattcattccttttcatggctgagtagtattccattgcataaatataccgcagtttctttatccactcattgattgatggacatttgggttggttccatgattttgcaattgcgaattgtgctgctataaacatgcatgtgcaagtatctttttcatataatgacttattttcctctggaaaggtacccagtaatgagattgctggatcaaattctagttctaacaaaagtataaattttaatgataccttcatatcttttctacattgtattttagccagtggccattttacatattggttaaatatgtagctgcatcattcattcttgagatttagcttctgaattacattttaaagttttttttttttttttgaaaatctgacattaggaaattaaacctcttctgcaagatccagttttctccagaataaaagttttaaagattttttttctttttgtaatttaaaataattcaggtttacaatattttgagaatgtagacatataggggaaaagtgggtattcttccacaaggctaacactttgtaatgcatctttccagcctcttctctgcaaaagatttcttaaagaaaaactggacactttatatactgtctcataatttgtgtttttacctaacactcccatgtatttccaggtttatagatggctaccttttagatactttttataacatcattttatagatcattataattaagaggtctctctgttggataatttctggcacttctaatattgtaaataatgttactacaaacatccttatattaaattgcttttatatccatttaagattaattttttattgagaatttctagaagaaaaatgaccctttcttttttttattattattatactttaagttttagggtacatgtgcacattgtgcaggttagttacatatgtatacatgtgccatgctggtgcgctgcacccactaactcatcatctagcattaggtatatctcccaatgctatcccttccccctccccccaccccacaacagtccccagagtgtgatattccccttcctgtgtccatgtgatctcattgttcaattcccacctaggagtgagaatatgcggtgtttggttttttgttcttgtgatagtttactgagaatgatgatttccaatttcatccatgtccctacaaaggacatgaactcatcattttttatggctgcatagtattccatggtgtatatgtgcctttctaaactttttgatgtgttctgttagtttggtatctataaagtatcctcctaatctagtctccttcctaattgcccagtttcttgtaccctcaccttcactatctatatttagccagatttataaatgaatatgttatcccactgttattttaatttgcagttctttatttgtgaagttaaattttttaagattttgcttttagtttttgtcaggaggtagaggagtttgtatttctttctttgaaaattgtttgtgctgctatttacaatagcaaaggcttggaaccaaccaaaatacccatcaatgatagagtggataaagaaaatgtggcacatatacaccatggaatactatgcagctataaaaaagaatgagttcatgtcctttgcagggacatggatgaagctggaagccatcattctcagcaaactaacacaggaacagaaaaccaaacaccgcatgttctcactcataagtgggagttgaacaatgagaacacatggatgcagggaggggaacatcacacacccggacctttcaggggtgggaggcaaggggagggagagcattaggacaaatacctaatgcatgtggtgcttaaaaccaccacagcacatgtatacctatgtaacaaacctgcacattctgcacatatatcccagaacttaaagtaaaatgaaaaaaaaaaaaagaaaattgcctgtgctggactttcttttagaagataatttaattttctattcaataatatttttcttgataatttaattgtctattcaataatatttttcttggtatatttcaggatgctgaattccactttaacaaactaaatgactgtgtctctaaaattaagtactatgtttcctttcagtaagatgacttgtgtcttccatttactggcaaatagattcaaaagaaaatcataaatacttcttcagtactgatttaattgtttaatgatgcttaaatgttattagtagagtagaccagtagaaggaaccttggatcaggctaaatctgtgtaggaccaatcacttaatcctgggaaagccacactccagttacttctgtaaaataagattgagttacttttcagggttgtaataggaattgagaattttctccttaaatatcaacaacagtattttggcacaaagtaggtgcctaataaatggaatcattagtattagccccttttggtgttattttatattaatatgtcctttattttagtggtttttcaaactgcaggtatcaaatcatgagtggattgtgaaactaatgtacacaactttgagatacaactagaattttttagtgataaagaatagagtagaattgaatttatccaagtatttcacagaagtgtttttatgcgaaacttctcttcagtatataatatctaggcagacagagtgtatatactggatgacaatgtaaaataacctcttaactatgggttgtatccaaaaactcctccaaaaaacaggattatattggatacttgtctcatagtttccaagtcttttgatactatagtggctaagacaccttggttcaaatcccaactccattaattactactatatgactttaactgcctggcttttactgtataacctcctatgacttactttcctcacctatgaaatgggtgataattattaacgagaataatatgaaatattatatgctttaatatgtgtaaaccacttagcgggtgctcaataactgttagcttattttttaaagactgagtagaatatctttttttctgaataagcaaactatgtacataaaagaatataaagtcatcaggctgggcgcctgatggctcatgcctgtaatcccagcactttgggaggccgaagcgggcggatcacttgaggtcaggagtttgagaccagcctggccaacatggtgaaactccgtctctactgaaaatacaaaaattagtcaggtgtgttggtgggtgcctgtaatcctgactactcaggaggctgaggcagaattgcttgaagccaagagatggaagttgcagtgagcagaaattgcaccactgcactccagcctgggctacagagcgatactgtgtctcaaaaaaataaaaaacaaaaaatgaagtcatcacattagccaggactgaataatcagctaattttttcatccacaaaatgatgcctcctgataagcattttatttccataaatatgaattttcaagaaccaagtaactattcttaggtttgctatttacaaacaatattatctctcaagatatgaaggaataaaaataaaacactaggcaatcccttagtctttgtcagtatattagatcctcaattacccacaacatttttgtattttatgatttttttaaatttcacagtggtatgcactaagtaaaaagaactttgtctatatttcttacaatctttttttgattaaaaaataagaattaacagggatgatatcattggctggtaagagttaaaagcttatagctcttacttttctgatgaacaccttccaagggtattttatgtctatagaggattggtttggaaattatagaaacattctttgcttcccttaaaaaaaagctgggtaactttaagaacattttctaaatgttgaccctgtttagcaaaagtcttattgttcctatagtcttttatgtctttcaaactatatgtagaaattttttatgtacaattataagctggagtaaaatgaaaactatttagcaactcaagaagtgaaggaggatccagctatcagtacacacaaaggctagaaacaactgtgtaatcacttgaaagtaggagctgaacatcagtctgaatgaccagcaacaatatcccacctctacaactggacaaaaattaagcagaaacatagttgagcaatatacctttaatgtaatgatggagctattgtacttagctattttcatttaactcaatcatttcctttaaattctacagtaagccataagtcctcaaatatcttcaactatcctgtacagagataagtaataatgtgtgtcacatctggtgtttctcacagcaaaggaaaaattaattttttgaatacgtgcctgtaataatgtgtgtatatgtgtgtgtgtgtgtgtgtgtgtgtgtgtgtgtgtgtgtacaattttagtctggctgactcaatgaaatacagaagttaggacatcattaatatcaacagttttacccaagttgtatcaacagagcaaacaaaacttcaaagttttccagggagatgagctcctaaactgaacaaaatcagataatcagaaaaagcttctgggacgtgacttgagttggaaacaaaaaatttccacattctggacaattctgggaggccaagtgctattagagatgtgtggataaatcaattgatcaatcaattgattgatccactggtagtctgttccattgatccactgatctctggaacaaactaatatgccagtggatcaattgaacaatggagcaatggaacaaattaatatgccagacactatgctaatttttttgcataaattatttcatactcataaaaaccttacagatttggtctgattatcctcattttacaaaagaagaaactgaaaaacgaagaagatctgagccgatatctgtccaattctaccctttaggattatattggtagctagtaatggaaaattaaaaacttaaaaaagagaacaaggccaggtgcggtggctcacacctgtaatccaaatacttgagaaggctgaaaccagtaggatcatgcgagcccaggagctcaaggctgcaatgagctatgatctcgccactgctctccagcctaacaacagagcaagaccctatctcataaaagagagagagagaaatagtcaattataaaataaaaattcgtatctatgtatatgtgttagcctcagccatgatctcctggaagtagatccaaaatctctggattttgattaagattttaataagaatcttatgcatctgagattattctattttcaattgtactttcactaaatatgtaactatgcatgaccaactcacaaatcgtttgcatttctttcttttttttttttttttttttttttttttttgagacagagtttcgctcttgtagcccaggctggagtgcagtagcacaatcttggctcactgcaacctctgcctcccgggttcaagctattctcctgcctcagcctcccgactatctgggattacaggtgcctgccaccacacctgactaatttttatattttagtagagatgaggtttcttcatgttggccaggctggtctcgaactcctgacctcaagtgatccgcctgcctcggcctcccaaagtgctgggattacaggagtgggccaccacgcccagactaaatttcatttttaaaaaaatcttgtttgctggttatctccacgtctttgcaaattaaaaggtttttataagttcgtctactttcctgttaagaacgtgaagtgaatcctgtccaggcctctttacttatctatttctgccccaaatcatgcccattctttcctcagaaagcctgaaatcttaagttctgcaggaaaattacaaagtctggaatatttttagaatggagaatattcgttcatttctactcccttagaataccttccttacatttgtaccttcacgtgttctaagaaaaatccaggaagggcaggttttagttcttcatatttcagaaggtggataaattaggatgtcaaatgccctgttaaagtttatttaactagtgaagaggatgagaactgatgtcttctgaattcacagctgtttgtattgattactttattaattattttggcatattttggaggtaaacaaatacttaaaataattgaatacattaataaaataaaatattctaattaaataagctaaataaagtaaaatatctaaacttataagttatgtttcattagcagcaccttgatatatatagtcaaccatgccacatttatagtgacttaaataattacccagcaagacaagtaaattattgatcagagtattgtttacaataaatgtgaaaaaagtgactggggtgaaaacttaccatcaataaataagattcaagaaccaattactgtaatatattcataacatcttagagtatcaatattatgaataatattacttataaccatttttaaagtcactagcattttgagtacatgttatcatttatcaacatttccaatacaaatattttatctctttcttccttttagaaaatacaaaatatttaaagtataaagcatgtatttcatcaagaattgtttcatacacgttttggtaagatatgggttaaaagttaaatctacacagcaaataattggctgtataaataactaatagatttgacagtatacatagtattgctggaatagaatgctattcagtaactatgtctggtcttaccttctggggaagaactcttcactcgctgtggttccataaatatttcatttaccaacacaaagcaatatgctaatgatggactatttacccagtgagcaggtgccacctctgatgttgtttcatctctgggatacctttgatgtgggagcagttaagccattttgaattgttctgtctttgcttccctcccctcacagcttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccatgtgagtattctatattagtacttgagtaaaaataagtggttgaaaaataccccatccattggaaagaaagtagaactccgtttgatatactataaatttacatttaatttattactatgggaatgatagtatcccaatataaaatgaaatattcttggaaatggaatattcttcttgtctttaaatatacttcataaatgaaaatccagtttacaaaaaaaaaaaagtctgcagcttgtatttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaattttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataagacacttgggttgattccatgtcttggctattgtgaaaatttctgcaacaaacatgggagtgcagatatctgtttgtcatattgatttcatttctttggatacataccgggtagtaggattgctggatcatatggtagttctagttttaatttttaaagaaatctccatactgttttccatagtggttgtagtaatttacattcccaccaacagtgtgcaagggttcccttttctccacatcctcgccaacacttatatttgattttttgataatagccattctaacaggtttgaggtggtatttcattgtggctttaatttgcattgccttgataattagtggtattaagcattttttcatatttctgttgaccatttaaatgtcttcttttgagaaatgtctagtcaggtcgtttgcccttcttttgattggtttatttgttttcttgctgtttgaggtccttatatattttggacattaaccccttatcagatgtatagtttgcaaatattttctccccttctgtagattgcccctttattttgttgattgtttcctctcctgtgcagaagctatttagtttgatataatcccattcgtctatttgcttttattacctgtgctttttgggtcatatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtctgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggtattagttcttcaaatgtttcatagagattagcaatgaagatataaggtcttcacttatgggagattttttattactgattcaatcttttgttcattactgatctattaagatactctatttcttcataattcaaccttggtaggttgtatgtatcaaggaacgtatccatgttttcttggttatccaatttgttggtatataattgttcataagagtcccatgagcctttgcatttctattgtatcagttgcaatatctccttttttgtttcttattttatttatttgagtcttctctcttttttctcttagctaggcttgctaaaggtttgtcaattttgtttaactttcaaaaatgcagttttgttgatcttttctgttgtttctgtagtctctatttcatttctttctgctctgatttttgttgtttccttcctttactaaatttgagcttagtttgtctttgtttttctaatttcttgaggttcaacattaggctatttatttaagatttttcttcctttgatggaatagacatttatttctataaaattccctcttagaactgcttttgctgtattgcataggttttgctatattgtgttttctttttcatttgtcttaagaaattttttgtcttcaagaaatgtttgtttcctttttcatttcttcagtgacccattatttattcaagagtatgttgtttaatttccatgtatttgtgcattttttctaaagtcccttctgtttttgatttctagttttatatcatggtcagaaaaaaataacttgatatagttttaatcttcttaagtttattaagacttattttgtggcctcacatacgatctattctgaggaatgtttcatgtgcagttgagaagaatgtgtattctgtagctgttggacagaataatctgtatgtctgttgggctgattagatgcagattgtagtttaggtgatgtttccctactgatttcctgtctggatgatctgtccattactgaaaatggggtgttaagtcattattattgtattacagttgatctctcccttcaggtctattaatatttgctttacatatttaggtgctccaatgttaggtgcatatatgtttgcaattattatattctcttgctgaattttgaccatttttatcattatataatgacctttttatttctttttgcaacttttgcttttattttatttgatctgatacacatatatagttattcctgctctcttttggtttccatttgcattatatatcttttttcattcctttattctgtatgtccttacagatgaactgtagacagcatgtagctggatctttttaaaatccattcagtcattctatgccttttgattggagaatttaacctatttacatttaaagtaattatcaatacttactactgccatattattaattgttttgtagttattctgtacattgtttatttctctcttttctcccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaattgttttgccttttagccttcatactgaatttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattccactctctcctggcctataaaatttctgttgagaagttggctgctggatgtattggaacttccttatatattatttgcttcttttctcttgctgctctcaggatcctcttttttgtctttgatccttgacaacttgagtatatgtcttggggtagtcttatttggaatgaatttaattggagacctttgatttttctgtatctggatacttacatctttctccaggtttaagaaattttctgctactatttatttatttactttttttttcttttttcttttttttgatggagttttgcttgttacctagactgaggtgcagtggcacgatcttgcctcactgcaacctccacctcccaggttcaagcaattctcctgcctcagcctcccaagtagctaggattacaggtgtccaccaccatgcccagctaattttttgtatttttagtagagacagggtttcaccatgttggcccagctggtctcgaactcctgacctcgggtgatccacccaccttggcatcctaaagtgctgggattccaggcgtgagccactgcacctggcctactttaaataagctccccactctttgtctctgtcttcttttttatctcctatggcttgattgtttgctctgttgatgctgtcccataaatcccatgagctttcttcatttcctctcattcttttttcttctctgactatttttaaataggctgtcttcaaaatcaaagattctttcttctgtttgaccagttctgctgttaataccctctactgcattttttttctttcattatatttttcttgactccacttttcatttcattcattgtatttcttagctccaagaatacttttttattatttaaacctctattaaatgtcttattctggtctcatattattttctcattttgttttcttgaagttcactgagcttccttagttatttggaattatttgtcaggcattttatacctctccatttatttacagtcagtcacttgcaccttagttttttcctttggtgatttgtttccctgattcttcttgatctttatgatcatgtatcaatgtctgtgcatttgaagaaataggcacttacttcagtcttcacagtcttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaaatggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagtataggtcttgaatataaggccgtggtagtctgcctggtactgagttttactgtgcagttgcaatgctaggctccaaagcaaagtcctgtgctcgcttccctctctttcccccaagttgacagtatctctttctgcacctgtgctgcctggggctagggaaagagtgatgcaggtgttgtagaactgtccttcctatctcttcaatgcattttttcttagtattatgctactaccagttactgtgagctttcatgtggtttccttagctcttgtgaagttattttcatgcatggatagctgttcaaacttatgattttgtgggagatggtatctggagagtcctactcctccatcttactctgcctcagtccagttgcatataatttgaatcttaaactacaacttagtcttttttcttcaagtatgaatacttactatgtactaggcactttcccaaatgctgagaacaaatatttagcactcacagagcttatattctagtgaagaaaagaagttagaaattaataaagaggaaaatatatattaataaatgatgtaaggaaaaatataatagtgtaaatgtaatagggaaggggaaaagcataaaaggttgttattttggggatgaccagggctggtttccttcataaggagatctgaaggaagtggaggagaagctatcacaaaacctggcaaatagaaccaaggcccttaggtaagaatctacctggaagagcaagaagcccagtgtgccttaagtagattgaacgaggtggagactggcagaagataaatttgaatgtagcagaagccatgtcatgtggggccttgtcaattgttctaaagaacttagattttacactgagtgaaataaaatgcctttttgagcagaggtgtcccatgatctgacgggtggtttttttgttttgtttcattttttatttatttattttttattattattattattattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgcctgccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctctgaaggcaatatgttgggtctgtttatgctcatgcctagcacatatgaggcactaaatacatatttgatgaatgagtggattaatgacaaccaatttaacttgtatcctgagccattcctcttagactttgaggccttaatatgctgacaaatttaagcatcttactaaatcatacattttaaatttccaacacttatgaaagcatcattttaatgcttgactgtgtcataaacgttgaaaatgtaattgtttctttggtcacaactcctccatcttttagcctttctcactcagagccagctattactttattttttcctccctattcattagtaggaaagcaatcagctggaaaaaaattatctatgaaactctcctttcttttgcttctcttgggtaatctcatctttttccttcccaaaccattgtcttagtcctgtgtccctctattgggcactggaaatcagaccagataaacaatctgcttgtccatggagatttgcctttgaccagcaacctgaaataacagaatgtcaaagaatctgagtaccacccctaaaaaatattatgttgctagcactctccttgatttaacaggaagaaaaaagtaaggtaactaaaaccttaaagtggtatggtaaatcaatgttagaaaacactgcatcataaataaaagccatgccatttatttaaagtggtatgttaaatcaatgttagaaaacacagcatcataaataaaagccatgccatttattaaaagtgtgtaatagtatgtattttacactttcattttaatccgtcataatttttcctgcctatataattgacatttctaataggatttatatgcaggaggcaatactaaacaaaaataaaacacatccttaaaatcaaattcctttaggactataagatatataaaggttatcacttttgacttggcataacatactgtgatgctaatgacgggtaacaaattagaatattaattgatttcagtctctgaactaaatcttggctatctggcagatgtgttttttgcaaaattgatagcaaacagctttactctgtcacttgaaattcccacttgtaagaagaggggtgtcacaatggcaaggagtgtgcatgtcattagttgggtaatctgcacagtccagcatgaaacatattcaaaccaaattgcctgatgatatcatccaggccttaatttttttaaattaaggcttaaattttttttaaaaaaaggagaaggaaatggtaaacgcttagcatttttatctttcaattcattcttcacactgttatctaaatgaagcagacaaggttttttagaattttttttattttgcaactttgattttaatatgactagggccatggttggtctgtaaagcatgaactcatgtcatctgaatagctgtgattaaggctttgatattcatgagcttcttgaagtagagtgcacctttctttaagcacagtagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtcgttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccattttttttttttttggtcctataattttactttctctctccttcattccctttagcctacacacatgctcaagattcacatatctgataatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaatattcagttgctcagatatttctgcattattatcactattggccttcatctactgaaaactcttgacttccaggaccactctcctttcttcctcttctttcctccccttctccttcactgactggtccttcttttgttatgatcttttctcccattaggtgttagaggtccttgttttctggggtttctcttttaatcctattccatgtttattctacatgctctttttgggcagtttcattcacctagccattcaaataaaaaaatctcactattattcttgactccttgagcgatttcaccacatattctgtacctgcattcaagttatgtgaactaccttgaacgtctctcaaaaccagccagcacttcactacaccactgtctcccctcatgattttctctcttcctggattccccttccccagtaccctaatacattgttggggttttttttgccattcaagagccagttcaagtgtcaccacttggatgagaggttccctcatttcccaaggcagaaatatatgagtcttctccaacctttcagagttcttcattcaaatctctcactgttttggttacctggggttttctgcctttctcactgaaatgtaaattagccaaaggcaggaccattttcttacacatcttcgtatcccccacatcttgaaagtgtctgacaccaaaggcattaatcaaatccagatctcttctcggcactgtgttgggatgaggaacaacagcaaagctgtccttccaatacatggggcagcctaaacggggaggaggagctgtttcctttgagactaggttaattactgctacaaacaactatttagatatcaaattacaaaaattaacattaaagcaaacagtgcggttcttgtgccatgctcggagaaactgtgatctagaaagcagtagttttcaaacctttttagccaaggattgctttgttcaaatgcagtattacatagatacttaaatgtataaggtcttattttatttcatcatcttctttagtttataattttagtttaattttgactcaaaatatagaaagtgtgtctgtgtgtgtactaccgtgtacgtgtgttttaagagttaccattaaaaacaatcctatggcagaaagttcacctaaagcagtagggttttttttattttttatttttttattttttttagacagagttttgctttgtcgcccaggctggagtgcagtggcacaatcccggctcactacaacttccgcttcccgggttcaagcgattctcctgccttagtctcccaagtagctgggatttcaggcgctcaccaccatgcctggctaattttttgtatttttagtagagacggggtttcatcatattggccaggctggtctcaaactcctgacctcgggtgatccacccgcctcagcctcccaaaatgctagaattacaggcgtgagccaccacgcccagccaagcagtagttcttaatagagatggcactgctcctacaacacagtgtaaatattttgggggtcattttcagtatattaaaaactgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaaatcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctattcaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcaggaattactttgctgaaacaccatacgaatatactttaaaatagctttaacatctattttgtttttaccacgtagcaaaccacagactacattttcactaagcaaagcctgactacaaaaacaaatctacaaagatgacagaataagagaagctgggagactgctgtttctcctcactcatgactatgtagatctcttattgcattgctgatctgtcaggtttgtgctagtttctattaaattgagtaaagaatttagaagcagaaaccagagggaatgtatgagatataccattatatttttagtgcttggctttatttttgtttgttttgattttcctttataagaatactgtaataaagggatttgtacttgatatcttctgagtccacgtgtctccccagcctgtcttttgagtgaacctaggtaactttgaaataaagattaagaaaatattggcccattgaaagatttcctcactaagcaacactttcattgacactgctaccctggagaaatttcaaaaccacttgaaccctctccttttttctcttctctttcaagctgttttcacacatacaagtttttcttaaaaaaaaaagataatagtagacaacgaataatagaaatatatttgaactgataaatatgccattttctgaaagtagtttatatctgtccataaaaactcagaaaagagccaggatcttgggacaataaactataattgatttagtcatattgttcaatgccttgaaggtaaaatgttattttaatgtaaaaatataaaaaattaattatttaatgtaaaatgtaaaaaatttatttttgtaaggatttggatcagattattttaaatcagttaactattgcagtggatttaaaacactgctgttataatcacgcaaatattactacctaaattatttgttatacttcagtagcccaaaagtggtagcaatttatccataatgctgtcttaatcactcacagattcttagccaatattagcaactaaccgaggttcaggagaacattgtttgctatggtgagcatctatgaaatgaggtcatttgtagtatgagctgcaaagttggtcttcccaagttcaaaattctgactctaccattactagtgtgtgaccttgggcaaatgatataatttctctgtaaaataaagacaataatagtactttacctctgggaaggtgtgagcagtaaagtattcgtgtatataaagtgcttaaaacaatgtctggaatataatggtcacattcaaattccataagcttccactgcatatgtatagagcacctactatgtgcaagactgtatatgccataggaaggagttaaatcaaagcacataatttttctggacctcaacagcattacaactcagaacttttctgcgagaaggacttctaaattaaaatgtcttagcaggacagcgatggctctttatgatatggctcttgcatatgctctagcctcctcttcaactgttcgccctcacacagtttgctccagcacgacagttactaaatgtattatccatagtttttctttcttccaggtctttatacaaattgtctcctctgcctgaaattccttacttgccatagcttgtctacctagactccttctagttagccttcagaactctatttttctttaaagcttttccttttttctggtaccaacttcctaacccactattcctcagcaattctccctccataacaagtttatactttgcatatgtttataaattttacttttattattttgtatttacttgaggccaaggacacactgtcttttcatctttgtgtctccagttccagcacaaaatctggctcataggtaggcagaattattattctcctttagctcaaaggccctcatatcaagttatcaagaaagacttccaaagagctcttacgggaaaagggtgagaggacataataatcaaaggcgacattcactgtgaagctgaaccgaaggtaggcgaccttccagaaccattctgccatgccctctaccccactctactttacaatacatctttgctttttctctctccttttatttcttttctccctttcctcgacctttctttaacattatcatcttctgttccctttctttcctccttgcccctgctgatttaaaatgttcattgtttatttttttctctacctgtctcgtggcagccccatctaattcagagtcaagatgcaagcagccaccaaattggtcctccagctaaacagtgtcctcacccccaagcatgtttattccaagtggagatcagggactcggtgatagcttcatctttttgttttaaaaataacgaattgtattgaaatgtccagaaaataagattagttcattttacatgatgattgttatctaacatagcccagtttcctgtgttttcactgagacagttcaaaagaaacctggatacactgttacagtggcttttcctccagtgggtacttgtgtgaggtttgctttgctgagtagctgtttatacgaaacttgtgtaggtttctgtgtttcaccctatcaggcacacaaagcacagcagttcctcttttcagctacattgtcgatatcaccacaaccgtggatatcatttgaagtggtgcttccacgtggcctggacagccatcttctgcccacagtgattggaactgttctgtcatctcacctttctacagctgctgtcattcatccacctttcttttccggatctgctaatgtggctctaatgcgatttacctggctgctttccaggccctcatcagtagtgaatctgttttgctattttgcattaagtagtcttaagcaccagtgctactgacgtgaaaggcaaggtacttccataaaagcttgaatgtaataatctaacagttgagccctgcataattttaccagtgctgcaattacaggaaaacatataggcagtttcccaaagtcagttgtgctgctgttatcttccattggagattgatgccgccttgcctctactctggattacttgatttggccattcccttaggcagggatagttggatccgtatgtacaaggcaccccacacaatgtatcttactgtttattgaaaatctcgtctcccttggcttctgatactcaattctctaattctctttctttccttctaacattctttctctctctctgtctcctccaattgcctacaggtgggtactctccaagcctctgcctctggcatttttctacctctatgatttatttataatttcaggatttccaatactatatgtaaatcacactcaaaactcagtcctcaaacttgatatctctgttgaactctcctcttttgttaaattaactttattgaagaatggtttacatacaataagatgcacccattgaaaatgtatagttctatgcttttagtcatatacaagcaatgtaatcaccacccccaaaaattgcttctagttcctttctagcaatcgctgccctgctacctctagttatgggcagttattaatctgcttttctgttattacaaattagttataactgttccagcatttcactaaaatggaaccatgcacgtattctgtgtctgatttctttcacttagcacaatgtttttgcaattcatcttgcatgtttcagtagtccatttctttttattgctgagtagcatttcattgaatggatatccatgagttgcttatccatgtatttcttgatagacatttaggttatttctagtttggggctttttctttctttctttctttctttctttttttttttttttttgagatgaagtcttgctgtgtcaccaggctggagtgcagtggcgcaatcttggctcactgcaacctccgccttctgggttcaagcaattctcctgtctcagcctcctgagtagctgggactacaggcacatgccaccatgcccagctaatttttgtatttttagtagagatggggtttcaccatgttggctaggatggtctctttctcttggcttcgtgatccacccaccttggcctcccaaaatgctgggattacaggcgtgagccactgcgcccagcctagtttggggctcttaagaataaagttgcagtaaatatttttgggcaactctttaagaggacatatatttattatgttttcgtttctcttaggaagtgcctaagtatagaattactatgtctggtagtacagaagtatatttgtcttactttataaaaaagaactgccaatctgttttctaaagtggttttattatttatatctccacaggtgatatatgagagttctagttgctctacatccttgctaacacttggaattgtctagtctttttcattttagttactctagtatgtgtatagaatatatcattgtggttttaatgtgcaattccctggtaactcacaatggattgtagacctaaatgtaaaagttaaaactgtaaaacttctagaagaaaatatagacaataatttcatgaccttgatatagacaaagattttcttaacaggtcaccagaatcattaagtataaaagaaaaacttgataagttaggatttttcaaggagtcaagccttctgctttgtaaatataccattaagaaaataccaaaaacggctagtcacagaatgggagagaatattcatttcatatatagatataaatatatatgtaattaatatataaatatatataatgattatatataatgacatagaagtcatttccataatatatatattttaaaacttcttacaattcaatacaaatatgagcaaaatatttttaatagacactaaatcaaagaagatatgaatggctaagttcatgtaaacatgttcagcattcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtttgagccctcatctatattgtaagagtctcttaggaggtgttcccacaacgattttccatttatggccagcccattgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgctagctcttctataaagctcctgctgaataccagtattactcatttaatatacttttcatcttccaccaagtggtattactataagctcatatcttccttactagatttttaagaaaactgtagaggttgacccattcctacatagtgccaactacatgttatatgccctacaaggagaaaacagtcaacaaatgtttgtgtcatggataaacagcttgatgatgggatataaaatagaataagccatcattcttacaatctgataagagaaatagaatatgcatggaaacaataacaacgtagcatgtgatgcataataaaacttgtgagagacgtgtagaggagtcatcatagggtaatttggaattaggttagagaggtccatcaatatcaggctgaggttagactttatttaatagttaaagatgagccaggaaccattcaagatattcaaacacagaagtaacataattacagttttgtatcaatctggcagcagtgtgtgggtagaatggattgtgacgggggaacctggaaggagagaaaggcaggacagagagaactgaaggaacactagcgtgagataatgaaagactaaattgctagcaaaagcgcagatgtgacagactctgtgaacatgctgttgacaggtgctgtgtctgggtctgaaggtgtgtagaaaagagaaaatgaaatataatttcagagaagctgggtaaccattccagggttatgccctgtagggattggacaatacgagaaagagttgggcattagaaattgagatttctttgaccacatacaagtttaggttgcattaaataaagtggatatatgttattagtaagactacacagagggggaaaaaagacagaaatccagtgataaattcctaaaatacaaaactcatggaagagtaaagaagttgatgaagagataaatgagctgtcaaagactattgggtaaagtagaacagcagtgtgtcatggaagctaaattaagagagagtttcagagaaacaatagtcatttccatgtgaaagaatgttttttaaagtactgcttaaagtttggaagaaacaaacaatagggaggctctgagcctactccagctccagaagctgcccgttgaaaattttaagttaaaaaaaagaaataaaaatgattaaagcaggcaatctacccttatagtgttttcagtctaatggggcagaagtagcagacttcatcctcatcatcaccattcccatcattttccgagtgcttagtacaggccatcatctgtatattgaattataattttgctaaccctatacacttatgatcccaattttatagaggagtagaaagtctcaaagatgttatgcagaatacattttagtacagggtttaataaagtacatattaaagtgagatacaagtgagctaagatcaaaggaaatacaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatactacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttcattagagagctggaatcagaagccaagttgcagggtgcaggatgagaagttaagaagtgaggaaacagagtgagaatgtgaaagcggtgagcgtgaactgttctcttccataagaggacaagtagaattacagctcatgcacttaacaagatgcagggcaattgggtatgtgctgcggtagtgaaaagaaggagatgaaaataaataggttttcattaccaaaggcagagctaactctcctgcctacttccaaatgctaccacatatccacacccttgatgtcattactaatccctcatatatttgcagcagaagttgcttgtgaacctgggacagaaatgttgatggcaatccaactgataatcttgaatgtgagaaatccttttggatatattcatatggctaatttgctttgactataaagtgttgctgagacctcattaacaaatttgcgatatttcccctgcttctttgatcagagtctccctgtccttggaattctccataagcctcatgcatatagcacttgccaattttatttgtatgttctagttatttgccttattcttccaaattatcctatattctgtggtggcagaaattgatattttgtatgtactgctcctatacagcaggcactaaataattacttttggtttgaaataattttagatactatgtttccctattataaatatgtgtaaaaaattgacttgtagagatatcttagttttctattgctgcataaaagtttaccacaagctattcctctgcagaactaatagccctagtataaccatgagaaaaatatcagacaaatcccaatttagagacattttgaaaatacttgaccagtacttctcaaaactgtcaaggtcatcaagaataaagaaagtctgagaaactgtcacaaccaagagaagccaacggacacatgacaactaaatgtaatgtggtgtcctggaacagaaaaactcagaaaatctgaataaagtatggactttagttaacaataatgcatttacattggtccattcattctaataaatgtgccatattaatgtagaggttaataataggggaaactaggtatgaggtatatgagaaatctctgtacagtcttaacgtttctgtaaatctaaacctattctaaaaaaagtttgttaaaaacatttgctacaatattagtggcttaaaacaacacaacgtttattatctcacagtttacatgaattagaaatccaagcccagcctaacagggtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaattgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaaatttaaaggatttgaactgaaaagcatccttcttattctcattttcttctctccttctttttggtgtcattccattatagccactaaaatagtgtatttttgcagggttagcagcagcatggttattatagtggtgatatcttccagtgcagattctttagagtctgagcattgtttaaaaagaaaatgaaagctatatcagttcactattaattattctcagtctagtgaatccttcaaaggttatattttggtgatggtgatcagttcatatcaacaggttcaggaatgtctatttccaatctatgaaaacaacatagattccaggttggagacacggttccaattctaaacttttgcttaaaataaaaaaatgattaggaagaagtagagtttctgtgcttaatttgatctcagttgtacaacttgaaattatgagctagtatacatgggattggttattagaaattgctagcttgacacattcattttttaaaaagtaattatatattgcaaggtgttgatattgtcttttataagaaatatgcatctaaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgaacaacagagtgaaaccctgtctcaaaacaaaaacaaaaacaaatggtaagtaaaattctgagattctagaaaaaagcgattcgtttactgaggaatgatttgcactggcaactttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtccagcctacactgactttgaatgtgtttcccaaaacataaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcgtccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcaatgactttaccatctctgcccaggatcattgtcacccaccgctcctgaaggagagaatgtcccttaacaagaagagggttatagagcggcttgggaagctagacttcatctacttatcatcttctcttgggctagttatgtctactttggattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggcaggattcaaaacttagccaaaactaagttcttgaaccaaccaggttgtctgctactacatactgcctcctcctcccaaaatgccagtggaagactgtgtgttatatttaatatgtaacttgtattgcacgtgtatataacttctatgtaactttacattgaaaattgtaccttgctgcttttttcctaaaatggtgtattagtcatttttatactgctatgaagaaatacccaagactgggtaatttataaagaaaaggagatttaatggactcacagtaccatatggctggagaagcctcacaatcatggcagaagatgaaggaggagaagaggcacatcttacatggcagcaggcaagagagcatgtgcaggggaactgccctttataaaaccatcagatcttgtgagacttatacactatcatgagaacagcaggggaaaaaccagcccccatgattcaattacctcccatcgggtccctcccacaacatgtggggattatgggagctacaattcaagatgagatttgagtggggacacagtcgaaccatatcaaatagtctccaaaatgttcccattttatcgttttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaaactaaagtcactccagagtggcagagttgtcactttaaagataggccttaatgtaatgttaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggaaggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaataccttcatcactatcattggctttgcacatgccatactctcatttactttacaatttgctaaacctttttctctctctttggaaatcttgatcctcaagaactttccacatgatttctttcatagttcttttgcattctttttctccttagaaactttcattttttctacattggcacaggaaacatcaatatttgatcataaagctaaagtgatagcctggcacagtggctcacgcctgtaatcccagcactttgggaggccaaggtgggaggatcacttgaggtcaggagttcgagaccagcctggccaacatggtaaaatctgtctctactaaaaatacaaaaattagccagtcatggtggtggcgcctgtagtcccagctactcaggaggctgaggcagaagaattgcttgaacccaggaggcagaggttgcagtgagccaggatcacgccactgcactccagcctggacgacagagagagaccctgtctcaaaaaaagaagaaaaaaaaaaaaaaagctaaagtgctccatggttatattaaccttccccgctaagtttccacacatctcagtttagtacatgttgagctagtgaagctgggattctagtttgacttttgaacggcttttttttaactgagatttctatctttagtttctttttctatgtggcaataatggaatgagaactttaaaagttactcaaaaacttcatctgatgaagtaggtagctgtcttggcaagtaaatgcaattcctgaaaattttttccactggaatgatagctattatggctacaagataaggtatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaagaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatcccttaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccatagtatgagataaatgtttagcatccaaatataaagtacttttaatatcaatttaaagcagagcatttcttttattttaaaaaatagggagttattaaagatttttactagtattttaatcataagattaaaatattttatggaaattatgcaaaagtcttaatgaagaacagaatctgaagaccagtagacatgttagtggtcaattccaaaagacgaggcaatgtgcataaaagatattgttctctttttcaatgtagtacttattttcgcctctactcttttattcacgttgcctctctttcacccatcagcttcgcatgtgtgaattttacacatttttcatgatacccctttcataagtccattccagttcttctcttctttctctggatttccacttttttttaacttttgcctctgtcttagtccattcctgccgctataacaaaatatgtgcgactggataatttttaaagaacatgcatttattgctcacagttttggaggctggaaagtccaagatcaaggtaccaacaggttcagtgtctggataggggcctggtccttgcttctaagatggtgccttgaacactgtctcctcacacggtggcaggtggaagagcaaaggggcaaatactgtgtgaagcctcttttataaggcattaatcccattcacaagggaggagccctcatgacttaatcacttcttaaataccttgacttttaaaattaccacactggtgatgaagtttcaacatatgaattttgggggacacattcagacaataatggcctctgaggcaattatcgttaattctatctggaatcatagtcatttatctcttatctcaattattatgattttctggaaaattaaggggatgccttgatttctttttatcacccttgtccagcccagtggctggaacataagggttcagtataaggttgacagagcattcagttattgggggtgttagatggatagagtgatagaagtaaagatgtacagttgctgagaagtcaaagaataaaagcaacagattcaaaggataaaggtttttttaatctagaaattttaaatttgtttccaattccaagtgtcatagaggttgggaaaaataaagataattacatttagtgatgagtttatcacctgtgactttacagtgtatggtttttatagagcagatattaaaattttagggagggtattcaaaagtcaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggcctagaattaacataccactgctgggatatatagagtataatgcaaagtaacacaagcaaagtcagtgatacacaattcttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccatttaaatcttccttaggatgccccacattaaagtaggtgaactaatcacataacattggtgcaaaccaatgagatttctgaaaaaaatattttaagtgaatcctccattaatggagagttgagaagattatttttagatccaaaagacaggatttaatagtaagtgagatgaatgagatggataaagggtacagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggggaggaatttggcagtggataggatgtaaatgagtaccaaagaagatggagaaggctaactttactgaagactaaaatgagagtcaagaggaaatggtatgttcaacaaaatgcaaataggcaagaaaggcttgcttctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaggcatatggctattccggcttagagttgttgaagggcaaccactatgcaaattattccctcttctctttacctctttctttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcttgagccaccgcgcccggccctctttacctctttctatatcttccatctgaagagttggaagtgtgagtggtgagaaatcacatgcatccagaggagacagactctaaaggacatacacaactctatggaaggactagactagcagcccaatcaggtagttaaagaaagaccaaaagttattggtttttctttagggagatggcatcaaagcattttgagccagaagttagtgctaagtacctgcaggaaggatgtagaaacaagggtcttgtcatttgcagataaccaagcaggtaatgtggcagccaatagcagcagcccagccttggtgatgactttactcctatcaatgaaccaacaagagaaggttaggtcaccattcctggagaaatggaatttaaaatttttcatgttaacagcagtttaggagaatgaagcctgttttagaaattagagtagaatgtaaagtatcaaagttttgaaccccaacatcagaagtgaatctccaaatcagaataaggcaaattaagaaagctagaactccttaaagtccccagaccaaataaaaaaaaaatagggttgggtctggaacctgtaatatgatcattatcattaatatagtgattattaagcactttacttgaatcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcactctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattaccctgattaacaatgaggaagcattatttttccagagaggaatttgagtgcttttaccaaacaatggatatgaacctggagggaaaaaaaaaatcaattaaaactccaaaatccaaattcaggaaaattaaatgaggaaatctccccagaaaataaatagaacttgctcagataagagaaaatggaaatttgagtcaaaataagcctccttagtcatcaaatctagatactccctcacccagtcaacaagcgcaggtagcaaaatagtcttcccataaagagtaagttggtggatgaagttgcacttctatggataaccacactctgtagtcatcgcctgaatgcattgtctgaggtttataacttctatttatagaagttcagcactcaccaagtgaagagctctgggctatagatacttgcttccttccatggacagtaaaaagtgtgttcaatcttgacttaaccccaagtgagtagaactcaggctgttagtgattgaggcctcaggcttggtaatttataaaatatactttgcttttctgttttatggaggaaaacctgcttacttccatgctttggaaaaactgattcaaaacgtgtctaatatgctgacttcaactaagtgtatagtaactgataaatatctcctaatggagttttatttttttttccaataacagtgttatggtagttgaatatatgtttttcttaacaagatagatgattgatagatagatagatagatagatagataatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgaatggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcatttaactttctcagataaagtcaagtaatggagaaggaagttccagagctagttgacaggttgagccagtaattctgagccttctctgaatcattaaagaacagctgtggcagctccaaacatcatattcccacatagcaatacaatcaggaagtggaatggtggggagcaaaggcaaaaaggatcttttcccctagtgctctctcttttatcagggaggaaaatattttctgaaagtctcctccaggtttccattatatcttactgttagtgctaaatcttatatccaaccctagaccaatcaatgacaaaaagaaaaaaactataagcttgccacattttatcatgtttcactgtattgcactttaaagataccgcagatttttttacaaattgaagatttttagtaaatctgtgtcaagcaaatcaatgccattttccccaaagctacgctcactctgtctctctcatgtcacattttggtaattcttgaaatttttaaatctttttcattattattgtatctgttatggtgatcggtgatctttgatgttactattgtaattgggggcaccaagaactatgcccatatgagacagtaaacgtaatccataaatgtggtgtatgttctaactgttccaccaaaagccattgcccagtctctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagcaaagttgtgaacgtaaaggaaaagttcttgaaggaaaagtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtgctgatggagaagctgccacaagttttccagaagactgatgaaggtggccacactaaacaacatgtcttccacgtaaataaagcagccttgcattggaagaagactttcataggactttcatagctagagagaagtcaatgcctggtttcaaagtttcaaaggacaggctgactcttagtagggatgaatgcagctggttgaagccagtgctcatttaccattccaaaaattttacagcccttaagaatgatgacacagctactcttcctatgttctataaatggaacaacaaagctggatggcagcatatctgtttacagcatggtttattgaatattttaagcccattgttgagacctgctgctcagccaaaaaaaagattattttcaaaatattactgcccattgacaatacacacagtcacccaagagctctgatgaagacgcaggaggagattgatgttgttttcatgcttgttaacacaacatcctttctgaagcccatggattaagaagtaattttaactttcaagccttattatttgagaaatacattttgtaagactgtaactgctgtatatagttattcttctaatgcagctgaggaaagtaaactgaaaatcttctagaaagtattcatcattctagatgccattaagaacattcatgattcataggaggtcaaaatatcaacattaacaggagtttggaagaagttgattccaatccttatggatgactttgagaggttcagaacttcagtggagaagttaaatgcagatgtgataatggcaagagaactagaattagaagtggagcctgaagatgtaactgaattgctgcaatctcatgataaaacattaacagataaagaattgcttcttatggatgagcaaagaaagtggttccttgagatggcatttactcctggtgaagatactatgaacattattgaaatgacaacaaaggatttggattactacataaacttatttgataaagcagtggcagggtttgagcagattaactctgccttcaaaagaagtttggctgtgggtaaaatgttatcaaacagtatcacaggctgcagagaaagctttcatgaaaggaagagttggttgatgcagcaaacttcatagttatcttattttaagaaattgccacagccaccccaaactttagcaaccaccaccctaattagtcagcatccatcagccttcaacacagaagcaagaccctgcacctgcaaaagattatgacttgctgaaggctcagatgatcgtcagcatttttttagctataaagtgtttttaagttaatatatgtacattgatttttagacctaatgctattatatacttaacaggctacagtatagtgtaaacagaacttttatatgcactgtgaaaccaaaaattcatgtgactcactttattgcaatattcattttattgtggtggtttggaaccaagcctgcaatatctgtaagttatgcctgtacaaaactgacttaatttggtcataatccatctcacacatctgggaaaggaacctactattcttgagtaaattaatccctgcataataccagaacaattcagcactctcttagcaaaaagtaaggaagaagaatgtctatgtaaccaggaacgtttttcataagagtaatggccttctacaagactctgtggaattgaaagatttcttaaaatgaggtgcccttgtgtttgcagtatatgcagttttgtctcaggagagagttttgggtctactgagaagaaactgaggtatactgataagtttcactgcttgtgtattgtagtggataatgtggatttctaaatagatttgctctgccacattattagacagatgcctaataatttaatgtacattaaagtatgttaatagggagaatgtgtaatcataaattaattaccaagattatgattatcccaattttaaacagtgcttgaattaaaatatatccctagaatacaaaatgaatagtggcttacgtgttctaaggtgagagataagggctctgcaaccacttgtggctttggaaaatgacatattttgcagtttgaaagcatggatttcagttaaacattaaaagcagatgactgccatgactatctgtaacatgatcatgcaggacaatgagagaaacggcaaaagaaattctgcctttcggcacatattttctctactaatatttgcaatgccaattttcaacagcacaggtgtatttaattgcctctgaatattgcaatgcaaacccattcaatgttgaaaacaggagcccaaaaaggaatctcaggctttgttggcctgcagaatcttgtagctccagattgattttaatatatccagggaattttttttctttgtcattgcgctttctttagaagggcatttaaattatcaaaccattaccttatcaagcacaaatgtgatgccaattcttgtgatttctgagttatatgtgctaaaaattacatgagttctattgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtacttacacaatatgagaatattatattttacgcagggtatacccatgattcatctttaaattaacttcaggaaatctcaaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgggaaaatagtcaacctgtatccttctcataccataaatcagcatgtttgatcactggaagcttcattttgatgattagcagtcatgtattgaggctaaatgatatgtttgtcgcacagctaatattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacccccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagaatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaaactgagagttcttccaaggatagagtgtgtaaatgctgacctacattaaatacaagtgacatggatttctgggcatgtgggacgccttggtaatttgagtgacaaatcacgtatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaagcactagattttgtgtagaggttaccccttaggaagagagaaaaggatgcaatcaaaggtagtcatatgtggccttagtagtacccatacttttttatttcttcactgagtgtgggtaaataaataattttttacttgacttaattttaataatatttgaaagaattaaagaagtccatgaggtaatgtgaaaacttgtaatgaaaaaggctgaatacaaaattgtatatgctgggatgacaactctaaatgtttgtgtggagatggggacaagaagaaatagaaagagttaacttgctaagatggcagaattatgagaaatttggacagaaattgatgagaaaagtgatttgaggttttggtgatgaagaaagggagaatataacctaaggaagattaaagatttcacataaaactaggaaatgtttagcataaatcagtttcaccaatttgaacctggtcttcctctctgtcctctcccttgtactcaccaaatcattttacaatcttccaataaggaaaaatacttcctttggtatgaatgtctagaattaatatttatagttctacaaaaaaattcagagctcttaacctaaaacaagtgaaagtacaatcattgtttttaaatgttacaaatacaatacctgacattaaattgtatttcctctatattgcatattctgaatttaaaactgtctaacacctttaagcttaaagcttaaattaggcatgtaaaacaagataatgacaaaagaaaagaaggccggatgtggtggctcatgcctataatcccagcactttaggaagcaaagactggagaatgcttgagcccaggagttcaagatcagcctgggcaacatatggagaccccatctctataaaaaaataaaaatattagccaggcattgtgtcatgcacctgtggtcccagctactcaggaggctgaggcaggaggatctcttgagcctggaaggtaggggctagagtgagctatgattgtgtcactgacctccagcctggatggaagagtgagtccctgtcacaaacagaaacaaaaaaactcatatttattttcagaagggacttgattatgtggagccatatggggcaaagtgcaaatataccttagaactactttaaaatacctattattttttctataagtatccacagccagaaagagcaaaacttgctgagtatgattggcaaaaagattttcttttgttttgattccaccgttccttatttttcaggccttgaataaagtcaaatacagaactcttatgaaaaaattcagtgtagaacctataatttagctgcgattgttctcttggttttattttattttgatcaatttcagtcaggttcccttgatttctctgaaactggagagtattgtattctaaacgaatgacttgtctttgctagttgaagtaaataagcaattagagcaaaaggctgtttcattgaacttcaaagaaaattgtttttaagattctgttgttgttctgtggcccctaataatgcagacggtctttatacaacagaaatctgtcagagaagaaatttttattggtagctaactttacacacacacaaacacatgcacacacaacttcagaagcagaagcacaaggtacttcctcagagaaccacaaatatcatcaaagtcttattttgacataatgctactttaacaagaaattcagatttatggaatgaaaattgctgtagtaacaagtattttgaaatccaccctaatacccagaaagtgacagcaaatcccagtgcttcagtaactctgagccagttaaactgtaggacaaaattctgttgtgttctagtatcactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgcagattcttcaaacagaaataatagctttagttagtgtactttagagccataagtttaaaacccagcaggagaatataaatgatggccaggcaagaaaaacaaaactccctgccaaccttcactgcctacaaaacttaatgatctatgccacatctactatttgtaaaattctttcagaaagtatccattcttaacattaagaaatgtctaccttccttcctccaatattttcaatctctctgccacactatgtttatattctctcagaattctagtggatcccattgtctaagacttaaaagctgttattttatactggattaactttaatcatctgtatttcttccaaattgtagagattgcattggtccaattttcttttccttcaatttttaagagaagcaaatcaaaccaagtctttaaaggaagcacagcaagtctcagataattttattgtttgggcctaattattttaaatgttaccaaggaatatctttaggttaaaaaaattaaattttagaacagaatttgatatatatttcttattatttaaaatgggaaagggcattagcatttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactgttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattcttccctctgttgatttccctacaaaacaaataggcaaaaaagcagctcacaaaaaagatagagtacatagaaaagagaaaaccgaggcataagacagcactgtgtgcttcaagaaagtcctggagcaaagcttggagcacagggttcaggtgagaactgaagttatattagcataaacatatggtcgcttactgccccctctgcaatgtccagaatgcattcctaattttcattccatttgtctccaatgcgtgataggacttcaaagagtcatgattaaagaaattgttcagtgcaattagtcaccacttacaagtcagtgagctcgcattctggggtgagtgctaagctttttcaataggagatagcacactccattcacttctttgttgttctttcttaagatccttcttctggtgattttttttttttttttatgtccagagttctactattttctttctttctgcctaataatacttaatttaaaataaatacatcttttcagaaataataatttcatccttagtgaaaacatttacccatatctgcccactatattttgtgttttatattctttcatttaaaagtattaagatgaacttcaattataaaatcttacattgcttgaaagacatttgcctaaatatgttatgtgtctactgtagtttttcaaaaaattttgatttaagaagccacaagtatattaaaataattctatttcttccaggaaatggctggatttagtgatcctgtaaggttaaaaacattataatatttgtatagtgaccaggctcttgatttagatggttacatataagcaaaatactgaatgaagacaaaaaacacagctatcccttttattaagtttcatagcttttaatcccctaaggaaatcctttagctatttcactattttactaaatcatattaaaatgcaaatttccactaatattacaattctagtcaaaaccaccaaaagaaaacatgggctcttaagcttttttttttttaagtatgagcacagacagcagaaaataaagctttcctgtaagtgaatatggcatctacatttgaattatgtacacagtaaaggactaaaaattgtgtggtcctaagtaagtttaaattctattgtctttgattgatttgaaatagaattatcagagattggattaataaaaagagcttgacagttcaaagaagtaagcttgtgattgggctatgattttttccaaggattttttgggcagtcatattattttctgtaccttaaatttaccatctatgaataaagataatattgactgcatgaaataataagcccagcaactttttttttttttttgagatggagtctcctgtgtcacccaagctggagtgcagtggtgtgctctctgctcactgcaagctccacctctcaggttcatgccattctcctgcctcagcctctcgagtagctgggactactggcgcccaccaccacacctggctaattttttgtatttttagcagagacggtaaactattcagtggaaacgtgataaagttgtttctcaatgaaaaatgatcattataatgtaaatgtgcatgtaactagttattgaataataaaagttgaactcaaggtagctttttcagtcacttcaaatacttggccaattttgaaggaaaaaagaaagcagcacccaaaagtctattgttgttgatgcactatagaattgagagtgtgttcaagcaaaatctagcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgttagctactttagctattctacaatatggtgtttaggatcaaaccagttgaggtcatgtgaaagggtctcagaaagtgaaaaaaactataaatgaaagaattagacaatactgcaagtgctgcatgcaagaagagtaaaactattagcattactaatacaatgttaagagaatcttttcaagaggatctgctatgcaaaaattatttagaaaaactaattgacagaaaacaattgagtctttctgtcatttccatagtctatccagaataaagagtaatgaacacgtgcatacgttttctaaataatctggaaaagttgatattttttaagtgtaccacttagatttaataaggagtccagtggagccatgcttacactataggtaaacaatatttgaagaaagctttctctgcctctgattatatttttatttattcaataaacattttctaaagacttagcatgtacttaactgacatttcatggaaggcaaaggaaaggaagaaagcagtatccctcttcaggtagcctcccccatgttagaaagacaagtcacaaagctactagaaaacaaagattgatatatgataatacaaaacaaaaggagtgaatacatgcagatgtgaaacaaaataaagggcttatatatggtattactcaggtagacatttggaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagttgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacgccctgttcttctccacccaagcatagcagccatgcaattctgctgtcaatgcaatcaaatctttccaagttacagagaattctaaaaacgtcctcacttgtttctagaatcttaaaagaaaggtagtggaggaaaaaaaatccttccaaaaaacaagtaataaggcatttttgtttacttattgcttatagctgttggccttaaattataaaatatcagggaatatatctgcccctttagctgataatcttttatcataattgaatttaatctcaataacattaaattgcttagaaaagaaacaaagtagatattaagatattgaattattcagaagctatcaacaggggccatgttcaattcttggaatgaatttctttttctcaggcatctttgccaaagttggaaaacaggttaacaaaattgttaaccaaattgaaagtgtcaaaataaagccaaatacaaattgggtcagaatccaagagctgcctattgtgaagtcttctaacgtaaaagttgaaaagaaagttagcttccttgacaaaagaaaaaaaagactaagaggttatgtgtttttagttttgaacttagaaatcagaactcaagaaagacatactgaaaatttcataggatgaatggatttccctttaaccacaatattgtgttgtccacagcatgaatgaaaactgttacaaacttccaaaggcttcagatgattagcctgtgaattgccttcacctctgccaacttacctggcatcctttacgtttaccagcgcacttctccctggagcctgcagacagcaagctcctgggctgactgtggaggcttatctaaatcctctgaaagttgtgctggggtttatctctgcctgaagacccatcattttgcatgtcaaatgtcagacattccaatactgtgaagatatagatggctttgccttatcatttaaagcagactaatattattataggcattttataaaattaattatttgaccaatacatgtgcagataaaacgtccttcattcaactaacttccatcatcaagactaatcattgcctgcagtgagaaacatcagtaaccttaataagttattcagtagggactgtgaatttgttcaacagcacaggaagtacagaaatcagatcaaagggtagaggatctggtaaaaatttatcgaagcatagattgtgactttgtgtatatcaaaacaatatgatatactttactaaagttttgatgtattgacagttgagtttatgggcaaagagaggcagatttacgattctattaaatgttaaggatttttaaaaaatcatcgaaaaaattgtattcatttgacatgtaaaataagtttgccgtgactatatagcagaatcaaaatccattaaccatggattaatcattaaccctttaatttggaattaagatgatatgtggtatttttcacagtatttcatatatgttagtcaaatctgcccaagcagactgtaaactaataaattatttcaaacttgttcaaatggatgagtgaatgaatgagtgaatgaatgaatgaatgagtctctcttctagattactgttaaccacaatttatctgccctaaaaagtcacaggtaactgacccaagtcaatggcttggagcatttttacagtatttttgcacagacatatattccagtttcctctttgtcaggaacacaaattgaaaagagaaatagagctatgtgggaggagaatgtgacatgtattcttaaggagacaattctgaaggctatttggagaaggctacatgaatttactacaaggaaacatcttttcatctactatgatagaaaaatctaatgcagattttgataagtctgtatcatattgaaagctctgtttaacagagtaatcactggctgacaaattagattaaaaggagtctgaaaaccaaaggaaagaaaggaaggaaagagaaaggatgaaagagaggcaggtaggaaaagaaacggtgtcttccaaatactattttcaccgtggagcaagaagggctttggagcatacctcagaacgtagctcctccatgaagtcgtttttgaattccaggccccttttatcttgcccttctcttttttttttttttattgaatatcaataaatttattgaatgccagattctgggctcaatgttttcatacatttgttcgcttaatccttacagcaatcctgtgaggcaggtagtgttctcttaatttacaggtagaaaactgtgaaacagagaatttttttattgtaaataaagtccctctccatgagctttatatatatatcttgcccttctctaaccagctacctataaatcctttctgctccactgaattttgtgcttaactgtattgcctcctatctctagttttattttctgggagttagtctttctaagctcctagggaaagggaaccatcctttctgtgttctctgttctctcactccacctctgcataagttctctcactccacccctgtatagtttaaacacacagcagattgtcagtaggaaagaaatgaacggttaaatgatctgatgcaggaatacgtttttcctttggccttggtgtgtcttgccttgatgctctgagaaacaggtttttaatttggagtccagttgtcttccagacctggagaacaataatctgcactcgggtaccacatattaccaactgtatgaaaaagtacacacacacacacacacaatgcacacacggatatatgcagtttcccatgaagagtccacaacttttatcatattttaaactggacatatgattcaaaaaaggtttagaactatcattctaaaggaaaaaagatacttcagtaccctggggccaagaattggtagtctttgaagccattttaggctataatgagaaattcttcatttggacctctgattgatttaatcttaaattatgttctatgagactttacatactttttcaaatatgcatttaatgttctgtctccagaggtggctaatgagtgtattaatgcacatatttccagaacttttttccatttgtattgtataatttagaaaaagcttgtttttatttttgctgatttttgaaaaatgattatccttgtgtgtttttgaaaattattcataaacagccccaaaagcaagactttgaaaaagattttttgtgctagttaacagcagaataattatttccatattatattctgcaccttgcatctacttataatgatctagaaagatgatggattattttgagtaaaactagaaattggcaaaaagcatcagtaaatataagaatgaagaaacatgtagattattcataaaatgaataatgcacacattagtgcagtggtgaagcattcataagacaaaatagagatatgttgaaggtagaaaatgcttgaagttactgctgaatttttgtggtgaccatagcaatggtattacctgtattgtcttgaggctcttggctgaaatatctgggactgttacaaatgtacaagcttatatttttccagggatgaaaatatagctcatcctgtgaaaaagatatggatttaaggttgtttcttaatatgataaatgccaatggaactaataatacaaatctgcccttaaaagtgaaaccaaggcagaaatacaaaagacaatgaattatgccgtagattaaaccaagatcccagtgagtaaatctaccaaagttttccagcctaggggacagaaatagctgactatgaatgggaatgaggatgaagagaatcagtgctaaggaaaagccccttgagatagtggcgtacttcaaagactgtccgctctacttctacttgagcttaagaacatggctatgtgggtttccttcaagtcatctaatatttattgagcactgactcaggcattttagggactgcaaaaaagatccattgggaaataaatgcgtagaaccgcatagagcctgcctccccttagccatagggcacattgtataaattagaaaaggggctcctccccaattgttcattcagtaggtgtgagattcaatgaatgtctgatgaacaggcctcagatttggaagcatgaacttgacatgcacagctgctagtctataataccaaagattttcctttttaaaatgtatactctgcaacacccttgctcttggtgaagatttcatctttgttttcacaatgctcaattaaagagaaagatatttggagcatttacttttaaaatatatatatgtcaggactccttaagtaaataattttttaaaaaatttatttagtgccaaaactccctggaagaagaaataatgacgtttttccatccgagagttatatttttattgtagaaagaatatttgttagttggcttcacaatagttgtatccctgaagcactaaatttgtatacaggagcctattaggccatgtagatttcatttgaaaaatgtaccgtattatgttctaagagctgagtttagcaaatatgagaaattgagttcttttagtaaaataaataagactgagattttaacacctgggaaataaataataagcttcatgattgcacaaaccatccttagcactgtatcccaatcctgagaaaaatgccttgcacatagtagatgctcaataaatatttttctttgcacaatttttaactgctcaatttatgcctacttgtcatgaaaaaacaggctttcttgataaaggaagatctttttttcaacaaaagacttgctaatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattgaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaacgggtaaaatggacagaggagataattgatgggaaaagagatcagatgggagataatatcaggtctacaccttataaatagacataaaagaagagtaaaacacattgaaggagaaatggcaaagcttaccaaccagttggatttgggagtatgtatttccccatttttccaatggggtaggaaacgacagaagcaccgacagagccatggagctgttttggagaactggtttgggaaggagataaaggatgcacaaagcattctatagactttgggaatacactcctggagtatagaatagggagtagaatagagtaactgaacgagtagtgaggcatgggaaagcatgtgctcaacaatgagtgaatgggaagataaccaaggggctgagaaccaccttaagtagcaaccacattcaagccttgagaatagaaagggaaggagaggggaaaaatgtagagatgtagcagaacatgctggtagggaacagtaacatgaaaataaaagcagaagaaaattttaagaaggattatgtgatcaagattttctaataccacagacagtgttgtttgggtttgaccaaaaaaagctattcattatcttttggagaatcctgagtacaatgttagagtcttgagactggttgcagaatgaatagatagaaagggtagataagaagaaaagacagttttttacccccaagatagcggattggagcctttgttagtgtgcctcagccacttggagagagcaaaatagtgtgtgttaccttttttctttctttttttttttttttgacaatatctcgctctgttactcaggctgcagtgcagtggcacaatcatagctcatggcaggctcaaactcctgggcttaagtgatcctatcacctcagctcctacatagctgggaccacaggtatgcacaacatccagctatttttttttattattttttgtagagctaaggtctcatgttgcctagatcttgaactcctggactcaggtgatcctcctgcctcagcctcccaaagtactggcattatagttatgagccaccatgcctggccacacattgtgaacttttatccaagaaggaaaagagaaacttaacagaaaaagtgaaagaaacttcactttcaaaggagcagtaggcagtgaggcagaaaactgtgagtctccaaagggcaaaagagggagagaccatcaccatgattctcatttccactgcagagcctggcaattcaggccacaggggagcgccttaaccctacccagcactgaagctgattttgtgagcagcgaggaggatatgaggagcggcatcaggacacactttgcaggcactcctagaccccagtgaaacagaaggaagacattcctgatcctaactcgtaaaatcctccaaaagttggcaagttaaactcagccagcgcttagaggttgccagaaactcccaactgtggtggggcgtgatggctcacgcctgtaatcccagcactttggaaggccgatgctggcagatcacgaggtcaagagatggagaccatcctggccaacatggtgaaaccccgtctctactaaaaatacagaaattagctggccgtggtggcacgcactggtagtcccagctactcgggaggctgaggcaggaggatcgcttgaacccaggaggcagaggttgcagtgagccgagatggtgccactgcactccagcctggcgacaaagcaagactccgtctgaaaaaataaataaataagaaagaaagaaactcccaaatgagattcgtgatctaatctcaagtggggatgaaccccgaaggccagagctaagcacaagtgggaagtgtgctcttgccacaggtgcgggagctggacacctctgctttgcgggtcaatccaggaagggtgtggcctgagagccattgtttgtgtcttgagtgggaagtcttgcatcctgggtcagttttgtattctgagcatgaactgcctgagattccgctggcagttacagctttcttctgctgaagtctgcaggtgtgagacacaccatgtcaggggcatgagagctgagtgggtctcactgtggtctgctgcccctctcttcctgtgcagactgttttgtgcagcagaaatggttccactcctctctggaacattaccccagtggccaggaaacttcctttcaacctccgctgctttgcatctgcacttgggcagccgcagcgcaaacttggctcacccaacccccacacagcttcacctcctttatatgccttggtagcagacaatggatagggacttttgagagttcgatggccccacccatctcctgggatatctgagtactcttcctgggtaacctaggccatgcataaatcccacagccacagctggctccctcctgaaagtgtcacctcctggcaggaggtcaactggcacagccaattacaacatctgctgacacaacatagtactcatagtgaacatgctcactgtagctggcaattgagaaagccaccacactaaggctatttataaccaaggaaatcttagagagatacatcacttccctgtcacccccatcagagctggtgcttgcacctgccactgggagaccagaggacagatcagccttgtccagctccacccaccaccagcatgggttgtggcagccccaccaggtggctagatccagaggagcaggagaattcacagtcttctgaccctaagggactgccactcctaggggaaaagggagtgcaccacaccaagggagcaccccacaggacaaaagaaaccagagagtttttctctattccagaactttctgcttgtgggcaaagaacagctgcatctctttaagcagaggcacaggcagagtgctgggctcagtggaggaagactatggctctgcacagcagtcaagcagcccctgtgctcatgaagagatttggagaagggtacttcttgtctcccttggccattgctgcaggcacacccaggaattctcctgtgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagccgcctctatcagagctgggacttttgcccactattgggttttgcatttacccagctgcttcagccacaggcagttcttacccttaggtggcttctactggcctgaaggctgaactgttcaacccagtgaaaaaatactgagggtgtggggagggaagtacacatgactggggaatgaggtaagcttcatgagacctctgccaccctagccccacaggagacagtaaacctgcttacacatccagtacatagctactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctttaaaaaacaaaacaaaaaaaacagaattagtggggcgcaatgactcatgcctgtaattccagcactttgagaggccaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcctggtgacagagcaagactccatcaaaaaaaaaaaaacaaaaaaaccagaacttctagaaataaaagacttgcttagggaattacacaacgcagttgaaaattttaacagtaaactagaccaagcagatgaaagaaattaagagcttgaagatgaggcttttaagttaacccaatcagacaaaaataacaaaaacaaaaagaaataaagtctccaagaaatgtggcattacataaaatgtcaaaacctaacaatccagaagaagaaggaaaaatgatgaaggaaggagaagaagaagaaggaagaaggaggaggaggaggaggaagaggaggaggaggagggagaaggaggagaaaaggaagaggaagaggaagaagaaggagaaggggacaacaataaaatgtttagaaacctatttgagaggacaattgaggaaatattccctggtcttgctggaatattagacatctagacacaaaaagctcaaagaactcctgggagatacattacaaaaaggatatcaccacagtatataattatcaggttatataaaatcaatgtgaaggaaagaattctaagagtagtgagacaaaataacttataaaagaaataacatataaaggaaatcaaataacttataaaggaaaacctattagactaacagcagacttctcagcagaaaccttctaaaccagaaggccttggggtcttgtctttagtcttctaaacagaagaactatcagccaagaattttgtatcctgcaaaactaaatttcataaataaaggtgaagtaaagtcattcccagacaaacaaatgctgacagaatttgtcacaattagactacctctacaagaaatgctcaaaggaatggtaaacatcaaagcaaaaggttgatattcaccagtataaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataaatttttagagatttaaatcctaccaagtatcttctcagaccacagcagaataaaactaaaaatcaattttaggaggagctctcaaaactataaaaaacacatggaaatttaaaacctgcttctgaatgatctttgggtcaatgatgaaattaagacagaaatttttaaaaatttttgaaaggaattataacagtaacacaatgtatcaaaatctctgggatacagcaagagcagagctaagagggaagtttacaatgcttaatgcctacacaaaaaagacagaaacatcacaattgacaagctaatgtcatgcctcaaggaactagaaaaacaagaacaaaccaaacccaaacctagcagaagaaaagaaataataaagagcagaactaaatgaaattgaaaccaacaaatacaaggatcaatgaaacaaaaagttggttatttgaaaagataaataaaatcgatagaccaatagctagattaaccaaaaaaagaagaaagagaatttaaataagctcaatcagaaatgaaaatgaagacattacaacagatactacagaaatgtaaagtattattcaagattactctgaacacctctaagcaaacaaactagaaaatctagaggaaatagataaattcctaaaaacatatagcccccccaagcctgaatcaggaagaaatagaactcttgaacagaccaataacaagtcttgaaattgaattaatactaaaaaaaaaaaaaaaacctcacaacaaagaaaagcccagaactagatgaattcatagccaaattctaccagtcataaaactgacatcaatcctaccgaaactactccagtggatcaagaaggagagaatcctccctaactcattctacaaagccagtatcaccctaataaccaagccagaaaaggacacagccgaataggaaatgtccctgatgaacatagatgcaaaaattctcaacaaaatactagaaaaccaaatccaacagcacatgaaaaaattaattcaccgcaatcaagtgggtttcattccagggatgctaggagggataaatatatgcaagtcaataaacatgattcaccacataagcagaattaaaaataaaaaccatatgatcgtatcaatagatgtagaaaaatcattcaataaaatctagcatctcttcctggtaaaaattctccacaaactaggaatagaaggaaaaggaacataactcaaaataataaaagccagatacatcaaacccatagccaacatcatactgaatgagggcaaagtagaatgtgttccccctaagaaccagaacaagacaagggctcccagttttaccacttccattcaacatagtactggaggtcttagccagaacaatcaggcaaaataaagaaataaagagcatccacattggaaaagaggatgtcaaactgtctctgttggctgttgatataaatgtatacatagaaaaccccaaagactcctagatttgataaatgaatttaatgaagtctcagggtacaaaatcaaggtacgtaaatcagtaccactgctatatgccaataatgatcaagctgagaatcaaatcgagaactcaatcccatttataatagctgcaaaaaacataaaatacctaaaaatatgcttaactaaggagatgaaagatctctacaaggagaactacaaaacactgataaaagaaatcatagatgacacaaacaaatggaaaagcatcccatgttcatggattaaaagaatcaatattgtgaaaatgaccatactatccaaagcaatcttcggactcaatataattactgtcaaagtatcaacatcatttttcacagaattagaaaaaaaaacactaaaattcatatggaaccaaaaaagagcctgaatagcctaagcaatcctaaacaaaaataacaaatctggcaatatcacattacctgacttaaaattatactacaaggctctagcaaccaaaacagcatggttgtaaaataaaagtaatataaaagtagacatatagaccaatgaaacagaatatacccagaaataaagccacgtctctacagccaactgatcttcaacaaagccgatgagaacatacactggggaatcgatatcctattcaacaaatggtgctgggaaaattggatagccaaatacagaagaatgaaactggatccctatctctgaccatatacaaaaaaaattaacacaacttggattaaagacttaaatgtaagacccaaaaccataaagattctaaaagaaaacctagggaaaaaaactcttctcaacattggtgtaggtaaaagatttatgaccaagaccccaaaagcaaatgtaataaaaacaaaaataaataaataggacttaaattaaaaaacttctgtacagctaaataaataatcaacagagtaaatagacaacctatagaatgggagaaaatattcacaaactatacatccaacaaacggctaatatccaagatccacagggacctcaaatcagcaagaaaaaaagataataatcccataaaaagtgggaatatgtgaagagagatttttcaaaagaagccatacaagtggccaacaaacatatgaaaaaaatgctccacatcactaatcatcagagaaataaaaattaaaaccaaaatgagataccaccttacagtcagaatggccattaataaaaagtaaaaaaaaaaaaaatagatactggcatggatgctgtgaaaatggaactcttactcactgttgatgtattaggtaaattagtacaacttctatgcagaacagtatggagagttctcaaagaactaaaaacagttctaccatttgatccagcaatcccactaatggatatctacccaaagaaaaagaagccattatatcaaaaagacacctgcacttatatgtttattgcagcacaattcacaaacgcagaggtatggaatcaacctaagtgctcatcaatggatgagtggataaagaaaatgtcagatacggatatagagatatagatagatatagatagatagatcatggaatactactcagttataataaaagaacaaaataatgtctttttgcagcaacttggttagaattggaggctattatcctaagtgaagtaactcagaaacagaaaaccaaaaactgcatattctcacttataagtgaaagctaagctatgggtatgcatgggcatatagaatggtataatgaacactggagactcaaaagtgggaaggggatgagagattaaatattacctattggatacaatgtacaccattcaggtgatgggtacactaaaagcccagacgttactactatacaattcatccatttaaccaaacccctagagctactaaaataaataaataaatgaaaagacagcagaaaatacatgactagcccacatgaatattactaatgtatagttacctatatacagcatatattacaaatctcttgaggtcttctttgtatcacttgagttcctattgttgctataatgaattattccaagtttactgtcataaaagccacacacatttattattttcccattctggaggtcagaaatctgaaattggtttcactgagctgaaatcaaggcgtcagcagggccaattctctcttgaaggtgtaggggagaatccatttccctgccttttccagcttcaagaggcacctgcattccttggctcatggtccctttctttatctacaaaaccagcaacagagactcttcaaatctccctctctctcttggactctgacatttctgcctgcctctttcacttataaaaactctggtaattgcattgagtctacactcagataattcaggataatttccccatctcaagatccttaatctaatcacacttgcaaagtccctcttaccaggcagggtaaggtattcacagcttccagaaaataggatgtggtcatcttggaggggccattatcatgtctaccacaaggtattaattaaaacatcagaagcagttttaaattaatttgccttgtacttaattattatgtatcaatttacctttgggtcagataatatatgtgagattgattcattaactagaaaatgaaaataaaatttttaatagagtttttatactagtcaattattttctgctgaaaggcctttaagttgaatgttaaaattgttattataaacttccatgtaatggtagttgggtagcaataacaataaactgatagttttctgcctgtagcagtattttgatgagactatttttgactgaaactcttattttgtatttaaaaaatcactgcattttatgctgttatttgcttcactgaattatttaatttaatatgttctattaaagagactttaaagctagatacaaattttttctccgtatacatttttaatattcacatttttaacctaacgacctaaagataaatttgaatttctcaaactattcaacctatagtttttcctctgtaaaactgcagtgatactgaacaaaactgctgcaaagaataaataagataatgtatctataactgtagccaaattgctgggccataacaggtaggtaggtcttcaataaacttttagcctgatccaaaatatattccacaagatttgctgaccaatattgaaacatgtttctacaaatactgcagatgaataatactgtgggtgttgtttcttagtaaacttgccaaattttaaatatttggttactctacacaattaaataaaattttaacatgagcatccaagtaactctatttactaaaaatggctgtttctttacatgatatatgactaatgagtgaagctatcctatagctatacaaaatgataacgttaagcattttttattttgtctatctaaaggtgccaatacattgtgaagaaaattctgttaatttcattatatttaatacagcatattccaacttaaagttattcagaagatcaactgaaggcaaatctaaaagacagcagtgctttaagaaataaaagtcataaaacaaaagtttttcagtggttataaattactttcaagttgcattatttcaaatttcttcctgtaatctcatgttcctagctctttaactccctttgattaaatgatgttcctttgctttcactattttctttttgtgaacttgtcaaatcatctttgtcttgtcttgtacaatttaagagacttttatgtagctctctgagcgactatcaccacacaagtccaactgggagaataatttatgaggttcaaaatgaagggtcattatgaatgctgtctttcccgcaatgaatacatacactctcttgttcatgcatgacaggattttaactaaatcaatggagatagatgcttttaaatgaagtattatgaatgatatcattggttacataaaataatttactttttatgtaatctttaccttgtttaataaatttagagaactggaagaaaacttctttaggtgtgggtttatctgtaactgtcacataagtatttctttggtagaaaacacaatttcaaaagttgtagttttatgtccttaggttaacatctagtatccagtcataagccagaatattatgcatagtaagtattctgcacaatgatactaaatgcagaggaaaagcaaagagagtagattttctcaattttgaagagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactcagaaagatctatggggtacctaccaatttatttccactttagagatgaggaaagtgaggcagagagaggttagatgacttgcccaagatcacacagctagtaaatggtgaagccaggatttaaactcaatggctgaactccaaagcttggctctgaatgagtgaagagatgtgttcctagaaatctagcttggagagtcaagaaaagtaatagggaggagatgacatttgacatatctggaagggcaaagtgggaaagaaaggaaacaatacactcaagggagacaacaacatggataaagtactgaggaatggtgtacctgcagcataacaggtgctcaaaaatgcaaatgaaaaaaatgaatatctttatagcccatgagttaaaaggttttccacatctaagtgttgtatgactagtgctctctgtgtgtttctttcagtgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggtaatgtattctttctacatttcttcttattttgtttaaaaaagataaacaaatgtattattttatgccatataattacagaaataaacaacttctggacccatatcgtttttgagatgctttgcaaacctttcagtcattgttcaagatcccaaagcataatggaagcatttggcagggttttccaatctcctgagcatatagaacagaaaagggcatccatgatcatcaggcccatcttgatgggtttggcatatgagaatgatgcctgaatattttgattacatctgtttaaccagtcttcattgcgtttagagttagaaaaatcagataaaaagtgcctgagtgttttgcatttgggcaggggatctttctaatttctactgttcatagtcactgttaaataactgagttttacggctgttcatcaaactggatgaaagctgcttttcctacatgtccatccagctgaaaaattaattctcaagaataatgagttacatgggagaagggagagaaatatgagccagttctaaagaacacgacaggatagaatttttgccttatgaaaaagttttctttcttatttcttataagacaaaattctcatttcaatttaataaggacaattacaaccataacactggttataaaatccatctggctgggttatctttccaagcccaaaaaagctatttggatgttctttatgttgctatctgtttttggctaaattaattggacaacttggttcaagataatgtttactattattaatgataattattaaatgcctcttcatttttgaaataatatccatgttgaatatctctaaagaatatttaattcatattttaaaattaaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacactatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcaggacttgataaagatttctttaaacaacttattgggagattaagtgtggaaataacctcctagatggacatggactgaataatatgtatgttaattttatcaatattgtgaaaacaataatttgacaatagatcactatctttttcataattatcataaaatttgaatgtggtttccctgtgttctagaactaattaaaattactgaataatgttaagtgataacgatagcatttcttcctaggacaataaatctataatatttgtgggatttgttctgtatgatgtaaaattataatttacagcatagtggtggtgtttattacccctgttatgacctggataaatgaccaagatctcaaatatagagaattaatgggggttaatttttcattgatgatctattttttggatggggagagacagagaaaatgattcaaacaaagaaatattaagaagtcagtgatagtttatactaatctgttattgcaaattatttagaatttcaaccactcaaaaagatgttttcagttattttaggtagagcactttgtctacataggacattagctaggtctcaatttttgtaagttatgaacaattaaattcacagaataaggtacaatttggacagatgaatatacactccagggataaacgtttatataaccatagcttatgctactttttgaagcagacaaaagtagctaatcatgggttccatcattttatgaagaggaaggctaaaaaagcaaaatagaatgtgcagattttaagaggatgtttcatcacatgatgatcgccagatcacccaaaattcaaaacagcatgaatacaaattaaaattattattaaataattatattttcaaaatatcttcagcagaatgttgaagtgaacatggggaagaaaataaagatggcttatgcccttctcgtttaaaaacaagacagatgtgagaggcattttagatataatttcttaatcttaagaaatatctatatataggctctatatacaagatataaaggctctaggacaatcaatacatttttaccattttaattcatatcaaattcacagaaattccaatttcaatattcatggctacatgtctctatagtaaggttttgcaaccaaggaagatttttttaaatattctgcaatgactacaaaaagtatagacatttatgttgcataagatatatatttatgtgttcttttgtatgtgttaaaattggagaacactaaccagacagagggaaaatattcacatgtaaagtcataggtctggaaaggtcatttctccacggttttcactaatgtgtgtggatattttaatttttatttcttccttctatgtccttatctgtgttgtgtctcatgactgttctggactgtcccttgcggtaggtttcctctgctacttagacatccctagtcaacgctcagatacatttagtggcctggcacctggggctccacagctgagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgcttaagctcagcctttgggacaggaatagacttaatcacttcagtgatgaacagtagcactgagaaattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgacaacagctcaattctgtttatatgaccttcccacctgaatgagttctattaaactgtgatacagctgagtctcagttttttagaatcaaattggagttaaccgggtgaagccaaattagaaaatcttgtaatttcaaggactgagggtgccattttgaagcaccactgaagatccctgagtaagtgggtggattgaacagagaatctccttcctgagaatgctgaacacagcaaagaaaaaagaccatgtagtcttggatgtgggggtagcagagtggaggaactgcggtctgatgactgatgcctatctacagcctggttatacttcttgcatttgagttctatgagaattcttagattcaatttgagagctaagaagagttaagattcctttactttatcagagatataaaacagtctaccactggcttatccattttgatttctgtgagattctacagtaatacatgcatgcatacacatatacaaaaatagcaatgaaaatgctataacctaaaaccaggagacaataattgtgatatataacacaacaatgaagttgaaatcatcaaaatacaaagagcctttgcaaatcaataagaaaaaggcaaacaacacatagacaaattagcaaaggatatgtacaggcagtccccagaagaaaaaatacaaatggttaatgtaaaagtttgtaatcttttcaacctcaggaaaatgtaattttgtatttttttaattttgaataatgactgtgtatagatttctaattaattattctaattacttaaagcagtaagaattacacatccctagaaacaaaacttcatgtacttataacctttgatatttttagcaaaatgtttgcatattagaaaaacacattatatattttgattttttaaaaagaagagcatttgaatgaaacttatgagttagtgagctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggtatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaacaatgttacattttttgcttgcaatattctgaggggcttcttccatcgcttccattttgcttgctgattggggaaagaaattccgtgcacaaaaggaatttaaaaaatatgtaagcagcaaatgtgaatgtgtgtcagacaaacagatttccagcatcttagtgcttgcttcgaacagcttggaagtgtaactacaggcccagttcaatttgagttttgatgaaaactctgaaattcacatgtgatcctttctctatacataggccctcaaggatgatgatgctgaaactggattgacagatggagaagaaaaagaagaacccaaagaagaggagaaactgggaaaacttcagtattcactggattatgatttccaaaataaccaggtctgaagtggagaaatgtcttctaattccattacattttctgaaattaccaagtagaaattgcagcaagatacctcttaaaatattttgtttgctgtgaggggaaaatgcaattatcaaagctatggatgaaataatttctaagaacaggcagtcccctacttgctaatttaacttctggtaattagaattcacagtattcaaccgattacatctacttgtggcactttcagcaggcagacagaatacaaattaacttgaagcagtcggtctgcttctgagagcttctagccacagtctcaccttctcagcttcctcagcctgagctgcagcaaccttccttggactttacagatttagaactagacagggctaggggccttttgagttgggccgctattctagccaaatttttgaaaaataatataatgatttgataagggatcgaagatgaaaaattaattcttgtccattaaatttaaaagcaggatggccttatatgatactaggtgaaactcctagtgctaatgagacagcaattctaaaagagtgagaaaaccagagacttacttctagtgcctaggaatattgcccaaaaagtgacaaggaactaaaggaggtaacaaaacggacatttttgcttcaatttctcaagaagtcatgaaatgtcacctagatgaatgataatattggctaccttttattgactgcctgtcaataaaatagagattgctgaaagacaactgttaaaaatcgcttttcatttgaagacattccaggatccacaacgttgatgaaaatgttcctcaccttctgaattgttaaagaaatgtgaaagctggataagaattaggggaacaggctaagttagagaccaggtttttaaaaatctgtaagacaggcagggtgcagtggctcaggcctgtaatcccagcactttgggaggccaaggcaggcatatcacgaggtcaggagatcaagaccatcctggctaacacggtgaaaccctgtctctacaaaaaatacaaaaaaaaaaaaaaaaaattagctgggcgtggtgacaggcgcctgtagtcccagctactcaggaggctgaggcaggagaatggtgtgaacccgggaggcagagcttgcagtgagccgagatcgtgccactgcactccagcctgggcgacagagcgagactccatctcaaaaaataaaataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtaatgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagcatcaggatttggttaggagcaaaacctcttatttatatattctaggaaagatcaaggacaacttatattggtcttaatatataacatattttccaaaaatttaatctggctttctatatgcatccagtatttttttcatcatattgaccattcatattttccagtggaaatctagtggtgtctcattctgattagtcataattttgaagctttcaagttagctttaattattaatactataagtatcattttataaagtagtatttttaagaaaataaataataacactgagaatttttttactaaaatatagtgagagtacatttactgttcccttttcagcaaacatcaaatctaaaaagttatttcattctgagaaactgatgaatttttaaaatattacacattggtttttcccaaatgttctcagttaatttgatttataaagtgattcctaagaagcaggaagttaaagtctgaaaaacttcataaagtttggatcaaatatatgtttaccaaaactaaaagacaaccctaaaatattctaattaagacgctttcatggtacagagaaatgtgatatttatctcttaggcagaagtcagaacaaggttgtaaaaagtaacctcattctttattaacaaaatatccaaaaactctaaattataaatcatctagtttctaaagagtttaagccatctctctagcattttttctgctcaaaagaaaattggttataaaaagtgaggatgaggaagtagaatcttacttattcgcattactacataaaggtaaataccaaatacctacttagcaaacaaagagacagactgtttcctttactaatcatgtctttataatccgatgcctattttagctgttttttgaccatctgtctgtgttttgtttacctacaatctagcactcttattgccactgttgtatcatgattccacaaaaaaaaaaaaagatattgaagcattaaaatagaaacaacataatcattcaggttattgggccatgttaaaagttgagccacctagccaaaatgcacttaagtacacggtgggtcacaattaaaatggttatgcattttttttaagagggggaattgcttttttactctactagctaaaaaggcatgaactcagatttttcaggctgagatgtaaaaacctatggtgttactgcatttacaaaatagcatataccttgaataacagtaagagtctgctttgttacctatatggatctaaatcagtctgttgacacaaaatctctaatggcagagtatctatgatagtctactcacacctctttttttcttcgcaaaaatattaaccataccataataccttaatattcataatgaggcttaagaatgcatcagtaagaaaacagacttaaagaaatgtaatagttctgtggtgtttggaaaaaataaaaaacacagttactcaccattaaaaaacctcacctctaatctcccttgctttctatgaagctgaaattacatttcttttactccgtgtcctatatttaaacacagaatctcatagataataatcattctactgtaagttaaaataaatgtagtctgcacaccagtgaaggtcaaatataatagaaactagaagatcttattttttatctcaaaatgctacccaatttctaagaaatttctactcagctagcctgaggctttgataaagaataaaagtttcccactttgtaattacaaacttgtgattgcttaacaatgcattttcacttacaaatcatgctctggaaagaaaaacaatgcacaagagcttttagcaactggaaagttatttgattacaactcttttgcaaaaatgaactccatatttaactgcaatcagcaaccttttaaaagcctcttttgtgcttaaaaccaggcttcccagagcctgcatcagtcataattgggtttctgaagtctacatagctcagttcatttgccttctgtgttcagattcataagagaatcagagttttattaaaaataaataggaagagggagaaatcccaatatgcagcattgtgaacaaatcgatcttttccaaaatgtccactgatatttatgtatgctgtattctgtcatttatttcagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtatttgttaacatttatttataacctttcctttgttgttttacttaaaagactgatctcatcctgacacatacatagacatgcacatgaatgcttgttcaggcactcacaataattccagtcagaatatgcaaaattcttatcttcactacagtcaacattcgatattgcctttcagcgtgttcagagtaggattcggttcagtcatttcagaatggaatggactagaacatgactaggatgtcatagtcacatctaaaaagtgagatccctccctgaaataaagccaaaggaatgaaatcattatttttctgaatttcaaagtttgtgaaaataagtacatctgttacaatcccaggattaagtaagctgtgtcccaatgcttaaatggtacaaatagacatgactcttgtaacaaaattgtgtgtgtagagggcaatttgagcacttcaaagtcattcttcttaactaatcaataaaaggaatatgaacatattttttattgcatttctagccttcttcctttactctaggttctgccctgatgttcttcatcttgttgaggcacctcagttgacaaacaacagagagattccagccatataatatctcatcaggaaaacatgtcctgcaggtctccaggatcttcgtggatcttggcttgaaatcattcattaaaaacaattcttttggtggatatctttaacgtgcgaaaaaaactttttaatgcattacttagaacaatatgtttctgaaaaatgaaatatctgtgaatatgccagcaggctaattcaaaatcaccacgtccatcagccaggcttagcatatgccttgtgttggcaaacattctgggatgaaataaattgaaaatgagggcatgagtcattttctcaaaccttgttttcaattatgtaaaggggaagtgtctttctattcactctaaaatttctgagttttcaagacaaaggtccctcatgtattgtcagtaatcttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacctacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatggatttaaatcacttaacaggaactcaacatgccccaaattaattcatcttcttttcccccaaaacagttatctgaaggagctactaatcattcaaacaataaatatttttaagtgcttcttctgtgctaggtgttttacatatattcattcatccctaaaatagccccatgaagcagccattattacagtattatcacaatttaatagatgaataaacttatgtttaatcacgtgccccaggccctttagttggaaagtccaaatctggtacaaggtctgtctgaccccaagtccaggtttttgactgttgctctttgagtacaatcactagaaagtctagagagattttagatatacaataacattttcaagggtttatccttactctaaaaaattttgtttctttctttgagagtcagctctttggaagggtttattttccattccttctaaaatggaaaaaggatgatgcttactttttaatcatatcattttaataaaataatcaggttccaaacagatggtaaataaatgacagaaaagaaaaactctttggaaaactaaaatttcttgtatgtagatggcccaatattcttccttttcttccctccttaatatacagagttaattgagaaatgtttgctgaagcataagacaaccatttacactgataaaataataggaagtgtatgaaaattgatcaaacctttaagacaagtctaaacaatttcttaattaggtatttctacccagttactgaagtgtagcttacttggattgcactgctttcactgaatattaaaaatgtcactaataaacatcccaacccatagcatctgtcccagatatatttgaacagctggagaattcatcagttcttggccttttgccaccactcatcctaaggcatgtcatacccaagaatgaacttcaaaacccatattataatgcacctcttatattcaaaacatcaatttcctagtcagttcttgtcaatcagcaaattattttagggagtaggtgaggcacttgtgaatatcatttcaatcctttcagactcctagcatagcctttaataaatcattgctccattgaactgtggcatttaaatgccttgaaagagttaatggagcatttgaaataagttatttgcccctcagtaagttacaccctgacaatacaacttaaaacaacaataacaacaaaatattctacaagaaaaacttacttatagtcaaatgcaattggcttgtttattgttttattaatcttaaggctttatagtataactaacagcaggatccattattaataatgctaacagcttctagaactttgagataaggcaataaatcactaaaatttcccattttctctcaagtaattttagcctcaagcagtttgtcaaaagtctgaatttaaaaaataaccaaaaacaaaattatctccctgttctgtttatgcaacgtaaatattaaattaagcaccatgaacaagtaacatgttttaagcatttttgtgactggatattttatcctcatgtcttttaatttaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagaggtaagggaattactagcatttctaacatcacaagctgtactcgccagttgctgctcatataataacttattgagaaatactctttacaaagggggatgtgggcctctagttgttgacagctgataaaatagggtcaagggcactgcaccacctcgttaaaaagtgtacaggtcttctgggtgttatctgaaagaagagagacatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatataattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactctttagttcctgacgtaaggctgtaattacgcaagagattgctgacagctcagtcatttaggatctccaggtccctaggattccctggcctcttggggtcaccagggagatcagagagaacgtcaggccttcagagaaactcaatcaagtccatcacctgggaatcctctcagcctaaggttttctgtgaccaatctgaggctatgaactttataccccctatatgatgaaatgaggttttagaacaggcctattaattcccatgctgaaattgaacttttcactctaacattgctgtttgctatttgattttacaaaatgagtcaaaaatacttaagttaaactctgctcttttttttggaaaaaagtatgtatacttatactttccaaaaaagagagcagagcttaagtatttttgtatataatattcatgtatacttattatatatatatatatatatatatatatatatatatttactgtctcaatatctaagaatgttgactaacctttcttagacattgacacagatttagccctactgtggatattcaagaatacccaggaaaaataccgagttttaaaattatatgattttatggatagttctttcctataagtgaactaatagtaatgttacagacatcttcatgaaaaaaaaaattcgatcattcagttacaatgtttataattatttaacaaagtagtgggatgtttcattgacttttttgttgaagtgtttgactttgtgtaaattttttgggtgataaagtaggaccataagaaatgtttattaactgattggttttattaattgactggtgtttggttggcttgttggttgaatatgagaacatgaaccactggtacttcacaatgcccacttgtgcagggtgcatggttcacacttgttactttcacctggataattatcaggtggtaatgacatccaagatcacacccagtgggtttctgaaaaattgtgcaatgtttttttctgagctaagggaatgtggaccattgagcaagtttcctctttcagaaatctttgagtacgagcagagtttgaaacttaacaccaggctgacgggtttcactctagaatctaggggtttaggtaaactgcccattcagaattttaacctagaaagtggcctaacatgatttaccccttatcttacttaccgatgaaatagaatagaacatgaagtacccagcatagagtctggcatatggtaaatgttcactaagtgagaggtctctcatacctttttcttggttaattttgtgtgtgtgttctctttccccattttgtgtgttcatctcctcatttgttgtgtctcttccctctatttttatctacttcgctatcctttttctcaccattgcacttactgagtatctgtaggagttattaatgggaaatattaattttatcattacactcgtaaaactctagagactttcctctttgatttctactcaggaatagaaatttttggttttcagttagactatttctctttatcaaggtataggttataaaaaactgtataagacagatgtctagcttacaaagtatctctggatgactagacccagttagaaactttttcattataaaggaagtaagattccacttgcattttatatctgaagaattacatattctcaatgatatctgctctaacttttcatgccactgtccattaattgtagaaaattataattgtgtgaataaattgaagtcttagattgactttagttttatgattttaaagaaattgtttttccactttacatgagcaattttgttcatgattttagttttgctttcatctagcagtgttaagcattatttttaatgtcataatgagatgaaagatatcaaagaaagtgagaaaaaggagttcaaggaacagctttggaatctagaacaagtactgctaatcatagtaagctgttctgccggagacttggatttaaagaggttaaatcaaacccactgacagccaactctgtgatgttaattaaatggagtaaggttttattgccagaaagttgacaactataagtcataagatgatgaagtaattgtgtaacttaaaggattatgtactattttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctctgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatcatggaaattgatccagaggaaaatgggaaagaattagttctagggagaactcaaagagtaggaataaaatctaagtttatcatgcctagaatatttgttgttaatcaattttataatatagtagatatagtttagtagtattgaattattttatagtatattaaaactataatatatattagtgtacctagtatctctgcgtccatatcatgggacttggaacatattgatttccctttaaactgctacagaagtatagatgtgttttattttttacagtatcttgggtcatagctgtggtttatttgagtttgagtctttggttagaatttctgtcaccaattataattgtattcttatgtataataaatgttatccacttcgtgatgtggtttccaagaacatgataggaaaaagcaaataacttgaaatatctctctagtatgtaggactgtaatttgcttgcctttctggttaaaaagacttttcaggcagaggtaaaagaaatccaaattctcactttagagtttctaaacaaaaatccaatattttttattttaaattccctagaaaagtaatataaattagactctaatttgaagcaagaattaaagcaaggagagatcctggacattttcaaaatgcactttggctaccttccattgttctccctcacgttgtcatactttagcctactgcacctgccttccttgtcacagtgataaccacccaaaggtctggtctcacagcctggctctctagcttccaaagttcatcttcattaaagcttatattaacttctctacctatcctataaacacaaataatagctatcatttactgagagtctactatatgctgacaaaaaaaaaaatctcataacattcttcaaaattggcattaccaaatctgttttacaaaacagggaaggaagggaactgagacccaggaaagtttaagtaatgtgtccaagtttacacgggcaatgccataactacaattcaaacacaggtctaaaagcctacacttgccattttttgagattgagtctcactctatcgcccaggctagagtgcagtggtgtgatctcagctcactgcaaccccccgcctcccgggttcaagcgattctcctgcctcagccgcccaagtagctgggattacaggtgcctgccaccatgcccagctattttttgtatttttagtagaaatgaggtttcaccatgttggccagcctggtctcgaactcatgacctcaagtgacccacccacctcggcctcccaaagtgctgggattacacgtgtgagccactgcacctggcccacaccattttctttaaagagtctctcttggtcttttcaggtctgtctggctcccaaacccattttctctctacactgccatattgccactaagagagtgcaaggatattgtctgttttgtttatctacttaggcccagcacattgcactgtgactgcaacatccaaagtgcttaaataaatattttcaagtagattggttgaacaaattagaatttaacaaatatgcattctaatgttctatcacctttgagagagtcatctttaaaagatacccagtcattccagttgcactgtagtatcctaaaatatttttgaattccagtccctctctccaagtatctttctcaatgtataatacattatctgttctcaataatgatttgtctttgctttgaaaaggtaaatctcattgaaatggccataactatgtagggtcaagtataggctattagttgatgatcgaattgggtaaaacagttgtaattactgtgggaaagtgatgagatggatgttcttgtgagttttatattctgattctgtcctaaatgctttgagcattaacatcattacatggtctctcaaatggtttgctatggggaaaattctcattaggagatataaattctgatacacatagtaccaagaaaatataattgttttaatagaaatcaatgtaagtattaggttttctttttatccaaagaataaaaggaccgagagttttcagctgaattttaaataaagcagagcaaagtggatttgggagcctggatttcatgtgtataagctggcagagcagaaagtgaggagtgggagttgaaatgggaacaaatataaaacaaaaggagaatgagaataatgatgtagacaagagcagccttgtttacatctggtttttcatattactgaaataatgaaaagggttttgagtgggaagcaatgtgagcaacacaggagaatgttttgttctgtcttccacagatttaaacctattcaaatgtaatcttttctcttgagttcatcatatgcttgggagcaatattttttatcttgtttgtgaatcttaaaattagatgtttttaccttctgtcttactcctacctacctttgagcaggccaaatgtttgtgctgtaaaatctttaatccattacaatctgttactctgcaattagatgaaatgtcagtgattgacttgtactagttgtactacagaataagggaggagaatgaggactcgctgaaaaacaagagcttaaataattaaagaatgcgagagagaggaagcatacacagacacacaaacttacttgctttaaacatgattaaattcttgccaattatgaacaagaacttttaaatactgtaaattaattttatttattcattctttcactgatttcatcatatattaaacctcttttataagccaggtattgtgctaacttcagggaatacagtggtgaataagatagacccccacgttcggccacctgaccttccgagctggcggggctgaggctggagtcctcccaggagccacaggggaatgaaatttgcagacttccggggcgcctggccctgggcgttgggcgagcccggggatggtcggaagggctgggggtgggggtgggggggcgtgggggggggcggcaggaggagcccgaacgaagcctttgcgattacagtcatggccacccagatggggcagtcttctggaggagaagggctgtttaccggcaatggcaacattggaatggccttgcctaacggcatgtatgacttgcatgatctctctaaagctgaactggcctcacctcatcctgtcttgctggcaaatgcggccttcagtgggaaagtaaatggcagctgctgtgattacctggtcggtgaagaaagacagatggcaaaattgatgcctgttggggatgacagcttttcagatagtgaagaaggagaaggcctcgaagagtgctgaaatgaaaggtgaacctcatgggctgagacgtttggaactcagcgttgtagaacttcagcctgcatttgaagcatcagctgctccagagatttacagctcaaataaagatcttcctcctgaaacacctggaacagaggacagaggcaagaactcgaagaccaaatcctttcgctgtaagtcatgccaatatgaagcagaatctgaagaacagtttgtgcatcacatcagagtgcacagtgccaagaaattttttgtggaagtgcggagaggcaggccgcggtggctcacgcctgtaatcccagcactttgggaggccgagacgggagaatcacctgaggtcaggagttcgagaccagcctgaccaacatggagaaaccctgtctccattaaaaatacaaaattagcccggtgttgtggcgcatgcctgtaatcccagctactcgggaggctgaagccaggaggcggagcttgcatgcggtgagccgagatcatgccattgcactgcagcctatacaacaagagcgaaactccgtcaaaagaaagaaagaaagaagaaataaagaaagaaagaaagaaaaaagaaagaaaggaaaagaaagaaaagaaggaaaagaaagaagaaagaaagaaagaaagaaaaagaaagaaagaaagaaagaaagaaagaaagaaagaaagaaagaaaagagaaggaagcaatagacaaggaatctggctcttccactgcagaagagggagatttctccaaggtctgtattcgctgtgaccactgtggctacaataccaatcgatatggtccctatactgcacacctgaaacaccacaccagagctggggataatgagcgagtctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaataagttatgtgataatggtgtgtgttttgtgtgcatgaatggaaattgtaaatgttgaattctaggctccgataatcactgtcaacagaagatcaagctgcaaatatttatgctttaaaacttaaattataaagctagttaaatctttctaacaactagttttaatgttcatgggtacattttacctaaggtactgttaacattgtatagagaaagattcatcttaagcacagattggctatcaggaattagtttggggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttcagtttaattacatcccatttgtcaattttggcttttgttgccattgcttttggtgttttagacatgaagtccttgcccatgcctatgtactgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcccaattgcttctttttctgaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttggttccatatgaactttaaagtagttttttccaattctgtgaagaaagtcattggtagcttgatgggaatggcattgaatctataaattaccttgggcagtatggccattttcatgatattgattcttcctacccgtgagcatggaatgttcttccatttgtttgtatcctcttttatttcattgagcagtggtttgtagttctccttgaagaggtccttcacgtccctcgtaagttggattcctaggtattttattctctttgaagcaattgtgaatgggagttcactcataatttggctctctgtttgtctgttattggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaatacgctttatttccttctcctgcctaatggccctggccagacttccaacagtatattgaataggagtggtgagagagggcatccctgtcttgtgccagttttcaaagggaatgcttccagtttttgcccattcagtatgatattggctgtgggtttgtcatagatagctcttattattttgagatacgtccccatcaaaaagtgggcaaaggacatgaacagacacttctcaaaagaagacatttatgcagccaaaaaacacatgaaaaaatgctcaccatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaagcaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatggatacatatgtaactaacctgcacattgtgcacatgtaccctaaaacttaaagtgtaataataataaaataaaaaataaaattaattaattaattaatttttaaaaaggaattagtttggggaaaatgtttttttgtggattctttcatactgcaaaagtaaaaccatttgccttctggggaattgagctaaattctcatctagtctaagactaaaatgctaaaaacaaaaacatgaaggaaattaaaaccccttattattaaatcgatttgtaaaaatgttgttactggaaatttattggacttgaggccttcttccagaaaataaggacttgattgtcagggcctgtattaggttctgaaccttaatgccatgtattcgtacttatcagaaattatttcagtgaaaagtacattagcagtatgaacttctgatccagttggaagttcttccatttgaaaaatgtgatatttgcatggaactgttttcatctttttcttttctagtcccactcccccacactggatagaatttaagctagaattttcccttttgataaaagaacaaaaaatgaacatgttatttgtaagttgatgtgtagtatctagtgataaacttgaaacactagaatacatgacaagcctaatcttaggtagtcttatgaaaacgaatctcttacctatcttttgaaactatattcacattgatttttaagattttttaagttatattttttccttttttcttcagagctgcttcttattttggcaccacttttttcttttattgtgtaattcacaaggggctgcattttttttttttttttttgataaggcttgtaactatggctggatgttttgctctagtcttctaagaaaggccattttatttttcagagtcacttataaagtcatgtgtaactaactttgtagactgttttgcatatgactgctgctacaaattaaaacccaaatagacctcattgcatgtcactctatgaatgttgacaatgaaaggaataccttgcctgtggtatactgtcacttttggactgaaaagctgaggaagaaacttaattttcttttttgcataagtcagaaaaacttacagctggtgttcccagtttcctggttgactccagcagatgaaatgaacagatagtgttaattcagactgaagaaattatctgaatcttggcttgtgtagatttacaatctacatgcaatattaactaaatcagatagcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgtaacagataaaaatgaagcagattgcaaatccttttttaaaatcttaaaccatgtaccaagtttttggtccaaattgtgtaggataagttaaccttaaattgcattctattaaccaataagagggtatttccgtaagcatagttatgttgaaatacagttttaaaaagcaaaaaaaaaaaaaaacaaaataaaagatagacctgctaagcttagtcaattaaaaattaatggtgagacagaactacagggtagattaaagctcagcctatatgcatcaccatgactccgcttactactgatgtctccttcggcttgttgcttaatcctttcataaaatgggattagtatttactcacctccatgagttgtgacacactctaaatgagataattaatgtaaagcacttagaacaatacttggcaccagagaagctctcaaaaaaatattagcggggccgggcgcggtggctcacgcctgtaattccagcactttgggaggccgaggcgggcggatcacgaggtcaggagatcgagaccatcctggttaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattagcggtttttgttattaaaaacattggtcagagcccttatttccttgccagccgaaaagcattgctctgatgactagatttacatccttccttttttgaggacagtgggacagcctaagtgttcagaaggcattgtcatacatggttttaataaaaaagtggatatctgagcctagataccatgtgcgagagtctgtgggatgtgaaaagattgcacaaagacgaacccagtttaaggctcagcacgtgtgagtggaagatagtgctaccatggtgtgacctcagtgattgtgcaccaattaattcctctaagctctgacaccccacaaaggaactcaaagtttcaggctctgctaaaataagacagacaatagcaagtgttggcaaagatgtgaaaaaattggaattcttatacgttgctaatggaaggtaaaatgatgtagccacttttgaaaccagtttgacagttcctcaaaatgttaaataaagttgccatgctatccaacaattctactaagttctacccaagaaaaatggaaactcatgtatacacaccaaaaaaaatgtacaacaacagtagtagcatttttcataacagccaaaaaagtagaaacaaccaaaatattcatcaagtgatgaatggataagcaaaatgtggtatatccatacaatagaaaattacttagctgtaaaaagaaatagtcttgatacatgctataacactcatgagccaaaataggcaaatccacagacagacagaaagtagattcatgcctaagggtaaggttagggtaggaaatggggaatgacaggtaatgggtatgggattcttttggagtgatgaaaatcttctagaattagatagcaatgatggttacataacccagtgaatatactaaaatccaccaaactgtacactttaaatgggtgaattttatggtatgtgaataaataccatttttctcaataagctgtttcttattttttattttctttattatttttatattaaatacaattaaaaaaattatttgagacagggtctctttttgtcacccagaccagtgtacagtggcacaatcatagctcactgcagcttcaaactcccaaacccaagcaatcctttcacctcagcctcctgagtagctgggactgcaggctggcaccaccatgcccagctaatattttttgtttgtttgtttgtagagactggatcttactatgttactcagtttggcctcaaactcctggcctcaaacaatcctctcacctaagcctcataacctgtggatcaccacagccagtcctaaatctgtttttaaaaaaaagtttcagggacagagatcctaaacatcaaagcatgatgctccaggctgactggggttccatgtgaaacagccctcaggtgtgctggaaatgtctttcctggggctgtttcaaaagttttgggatattcgctgaaaatattctagtctctctttaaagtagaacacttgtctccaaaatcacactccttattaccatttctattgatataagggcagtactaaggttcactttttagagatgaggaacccaggcctaggacatatgctagccaatgagagctcaagatgtaaatgccagtttttctgattccacagccattttctagtagtctactctcccttaagacaagaagtttatgcctaattctcctgatgtaaaaacaaagttttaaacatgagaaccaatctttttgcagcttgttttcatactgtagcttctcagagattcccccaagttgctcttttccagacctttttcctactaacatcgtgactttttaaattgaaataaaattggcatgcaataaaatgcacagatgttaagtgtacagttcaatgagtcttgacaacgctatacacagtgtaacaccaatcaagctacagaacatttcttatccccaaagaagttcctcatacctctttccaatgtgtcttagtgcaagctcctagaggtaacttctgttctgatttttcttaccacagattagtttgcctgttttgaactatataccatggaatcatgttattttgtgtctggcttcttcagctcaagatgatgtttatgagattcttcatacagtaatatttcactcctttttattgctaagtggtattctattatgtgaatatatcaagatttatccattttcctattggtggacttttgggttacttccagtttgagattgttaggaataaagctgttgtacagctttctgtggacatatgctttcatttctcctgaactgctggttcataggtaggtgtatgtatcacacttctttaaagctaaaatgaccaggaccccaggtaatagtctatacaggaatgtgttgtgatacctactgtacaggcttcagtcatgttttcttttcattctcactagcctccacgatgatgctcagtaccaccttgattcttgacctgggcactatgttgtctatcgtccaccgtacaactggcacctcataacacacgtttattctctaagtgtaggtgcatacccacacaatgctgttagataaaaagatgccttgtttacctgtttcgttgtctcgataggtagaacataagcttcttataagtgaggaaagcatcttagcacttttgcacatcacagtaattagctcttaggagaaagtatggcatggatcaaatgagcatagaactcggagtccaagtcacatcaactctctgagcctcatttccacatatgttaaatattattgaaaaaatgtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttcgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccagctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatagaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttctcttttcatgtgaactataactatgttatatgcaagaataaatttctgggccctggataacactagaatacagacagaaacatttatgagtgaagcgaaaggccccacgtacaattctagatgaggacaaaaaggaaaatttgaaactatctctagtcaacttttcttattctctaagctgcagatactctggaatgtagtcagaggttgagatttgccacaagttaaccaactgctcttcactttaagctgtgatttctacatgaataaatcaatattccgacaaggtgcttccctgaattttaacgttctgctagtgttttaaagataggagaaaaaaatgtttttcagaaaccaacatagcgtcagaaatagtctgctcttaatcgtatctcagtgtcaaaaaacaaaaacagagtgagattagaatattaaaataggcagagagtgtggaattttatgtttttattttataacgtatttttggatagcctctcaagtcataaacagggaatatagaaagcagactttgaaatgcccgcctgatataaaataaacattaatatttaacttagaatcagaggagagatgtacgcctcttttcaaggtcatcaactttccaagctgtgtcacactgatgttctgtttatgttgaagccatgctgccatgtttgaagatgacataaaggcaatggaacctatgtgtcgcagtaggattacctaattttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgtgtattttaatgttctccaaatagtatttaattaggggtacttgaatatatgagaaatgtctttgcaaagtaaatgttttacgtgcttagagttttctaagcccttgtgtttcataatgcaatataagctctttattagtaccctctggctgagataagatattgagctgtgaagaattgcccaaaatttaaaactttttaaagaataaaaaagctaccaaaaaatgtatgattccctaaaatgtactgcgatgtgaactgcagcactgaccattctcccaaatttccatcccaaaaccctgcttctcatgaaagagagagagaaaaatagggagaaaaaagcacatgctgcatcttacaaaaccagatagttactaaatgcttgtcatttggtccccaaattatcctttcttgaaatccaaatctttaatattttaaagaataaattgcagcatttctgccttgaggtttttatgtcatcttcataggaatcattttgaccaattttacatataacttagctaaatttttgtgttagatctgaatcttggagcataactagtctgtattagatgaggaacagttgtcattttcagttatgactctccaaacgtcatatcagctggtgctatggctctgatttcctctatcagcagcacctctctcgggtaatttatctttttttctttttcccctttttttttttttttttttttgagacagagtggtgcgatctcagctcactgcaacctccgcctcctggggttcaggtgattctcctgcctcagcctcccaagtagcttggactataggcatgttccaccaggcacagctaatttttgtgtttttagtagagatggggtttcaccatgttggccaggatggtctctatctcttggcctcgtgatcggcccaactcggcctcccaaagtgctgggattacaggtgtgagccaccacacctggcctctcgggtaatttctgaagaccttgattctcaccaccactgcaaacccccaaacccaacccattctacctgctggcttgtgctccctcttcagaactttcctaattttgtgattctagttgctgttcagtccccttgagaggaaaaacaatggacaaacttaatttaaatctgaaataactgattagttcaatgaaatctcacaaactgtgttacagatattattaagacaaatttgcaaattaggaaactgagactcagaaaggctaagaaatttatctggaatcatataactaaggaagtaatggccaaaaatttaaatcaaaagtttgccttactccaaagtgtgtgttaattactattttaaagttctgttaaagcagggacttcatgttaaattcctagtattgggagttcaggaaatgttcaagaaaagcatgagggtccctggtaatgaacttatgaaagaaatgtatcatgtgaatatggtgacttttccttttttaacaaatggattgaaggtttcctgaaaaagtgatgagggataactttaaaaggtgcctatttaaattagcatacaggcagtttgaattctagttcttcctcttttagtatgttaaagggaaggaaatggtttatcccagtgactgctactccatagacacctgaactgaacctgaaggtagaaaaggaatgggacttagctgaattttaacaaggatcatttaggccagggctgctgttcagggcactgggtttgagtctgagactagtatttaccaaaatatgttatacaagtcatcaggggatacattcatggaaaaactcagtacacaaggacaaggaccaaaccttctttcagatcctcatgttgagcacataatgaattcagtgccctgggctagaatttaagtaactgggaacagaaaccagttcatcatgtgtaatttctataggaagataatgcttcagatattgtgtggtctcctccaagtggagcacagccacttgcccagccattagttagagtgcccggacgagaggagagaagcagaggctgggaacgtaacaggggagtgcagttgattgttcctctcagggccaagatgaagtgacccaccgtttcccaccgcccctctcattctcagtatacagtctggtcaatgttccctaagaaaatgattcattcagcatgccccatttccagttgaaatcacatacacttgacttcagaactgagaacgaaaatggttcttcctaaatgcaagttctggcatgcctaaacaaaaatttcatatatagtaagctaaaatctcctaaagagtttaacgcataacttattcaaacgtattctgagactgtgaaaattgaggactcatctatcctcaaatggaaactgccgctggcctcatcttctgcaccttatctttccttttaaaaaaaactctgagatttaccacttacatgcctgcatctgtttggattaactttcatgttccatatatttctgtttttattagttcatctttgtcctccaaatgtgggtcatcatacaagtgataagtttaagtaagatttacattctctttgttcttatgagtgtatcagtgaatattattaatattgcctcacatttgcaggacactttaatgtgctatggaagccattggaacccagccccgtatttctgaaccaaattctctcctccctcaaactctcggggcgttgggcatttcctcaattatgtggcgtctatggcagtttctaatctgattggggctcttaaaatagaaccagaatctcttttttggagtgagagagcgcagtgatgagtatttattaattaagggaaaagcctccacttgaggcagctgggaatgactttctgaagacactaaaatccaaataaaaagaaagacattcaaatgtgggaagaaaaagtaaacccagtaagaccctcctgaaagtgttaaatgttgaaacgatatctgaaagaaccaacttctttggaggatttttaaaaataagaattggggcatggatttgtagtcttgcttcaaggcaagggaatagacaaggtgatctcccgtgggatctaacagccctgtaattcatcaaagaaggtatttaaaagcaaagccatgggggaaagagaacagtagcatcaatctaaatcaagccttacatgcattttctctcttttttttttttttcacttctaatctctccctgcttttttgtaagacctatcacagcaggacatactctctacaattactttgacaaacaatggtaacagcacttgggtttttaatgtcttccaaagtaatctatttttgacagtgaaaagtagaggaaactgattcctgaagctatgaactaaaatgacagatttggggatctgatttaccagagtgggttttccatatatcagcccttgctgacattcctgggcaagtacccacaggcacaaactcccaatggaaagtcggataaatgtaacacaaacaacagtcataagttgactttcctatcaggtaccttgtgaaaaaataggtacaacattttataaatcttttattttaatgaagtttacttaacaccgaaaacgtcagtccagagatgtgaaatcttacattataaagaattatggcaaatagaaacactaacaaactgagcctttagctgtcatatctgaaatactatacatacacatattcatggatgccaacatgctgtaacataattttacatattaaaataggctcaattttcaatgataataaaatggttactgatactatgacttcatggaatattagatagccattaggcatacttatatggaaaaatgttttagtatgttaaatagaaaaagcaaaatataaaattatatataaattatatatatatgcttttgtagtgggttttaaaaatatttgcatatgtataaaaataatttgggaatccatgaaatgagaataattattttaggaggctaagattatggtatttttgtttctattttcttttttttttttttttttttgagatagagtcttcctctgtcacccaggctggagtgcagtggcgcaatctcagctcactaccacctccacctcccgtgttcaagcgattctcctgcctcagcctcctgagtatctgggattacaggtgcacgccaccactcctggctaattttttgtatttttagtagaaacggggtttcaccatgttgttcaggatggtctcaaactcctgaccttgtgatctgcctgcctcggcctcccaaagtgctgggattacaggcgtgagccaccgcgcctggcctgtttccattttcaatatacaaaaatacaaatgcacacacacagggagataacacatttgatgtaacaaatgaccgtgctttcagaattcagtccagtatattatggttgaagaacagacttacattaagtgttctgccacgagttatcagaaaaagtcaatagacccacatgaccccgccttcattcccttttctcctcttaacacctctgccagcaagaacacacacactgagtgggccattgtaacttagatccatctggtaagattctttttcttcttccaaattagtttgttccaaaaattatccagcagattgttcaagagaggcatttaatatttgtctttaagaaatgagaaaatagggaggtcaaaatgaattagcatttaaaaataagacctatagcacccctgcggtgcatctgtggggtttgagatgtgcagcatcatacaaatatcactaggaaactgagacatttggaaacagctaagaagagccacgttgctggaaaaaaccatgactggcaaaaaaaaaagctttttgtgaatattccataacctacaaagaacgggacaaaaataaatacataaagacttataccctggaataacacagcagaaaatatcttattaaaaggttttcactacctttgagataccatgacataatcatattaatccaaaatacttccttgaagcatggatttttaaagcttgactttttaatgccagttgggctgtgttataagtagccatcagattttttgtttccttttcctggccaactaccaaaaatctttggtagttggtgagtttgctctactacaagaaaacctggtaaccttgggatactctgctgttaatatccgattcctattcaagtatcttcccaggaaaagcatgggggttgcagggggaggccaaaccatctgcttattttaacaaggcttttggccagcttctcatggttaaggagcgctaactctctggctagcctaccagaagctcagagaatgagagttcctggtatttacagtgttactttttaaatcagtttcagaatgtgattagcacaccttcctaggtaggaaaaagctatgttatggctgaaaagaaaagaagcagatactcttattcttggtggatgtgggaaaacaaacaatttggatactgaataaagaataaatactgttaagcacttaatttcatacacaaaatatatagagaatttattttaagctttcaattgccttttagatgccaaattcagatctatttatagatgccagctttgagtaattcaaaaatttatataaaatcatttctgtgaaacttacagtttatggaaaacagagaaaggtttgcccatttcaggtaaggcctatgatttcctccttttacactgatttagtatggctacagataaggttcatggaataagaaggtttttgtagtcagacctgggttcggattgcctctgccattcatgagccatgcaaacttgaagacagctaacctccctgtgctttaatgttctcatgcataagatagagaatataaaacctcatcacagtgttattgtagggattagatgagatgcaatatgcaaaaacacccaaaactaacaagtatgcagtcaatattagctccctttcctcttttccttcttccaggctcttgggctactgtaatttacacattaactcattctgtaactttaatttcctactacctctttaaaatacagaccatatttattgatggggggaaaatatacaaagcttaaagcatgtgccgtaaaatagttccttaaagggtagtacagcaaaatggaacacattttcttgcccattcacaggacgactgtgaattttagcataattattgaaaaaaactcagctactctgactttttacaatatctagtgatcaagaaaacctttagatcatattacttttcctctcaatgttgtagttaggctattcactcagagaggcctgtgacaagctatagttaataagtcttccatggtgtcaaaagtaataatattaacacgcctttgtgagttaaattaattttgttttgtgcactggcctgcataaatgtgaatgacatttcaaaatatgatcaggcagaagctgagaaggagccaagtggcaaggcagaatgagatgcggtcattagagcagagcagccagctgcaagcatttgtcagtgcaggcaaagaggtgcaggatattattacagcaaacttagggggttgttctttcagttcattttgccctttggaaaaaaaatactgatttttgtctttagagaaaaatagagatgtttgacatccaggctctccatgtttggaaatgaaagaccatcttcctgctaatcactgatttcaagtgtctttcaacccacagattttttttctctgcctgcgagaggcagctgattggtaatagcttttaaactaatgaccaaacagtggcattttaaagtcttaatggttgtgtttatttcagagacttcttcagattccccaccaccaccatacacaaaggcatatacctcctgcaaatagaacaaataaatatgctgtctgtaaacagttaaaagatacaggttgaacctaggaagaaaacacctcaggatgactcagggatcagatgaccaaaatgactggtgtaataagttttatactttttaccaaatggctggacaagcccttttccacttgagttctagtattttgattactgcaatcagaaatcaaattataagaaaaatggagatgttcctattaaggcagtcaccgtaaacaagaactggataataatttaaggggctctgtacctcttcatatgttaaacttgacaatttaggcaacatcccatagtaatgagcctctacatttctttcatatatctagtatcacaatatttttgtctgttcagaagtactacacatgcaacaaacaatttttaaatttgtctatagaagtttctctattttaataaaatgaagagcactatattcagagctctgcatattgtttagtatccacagcaatcctacatgatatgaaagcattgttatcctcatttcacaaaggaaaagtaaaggaattccctgaaagctataggactgttaagtcacagaatctgtgttttaactcagatcaatttcactccaaagcctgtgctctaggtaacatatagccaaaaatacccatgccctatttccttctggcaaccaatccactgtgacttctatggtaaacaactatgttctgtagcttctgcatttaactatctcaaatcaaaaggcaccagcaaaggaaatggcttattctggaagattttgcattaatctgatgattcacttcaacaaacatacatcttcagatcatttcatgctgggcactggtgatgtaaagatgaattagacagtgctaggctcaaggacttcataggcgatgaggaagggatgatgctatctggaagtgaagagagttcagaagagatggtcagaatgtaaatttgaaatgagttctaaaggatgactaggaattcaactgattgagaataagggcttccaagaagaggaagcagggaaagcattggaacatgtaaagaacaagatgtccagatctgattataatctagtactgtacatgtgagaggggaatggcgtgaggggtaagccagaaaaaataaataagggtaatattttagggccttgaaggtgggagttaacattttaagtctcacatttgggaggcagggaggatattaaagctgtcagtggccacatcagctctgtgtgtaagaaagccaattttttggcagtgtgaagatgaattggaggctcttgcctccatttaggagtccatgaacgatatggctgtgaagacagaatgtgaactaaaattgaaaaagtattttcaaaacaagaatttgcagaattttgttactgatcagatagagaggtgaggggcagagaaagctattgaaaataatttcaattagtttggttgactgagaaatgagcaaacaggacaataaatgaaattacaggaagatgcactaattttaagggaaaacattaagttctgttttggacatgttcattaaaacagagttcatttctatttaagatgatattacatccttttttaccccaccacaacttgttttaatgttttatatgcagtatttaatgttctcctaaatagtaccatacccacagtcaaggagcattatttaatttatctgattccactatctctttaccaacctaacacttctttaaaattactcatggccgggtgcggtggctcacgcctgtaatcccagcactttgggaggctgaggcgggcagatcacgaggttaggagatcgagaccatcctggctaacacagtgaaaccccgtctctactaaaaatacaaaaaattagccgggcgtggtggcaggcacctgcagtcccagctactcaggaggctgaggcaggagaatggcctgaacccgggaggcagagcttgcagtaagccaagatcacgccatagcactccagcctgggcgacagagcgagactccatctcaaaaaaaaaaaaaaaaattactcacaaagaaatcataaaaccatgtttttttctttcaaaagaattccaaaggaaaaaaaatgccctgaagaatagcaagcatggcctttatctttgcagcttaggatgctgcattttcaggtttcctcatggactttgtgatttccatttcaacacatcccagttagcagccaggtataacaaaccgctacaatcatccgctctttattgtgctgatccaagctcatggccacagaggggttaagtggaaaatgaaatccaaactgtgttatccaagcacaagattcagtggacttcagctctgaaagacccactgggtgaggaggccgtaagcaaccctgcagaaggagagccttggaaagggcccaagtgtggtaagatacacacctccacatagatgtcttacaaggcctcactccatgtgctcttctgtgtgtctaagaaaaacctggtaagagagctgacttaggggaatgtctctatatgaacacttacatgacattatctttccattaattaatatactgaaaatataagtgtctgctatgtgccaggcactagctgagcacgaaatacacaaagttggataaaacattttaaaattattcttaattacctatggatgggaatgctactgtacttgaataataatgaaataactagcatgcatgtacactttccacattctaggcactgttctgaccactttatctcatctcatctcatttaatcctcacaaccaggtgagatcagtacaattattatccccattttatacaataggaaacaagcttagagaaatgaaacaatctgcacaaggtcacctatctagtaagtggcaagccagagtttccaagctgtgtctgtctgacttaaggcttcagctgcaaactcctactctgtgtaacctaacaggtgcttcactcacacagccatctctacactgtatccattgaccttcagccatatggaaacggagaagatagcacttattgcttgtttagagaaggtggcttgcttttatctttttctaattcactccttaaaataatccctttcttgcatttatccctcttttttgcagaaagcatatctttccacctattttatcgtatttgacctcattaaatccctataaggagagaggaataaattttattacccctcctgagtcaaggcactgtaatacatctcctcttagtcaatctgtttaactcaggcaacctcaggaatgtaaaggaaaatcagaagcttgtgtttggacatgattctgctcctctgagaaaccctttcacctcaacagtctacagatttccatggaagaccttgagacggtcattcaggaattgtagcctgctgtttcctgtgcattcaggaagacatgaaagcaattacaaattgcttaacagatgatgcataatattagagatgaagaatctggctgtgaacacttgcaccagggaaattctgctgtgtgatttctcttccagatcagcaccttgtgctaacagtatcgtactggcatgatgctgagtactcctaaataatgatccagtataagaagaaaattaaaatttcagaaactttcactacatagaagaaagagcatggatgtctgtgcttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcatatatatctatgattcatctccttcagccaaatggtctgaaatattcaaggacttcaactgcctaaaggcttttttcagataacacaattgtgcatatactcttttcagctttaaattcaaaatactgtccattagatttttcatattctcctagttgaaagactttttaggacatctaaaatttgtgtgaatttttaaatttatgtcttttgagttattttcttcttttattttgccaagaattaatatgcattttaaagcaatagaaataatttgtccctttgcagcattttttatccctttgcagaatttattagacaatagttactacctttatgaagcagatttcctggacatctacaaacttctttaaattacagtgttagtagtaaacatgcttttatgagattccacatgtggaaaaaaataactttttaagaatgtttagtttgatctctgcccaataggatatcatataataaaattataggtaaaagccacaaaaaaaaataaagtcataaaaaatgataaaagttatctggtgaaattgattagcaatgtatggatcatttttctcatttacatttttctagaaacttattaatttttcttcatcaaaatgtgatgctcaaaagttgaaagccagaatgccatcacaaataaggaggaaaattgtcgtagtttagaatgcctaaagttacaattgcataacatatgctgttaaaaaaatatatcctctattagtcatttctcacaaaaatctgtgatgaactttacataaccaaaaaatccctggtatctcagcagggtcactccagctgtcagtgtgaatacatgcaaaatgaaacaaacaagatatacctattttctttctttgtctgaaaaggatggctttcattcaaattcacatcatacatttgcagataaactatatttttgcattgtgtgatttagtgacatcacattttcatgcaaaggaccattgaattccctaatgatgttctgattttcttaacaatgaacaccagtgaactttcccctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacctgctttgtgaaggaggtaactcattaagcacgtttctttacattgtttcaaatacgtcatttagctagttatatgaaaatctgaattcaaattcttaatctatgtgtctacattttctacttcacacactctcttacctataccccaaaatggaattaaatggactgtgcatgaaaaagattttgtttctattacccacaatctaattatattattttcacagtgacattatgaaactatccagtagatgcaacatgtttgtcacacaaaagataaattgtgctttcttctttatttcaagtaaagaatccttacaattctcatagcattccatctacagagggttataatttccccagatgtgactaaaatggccatagttatcattaggttttatatcttgtctgagtccatttaggctactataacaagataccataaactgggtggctcataaacaacaaaaatttatttctcacagttctggaagctgagaagtctgagatgaaggtgccagcaaatttagtgtctgatgaagtccgcttactggctcatggtcttttcaccatgtcctcacatgtcagacggggcaaaggaattctctctggcctcttttacaaggactctcatcccattcaggaagactcagccctcatcacctaatcacctcccattggcctcacctcctaataccatcaccttgggagttaggatttcaatgtatgaattctgcggaggagacacaaacattcacagcacagtgtacctattcagaaattcagatattccacctcagctactatgtcatcaagtaatcagggcttttttgcatttttacaaggttcactcatatctaaatctaaatctaaagagggtttttttgcatctttacaagattcagccactcaatgtctttaaaaaataatgaggcaaagtcaggaaaacgctttttagaaagggttattctactggcattaaactagcaagaaaaaaaatattggcatctttcatttatagaacaggtttaatttctcaacacttttatgttttgacttgtttattcctaccagctctttgttataaaagatagttacattattatttataaatctaacaacaaacaacaaaccagccaaattcccaatgttgtttatgtatcatttttcaaacctattcatttttctcaaattgtgattgttttctctttgtcttgtttacattttttcctgccaagttaattctccaataaactttatacatggtccgtgacattgctccccttctggaaacattgatacccaaaatcctactttatatttttacctttgcttttaatgagaaacccaaatgtatcttaactcttcaaaaaaaagttactgagtatacgctatgtgctaggcagctttttctttttaatatcactattgcctgtagcttagtttttcatttttacctcatggtcttgaccaactaactccaaacttttcttactgaggtacaaactaagaatgactattttctctgtcctatgcctttcccacagttaaaaaaaaaaatctctcttgtctgtaactctatattcatatggtgcacactgttaggcaaaccgattaaaacccaggacatatttaatgaaagagggagaaaggtgagcagatatttacggcacaatattgcaagtgctatactgagggtttgggaaggtgttacagaaatgcaaagaaagaagaagggccaaacttgaacgagaatggtcagggaaaggctcggcgaggatatgacagtgagaaataagtaggagaccagtaggaaaacaagggaagggaagttgtaccaggcagatgaagcagcacgttcaaaggcttggaggcacaagaacatggtgcaatcgagaacatgcacgcatccgctctccttgttctatttcctgcaaccctatatgaatttgctttcacgtagtaagatttctgttgtgtaagcttaatctcctttgatatttctttgataatactttcatcatttttcttcttatgtccatagacttcatcctctactctggcatcatcttcataggttgccctttgtattcttaaaaatcttttcaagtgggatcaccttttccaaaagcctgtcaagaggtcaggttatgtttaaccaggaccctcccatgtctactgtgttaatccttcttgcttgtaaatattaggagagccaggaacattcacaaagctggtcttttttatttctcacgacacattgacacatctaactcactttttccttctcccacaattcattcccccactccaggtgacattcttcccctactgatgagtatcaaaacatcccaagcctatcccttcaggtgtgttgacctccctctttacattatagtaaagtgcttgtgcttaatagtaaattccattctgcttccaacacggcaagcagtgctttcctacacttgtacgattttatttagtcccccaagaccctttcaactagatctttctttctggaatctaatgtctcctcttgtcagatagtcctttttcctggaacttgggttttatccacagaaagcctgttatgtttgtctgtttttccagcctttcctcgtatttcttctgtgtgttcttatgcctttcctttccttgtatgcctttgcttgtgttctctgatgctttttttttttttttactcgcaatcttttctttaatcttctgtggacttcaaacacaggtccgtgtttgaaaaggcagtggtttccctttcctctgcaagaaccatcttctccaggcacctttatcttggctcttgctcttccgactagcttatttaaattcctgctgtacctttcaatccattttgagagaagtataaataatatgtaacattgataacattttcctccattcaatcaacaatagtttaccaacacacacacatacccaaaatacccaatgacaacctctttttagggtccatccattcaaaaacacataccctgtgctaaacctctcatgctaccttttccttatctgagacttttctccaagcactttcttctcatgtgatttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctactgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttcttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccctctgacctccctaacactgcactcattcattcattcattgagacaggatctcagtcttttacccaggctggagtgcagtggcaatcatagttcactgcagcctccttataacttctgggctcaagcaatccttccacctcggcctctggaatagctgggatgaccggtgcacaccaccatgctgggccaattatttattttttatttcatgttatgtatttatttatttttattattttttattttggggggtggagacagggtcttgttttgttgcacaggctggtctcaaactcctgatttcaagagatcttctgccttagcctccaaaaattttgggagtacagcatgagccactgtgcccagcccctaacactcctttaaatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacagctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctgctctgtcaggaagcctgtgtataaatcattcagatacatatctctgccactaaagattatgcttctcagagttaaaagtactaaacaatgccttccaaggtttatctgccactgtttttcatgaacgctccaggatcaagagcacactttctggcatattgctttaaaatgcctcctttctaactgtgcaggtcaaatctgcattgttatttagaaatacatgttgcccatatttcaaaattacttggtatccacacttacatttacattttaacagaagataatactggttcccataatccaaatcactatgaggcagctttatcccagagcctcaaagtcaggtgaggacaggaaagtagaatgtttaaaattggatttgacccagaaaaccgaggacatgtggttgacagagggagaatgttaaagtgacaaagcaacttggtaaaaggtttgtctttggacgccatccccaaactgttctccattagtttctttccacttcgcatgtccttaggcaattggccatttgcctggattcctacttagccctctaccgagagcagcacccaagctatggggctcacctaccatcttccccatttttcaccatttccattgacttagagaaatcatccatattccaagaaaatgtcaactaatttttttttcttttttctttttcctttttttttttcttttttgagacaggatctcactctgtcacccaggctggagggcagtggtacaaatcatagctcactgcagcttcaaactcctgggcttaggcaatcccccgacctcctacctcagcctcccaagtcactgggactacaggcatacaccaccactaattttctttaatttttatttttagtcgctttgttgcccaggctggtcttgaactcctgagctcaagtgatcctcccaccctgacctcccaacaaactgggattacaactgtgagccaccacacctgaccaactaaaatttctcttttttttttcttcaatccctccctgcctccctccctccctcccttccttacttcctttcttccttccttcttccctccctccctccctttttttttattatactttaagttctagggtacatgtgcacaatgtgcaggtttgttacatatgtatacatgtgctgtgttggtttgccgcacccattaactcgtcatttacattaggtatttctcctaatactatccctcccccatcccccgaccccacaacaggcccgtgtgtgatgttccccaccctgtgtccaagtgttctcattgttcaattcccacctatgagtgagaacatgcagtgtttgtttttctgtccttgtgatagtttgctcagaataatggtttccagcttcatccatgtcactacaaacaacatgaattcatccttttttatggctgcgtagtattccatggtgtatatgtgccgcattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaaggaattgccacactgtcttccacaatggttgaactaatttacactcccaccaacagtgtaaaagtgttcctatttctccacatcctctccagcacctgttgtttcctgactttttaatgatcgccattctaactgttgtgagatagtatctcattgtggttttgatttgcatttctctgatgaccagtgatgatgagcattttttcatgtgtctgttggctgcataaatgtcttcttttgaaaagtatctgttcatatcctttgcccacgttttgatggggtcgtttgatttttcttgtaaatttgtttaagttctttgtagattctggaaattagccctttgtcagatgggtagattgcaaaaattttctgccattctgaaggttacctgttcactctgatggtagtttcttttgctgtgcagaagccctttagtttaattagatcccatttgtctattttgacttttgttgtcattgcttttggtgttttagtcatgaagtccttgcccatgcctacgtcctgaatggtattgcctaggttttcttctagggattttatggttttaggtctaacatttaagtctttaatgcatcttgaattaatttttgtataaggtgtaaggaagggatccagtttcagctttctacataatggctagccagttttcccagcaccatttgttaaatagggaatcctttccccatttcttgtttttgtcagttttgtcaaagatcagatggttgtagatgtgtggtgttatttctgagggctctgttctgttccattggtctatatgtctgttttggtaccagtaccatgctgttttggttactgtagccttgtagtatagtttgaagtcaggtagtgtgatgcctccagctttgttctttttgcttaggatgtcttggcaatgcgggctcttttttggttccatatgaactttaaagtagttttttccaattctgtgaagaaagtcattggtagcttgatggggatggcactgaatctataaattaccttgggcagtatggccattttcatgatattcattcttcctgtccatgaacatggagtgttcttccatttgcttgtgtcctcttttatttccttgagcagtggtttgtagttctccttgaagaggtccttcacatcccttgtaagttggattcctaggtatttttttctctttgtggtaattgtgaatgggagctcactcatgatttggctctctgtttgtctgttattggtgtataagaatgcttgtgattttgcatattgattttgtatcctgagactgctgaagttgcttatcagcttaaggagattttgggctgagacaatggggttttctaaatatacaatcatgtcatctgcaaacagggacaatttgacttcctgttttcctaattgaataccctttatttctttcccttgcctgattgccctctggccaactacaatttcataccatgatggatgccatgttgcccattagggggtgaaacagtgtttcatattgttttaaaggacccatagagatctaaagctttagctaaaggtaataaatggtagaatttcaagtacctcagcacactatagcataaagaatcttttgacaaggacacttttggaattcacttttccctactctccactaaaaagtcacagtagtaattatttacaaattcctctactttctctatagtggtccttcctaatacatgtttctataatgacacctacaattttatgttgaatttttgtttatatgcctgttcatgccagcattgaaaaagcttcttagggcaaagacatgttttaatcatcctttgtttctagttctttgtagcatgactggcatattgaaaacccaacataagggtttgacatataagactaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctgtctcactgaacctctgccatcttcagcatttcagcatgtagcttccaaggtcactctgaggtcactatcacagacatagaaaagaaaaaaaatcatgggtaggagttctgggggactgggtctaggagtggtgcacatcacttctgttcacattccattagctagaacccaatcacaagaccacatctaactacaagaaaggctgggaaatgtagtctagctgtgttctcaggaagaagagcgtggacttttggtaaactacagagactctggcagtctctgccagagtggaatacttaataaatacattcattcttttttttttttttttttttttttttgagacagagtctcgctctgttgcctaggctggagtgcagtggcatgatctcagctcactgcaagctccaactcccaggttcacaccattctcctgcctcagcctcccaagtagctgggactataggcacccgccaccatgcccagctaattttttgtatttttagtagagacggagtttcaccgtgttagccaggatggtcttgatctcctgacctcgtgatccacccgcctcgtcattcagaaagatgtgaaagatgagtgaaagttaactaagtaaacgggagggtggcaagagggcagaatgtcaagcaaaaggaactgtttatgtgaagcctctgaaagtgtaggtggcgtggcacagttaatgatataaagaaggctttccccttgtggctgttgcgcagagggagaaagaggcatttgatgaggcagaggaataagtaggaaatagaacttgaagattattctaaatgatcataagaatttgggccttttaactcaagagagataggagacctacttaaggattttaagatttggttttttgatgttttgttttttagagacagggtcttgctctgttgcccaggctggagtgcagtgccacaatcatagctcactgaagactcaaactctcgggctcaactgatcttcctgcctcagcctcctgagtcactggaaccacaggcatgcaccaccatgcccggctatttttttgttttttgtagagatagagtctggcttcattgcccagactggtctcaaaatcctggtttcaagctattcgccctccttggcctcccaaagtgcggggattataggagtgagatacgatgcctgttatttaaaaggtgactctgtcaattgtattctaagagtaaatttcaggaaaccaattaagagggtattggagtaatctatatgagagattatttgatcacatggtgaagactataaggatggaaacaagtgaacttattgagagattttatgataaataaaatcagaactcaaaagaagtcaatgatcaacgatcagtgataatgcccagttttctggcttaagcaaccccttggatgctaatatcatttgttgaaatcgagtgaaccagatttagaagaaagatcataaattcagtttttggcattcgagtctaaaacgagtgtgagatattcaatgactagtggacagttagatataaaagtctggggcttagagaaaatatctaaactagagatacaaactggagaatcacttccatattataactaaaaccatatactgggataagattagtttatgaagaaaagaagttagttataactacaccctgcaaagggagaccaagagtgagtggccagggaggcagagaaactaaaatcaggaaatcattgtattatagaatccaaggaaagaaagggagtcaataaattctgctgaaagttcatggaaatgagacctgcaaaatattaatggttcggtaatatggatgtcatttgaaatcttagtagcaactattttaataaaatgatggagagagaaatcaatggaacatgaaaaaatggggacagtgattgtaaccaatttcttcaagaaatttggctgtgcaaaggagcagagagacatggcacatgtagaaaagaggatagttgaaataggaattttgttatgataatagcgaacactcacacagtacattttgtgagccaggaactcttctaactccttttttacatactaactgatgtaattctactgactccatcactattcttccattttagagattagaaaagtgaggcacagaagagaaagtacattgcctgaggcttagtaggtaataagaagcagacttgggaattgaacctaagtagcctgactatagagtccatgttgttacaaagtcactgaggaatcttctaagcatattttaatgttgaaagaaagatctcaaatgttattttgtcttttgtcagtaataaaatatttggcacatactcccaatatttctgtctttctataaatcatatatatattgtgctataccaatatatgatgtgttttataaaacatataaatgaaacacaattttgaaaatatgggataaaagtaaatataaatagaaggtctaatattgtcttctcatactccaatggattatcttatgaaatctgcaatgaagataactaaagaagagagggaaaggatagagaaaaagaactgagtgcatttactggtttcgactacatgtgcaaatttccacaaactccgtggcttaaaacacccatttattagttcagtccagtaaaacagagagaaaaactagacaggtagctctaataaagtaaaatcatggaaatatatgatttcccagccagaagaaccttcaggactgtgttatccagacctgttttataaagacaaggaaggtggatcccgatggttaagcagttgaccacatttcacctccttcaaatccttcttatacagacattccctgaacttcctgtttcaaattgctatccttattccccacctactttacatgtttccacagcacatacctcaccaaacatgccttttattttactgttattttgttgactttgcgtgtcttactgaccactgtgcccaagtgcctagaacagtgcctggcacagaggaggtacccaataaatatcagttataccaaaaaatagtgaatgaatacacatggtggtccagtgctctttccaccactctatactgtactttactgtcactttttgtttgtttttgttattgagacagggtctcgctctgtctcccaggctaaactacagtggcacgatctctgcccactgcaacctccacctcttgggcccaagtaatcctcccacctcagcctcctgagtagctggggctataggcacgcatcacaccacacctggctatttttttgtatttttttgtagagacaggatttcaccaagttgcccaggctggtctcaaactcctgggctcaagcagtctgcccgcctctgccttccaaagtgctggtattacagccatgagccaccacacccggcctactgtcacttttaagaagcattttgattttctattttcatccttattttgatcacatcagaatatctgcttttctgtgaattattatttctaatgggaccacaagtgtatcagttaatcaaaatataaattatggacatcatgaggaaattttgaatttctaaatcataaagtggaaatccattttcaattaaattacatgaattttacacttacagaagagtaacttggtttaagctgttcaaggggtatagtactgtgtacatgcattcctgtgcctagaacactcatgccctcttgtggacagggttcatcctgacttcctgccgaaccttccttatctcagctcaggtaaccgctcctccaggacacctatatgtcccctgccctcctcctcctcccacagacaccagctctggttaaaaggggaaaactagaaggcttgtcttaaagctacatttgcatggccagcacattggttttacaaagaacatgcatttggggtggcttgcagaaatttataacgattattgagggaataaatctctaaagtccccctctccttagttactagaccctggaaggtttcaatcttcacctcctatagcatttgtgccacttctgtagtacagtcaatgcattatatttttactcatctaggtatccatagagcctagactagaacctagaagagtctgtggtggaactcagtaattattttttaataagaaatgaacgaatataaaccaatgagttacagagtatgcctaaagaataagcatccaaagatacactctctttcacctgaacaatttactatacatttgtagactaggccagattcagtctttctagcctgaacacattacacagcaacatttcacactgtgaccatctggtccattagatgtaaataccgatttggcagatacttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcttacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatcattaatttgtgtctattcaatggctgcatttttttaaaaataatgaaattatcaagctgctcagaacaaagctgccttctgattgtcagctgtatattctaaaagagcaggtaaatttctctgaatctcacagctggaacttttctaacactaactggcagtttccacctagtgatcaaggcaattgactaaaataaattacacataaagctgaaattcctaatagtaataaggccccttcatgagataatcacaccagcaaaagcactcatgtgttggctgcaaccctacagggtcttgaaattatcttataaaagctatacctccagaaatggttttgtttctagtttcatgacagggctaatatgacagtgtccatagcactaggtacaaaggaggagctccaaacaaaattcgttacttgactggattaaaatggagacactgttgttaaagcactaacatcagtgctatttacaaagcagatgactggtgaggacctcatttcaatacagtcaactgacaattatttcgaagcttttattatgtgcctggagctaggcatagaaaagtagtatatagtccctgctcttctggagtttaaggtgagttgagctcacgtgtaagaaataaatagggaaaaagtaatctcgaggcaccattctaccagctataaagcaattgctagcagaaatccaagtgggctagaatagtaaggaggtttttttgtttgtttgtgtgtttgttttttctttttttttttttttttgaacatggactagggcttaatggttaggagtaatttgattaggcagaagggaataaaggattgcagatggattttccaactaagcaaaagtctggtaactggaaggaatatagctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcataccagtatctaggagaatattgctgacagaaggaacagcaatgcaaagatcctcagatagaagtgtgtttggcatgttttggaaagaggaagtgaaatctggagaacagtggtaggatacgaagggggcagatcatatcaggccttttagtgtaaggaacagatgttattctaagtaaaaagggaagatctcaaagggctttgagtaggattgtcccatgatcagatttccattttaaaaggatcatgctgccttttatgtgagaaggaaactagaaaggagcaagaagagatgcagagaggctattatgaggctattacagaggtctaggtcagaagtgacaatgacatggacttaaggttgccactggtcatggcttgcctgggactgaggggtttcccaggatgcaggacttttagatcttaaaccaggaggatcttaaacaaatcaggatgtttggtcaccctacttggactagagtaataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggaggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagttagtgaccctgacagaaagatgttggaaagaatagttgaggggagggattggtattgaacattaatttagttacagatataaagtaagagtggaataaccaagtggatggccagctgggatattagtttctatcattccagacagcagtgtactagtaaagaaaactcatgattttgagttaaaagagtttgccccagttcctctctgagacagctatgtaacctacaccctctcagtctcaaagtctttatatataaaatggacataacagtacctcgttcacagggctattctagaaaaaagtagacaaaattgtcaaggagcagcaaggatatgacttgggtatcttcttttttctttgcaaattttccaagaacccttttagtccccatcaccataatcccaccaaagaaaaacattctttttaatttagaaaatcttggtttctagaactttagagtgataaataaaatatttatattaaatgtttataaattactatgcagccatctttcttccaaactggcatgccaaaactatgaaattagagtttgatgtaaaactgttcatataaaactattgggttcttctaattcttctatgttgatggacaagagatatagtaaaagcttcacatgctagaacaagactctagggacagaagtgcttttcttctcatcacagaagttcagtgaaagacttcactgaggaaatgaaaatattggtttccaaaaattcgtactggcatgagtctttaaatctgattcagggtaacaacactggcttactatataagccacaaacacaagccttgttttgactggggcagaatagaacacaccttgtggggatgacacagaagtccagatcgtcctgccgtgagggtccttcttgcgggcagtatcagggcctccccaggatgcatattcttttttttttttttttttttttttgagacggagtctcgctctgtcgcccaggctggagtgcagtggcgcgatctcggctcactgcaagctccgcctcccgggttcacaccattctcctgcctcagcctccagagtagctgggactacaggcgcccgccaccatgcccggctaattttttctatttttagtagagacggggttttaccgtgttagccaggatggtctcgatgtcctgacctcgtgatccgcccgcctcggactcccaaagagctgggattacaggcgtgagccaccgcgcccggccctcaggatgcatattcttgctcttgtttcacataaacttcaagtccctcatcctccccaacatgtgagaaacacatgacaatcatatttgcaaatatcctagatcaattaatcttggatcaaaccaccaggtagtaaaagaaagctgccctaattttcaaacttttggtagacaattattaaagctaattcttagggcattagggaaagcatatacttaaacctccaaaaatttcactaacaagaaaatggttagtataaattggatattttccttgcctttttctggaaatgagtttttctctatcttgttgatgcccataaaggacacaaatttcaggaaaatcaaggactagctttcaaatatcttggagatccagaagtaataaaatgctaaaactttttgaaaagtaacttcagttaattaatataaactacacattcaatttggcatatcaattacaataattttatgagcaaatgaaattttacatgttaaagttcttaaactaatgaagcaaatgtagatctgtaaagggtgctttaaaaaagcacttttccatatttttctttctcccaaaatgcccatatttttctcttaaacactcattcttctcccatcccataactttaaaattacaagtaacatcacagatttctcctgcttccgagcatgctttttcaaactgtacaaatactctcttctgaagataaatattatgtaaaatcttttaaacttcctatgtgtcataagattgaggaataaaaggtattggaagaagacatttgtgacatttctttgttcaacacaattgcaatgcccctaaattaatcgtggaattagattatggcccataaagggagatgttatttaagagagagcagtcatgtctgaaattcctaattagaacagttagagtaacctgatcctgcaacacaatcagttccccaaggaggctattgtggaaaatagacagaattctgcgaaaaaaaaaaaaagagccctcctcctaacgagcattttgaacagcaattttgttcatttacatttctcttgtcccataaagttcagataaatttgtccatattttatattaatttccatgatattgtctcccattcattattttcagatactctgaagagtaatttattccactagcctctcctgttgtataaattaattcctaggagtgagtaggcacatcaggtgaattcagcacattagaagtaactctttattatttatattagtgaaagggggttatgacctagataattcaaaacaggtattttctaaagtttccacttatttaagttttgaaactgtgtggaaagtgataatttaatgatggatcctgtcttcaaggagtttacaatcatgtgggagaattaagacatatacacactgagacaaaaacagagttcttggtaacatagagatgtatggtaaaatgctatggggactcaagaaatgaaacacttggagccataaacatatttggtgatgtttccagcacagacattactttagcagaaagaggcactatttctccctcacacattgaatgtattacctctcaattatagaaaaattacaatctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgtgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgttcaaaaatgcctgagtacaggactgttgaatgttctttgggcctaaagtatggttatcagtgaaataacatgagaagttatgagatgcatttgcattgtgttactatgggtttcaattttctagcctgctgctcagatttttagaattaggaataaaagttagacctcacttaagatgagtaatactaaaagtgcgaaaccttatactttgttacatttcagctatcaggaattcagaatttctcatcaataaatagaatttaatgacacacaaatgcaagtccttttcccaaaaacctagagtattagaggtaatcctatttgaaatgtaaaaggacaaaaatttaggtcgattgattcaactaaagtgttaggcttatttcaaagctgtttaataaaaacatgaaaattttgccaagagttttgcagtgctattcagagcacaaagtctctttaaaaagtcatgttgttctcatttcctgcaccattgaattatagatatattttgatgaacattaaagtatagatgatctttgttaaaaactgaaatagatggtcttaaaaaaaaaaagctgttatcactcttgataccttagtcaatgaaaggccactgtgtaaatgccaatggacctacaattttcaaattctaatcaacataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccacttcttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatttattaggtatttgatagcctaacatagttcctacgataccatttattaaagacacagcatttcaatatatatgcataatgaaatctctgtttcagagtgaacccctatggtaatgcatttaattccacagctgacattgaggatgggagagatgtggggattgaaatttccatacaacccaaccttagtaaaacgtggtggataaagtataccctggctcaaaagcaaagtcaactcaaggacttgtcacttccacggttgaacataatttttcttcttctgcatatgattaaatcaattatatttttaattttccgctaaatcattaaagtgtgaggaattttcttgatatgccacaaggtcatcataaattgactgcagttgtcattgtttgtggctgtggaattacaactaacattactggttattcaacactttctttaataaaaatattgcaaacttcaaaaggtcatcctaaggcagcatggtgattttttattctaaagcataacagctaaaaagtgctacagctgagcttcccctcacttacccactaatttgtcgaccaaattctcctggtacctgagtgtatttctctttataaataagtcacctggggaagctgtactaattctttcatgtcattaagaccctatttaataacttgctgtttttattgtgcctagcagtgtaacacagcaaatttgaagcaaagagcacagtgttctctagaagtatagagtatttaatgtgactataagtgaaaaacatgcagagaaatttttaactacaataacagttccctcctagattattacttagtttcctaaggtaacttcagacacctttaacatttccctgtcctttggttcaacagccaactatcatgacatgatttctttgtatcctgtctcttatgctttgtcccaaatatccatgccaaccatcccctcataacctatgtctagtactctgctagtcttcctaagtcatcctatctgcttcagcagataggatttgtcctggcttcttccggggtcccagaaatgagttcccatcatcatagagagatatttcaaccacgagttgttcatcccagtttgctgtctgtttccactaggacttctccaccgtctgtccccttctcgttcagtggcatcagagaggctggctgcaggcattttggaacttggctaagggaagttaggtctagcaggttatttttatggggcttacagtcatataatgtatagtgaggttattgctagctatcccaaagaaggaagggtacctgcaatgcactaactaactcagcattgtgaaatgaataaggaaaggccaaaggtcatacctaattttgtattcataattttatattctttgtttctgaagagaaccagcaaaaccatattagcttcaggatcctcacaacctgggttcacccctacatttgaattacctggaaggagtttaattattaagtaagaatatttaaagagtaaatatcctgaaaagccctaattttaagggcttctcactgcctgtagaattaagccataatcactctaatcacttgagtctacataatgtagatatgtccagcctatgtcatgccatatctcattttcaccaaattgaccaacacactcttttgcaaacaaactatacaactttctgcctctattacttgcttaggtcgtttccttcacctggaattctcttccttccaacaatgtctagccaattcctacccattctttaggcccagcttaagtattatctcctccattcattcaataaacatatattgtgtccctactttaagtcaacattgttctgagcactaggtttacatttgtggataaaacagtgcaaaagaccctcccctcctgcagcttgcattctaatgtagggaaacagaaaagaagccaacagatagcaaaagcatgagtctaccaagagataacaggtgctatggagcagtaaagcaggaagtaggataaggaatattggggattcatcttaaatggggttcaaagaagacctctgagtaggtggcatttccgcaacaacctggaagaagtgatgaattgagccacggcgcgtctgggagagagaacaaccacggggcttctgggagagagaacagccatggggtgtctgggagagacaacagatacctcgtggctcacttcttcacttcttccaggttgttgctgaaatgccacctactcatgaggtcttaagacctcatggttttaagatccatcccagtagaacaaatctttgcctttttttaaatgccattagccatttgtttacacccctcaaacatcatgcttctctctcactagactgtgttctgtatttatccctcccacaatgctctcagtgatgggtagcactaagcatagctgctgaatgaataatgaattatttacaaaggagctatggcctgaaaaaacaagtcttgcatttcaaatgtgtctaacccacttaccattaaaataactttaagcacttggatggtctgtctcaaagtaagttgacctatgtacgaggagaccaaaattatataataagatcattccaggtaattcaaatgccaaagtacatttgctggaaatgactagttaattggaaccaaagtgggttgttttgccagagtttaaactccatctgccactaactagcaatttgacattgcacaagttatttatttaactcttctaagcctcagctgcattatctataaagtgggaataatgagaggactttgttgatgatgctatgagaaataaatgaaagcacagggcctggcacaactaagtactcactaaatactattgtagtcatttctattagtaattttatcaaatcttgggataaatatgcaacatgggaaagcaaccaatggatgatttaaccaattacttgcttcaatggggaaaaaaagtttatcttattgtttgatggaattagctgattaattcaggcaaacgtatcagtaggcccacattttgcatagacactatagtgaattaagataattaacaaaacatttgagaaaataaaacatgaaaacatatgtaaaataattttcttattgctctccaacaaggttatttccttcctgcagtattcattcaaaatgcattgcacaaagatttggcctctattgtatatccacatgcaaaaaatgcaaatctcagcccttcatactttacagtgacaagcctaattggactatgcacatctctacagtagatccttgcatttgcattcttaatatcccaactttcaaatgcttgtgagcaacagtgaggatttctgaatttaactgcagtcatgtgttgattaacaacaggcatacattttgagaaatgtatcattaggttatttgatcattgcacaaatatcataaacacaaacctagatggtgcagcctgctacacacctaagctatgtggtatggcttattgctcctaggctaccaatctatacaacatgttaccatactgaatactgtaggtaattgtatttgtgtatctaaacatagagaaggtacaacaaaaatacagtattataatcttatgggaccaccattctataggcagtccatccttgactgaaatgtggttacacagggcatgactgtatttgtattgagatcttgaatcttgcaggctgcaagactgttcttcaggagcaagttggtgctgtagaacatgtgtaggactttttgccttatacgtggagacaatcaagacttctgcctcttaaacatgtctcaatagcttcgttgccttttacacatctctgtgtggagtaaatcttccttcaaataagaaatgttttctatttgggaaaattggggaagagaataaagaggtcaaagtaaaggcattggaaacattgaggcttcccaaaggtatgaggctgtgtgtctcatagttttaagctaaagtatataacttttattcttaaatttgtacctgtgtaaactcctaagtcagagactaatcagatacgttgctacttgtccctatttgtgtcatagcaatcactttcctcaagtttggtgttttgttttgttttttgtcatctcagaaatttgacacgtctgagtacagctttaatgaggaatgtcaacactgtaagtttagtttaggctttctgttgtaaattaaatgaaattctgaaagttttctatttaaggacatggccgtttaaagaaggaaacactaaactttaaaataagcaaaaattgaagtgattatagcttttaaattttgatctattccgtagaaattctgtttttctacttcaatctgagaattatttttaactgttaaaaagtcacattatcagttatagaacactttctaatttagaaatattttttaacttggttttctcatgtggttctcatgatagccctgtgagatactttctgaagatagcattctgattttaccagtgagaaaattgaagcttagagacattagacaatgtccataaactatcttcctgcatgtggcacatagatgggggtgttcaatacttgcaattgctcttatcactactgacatttgatctcagctgatttgagggtaggactgaagttcagatccccccagttctcaatgcagaggactttctaatatagcattcagccttgcccacacccctaccttcaagatgggagagcaaggattcctcagctctaacctgcgtgaggtgcctcccctgcccaaagccgaaacatcaagatgaggtcgtcacagtagggaagactagaaatggagtcttcatggattgttggaaatggagggattcttggagactggggaaaatgttcgtaactgtaaacccttaaggatactcctagtcaaatagctccagggtgccccctttcttgccttctcagaaccacaaattgattttcttgcttcacttgtggtttctggcagattcctcttcttgcctggcccaatatgaaacagaatgtgatctcacagacatgttctacttccctcattccctgaagctagcacctaattcttctgagacttttttctgtgtttgtactgctagtagccatggcaaatcaacaagggtaaaaagtgtgcagttctgctcgtttgatgtggtttgcattcacctaaattggaggagtagggaacataacaaaagtatgtcaagcatgggggcaagctggaaacccatatggtaaagggctgaaatcacatgtagctattccagcagcctcctgaacatcaaggagctagggaggtggctaggaggtgggatcaggtcaacaatggttgcaaagtgctctccttcatcatttttctgtccctttcactctgtgttctatgacccatccctagtcctcttcctggccatccctagtcctgccttgttactatgaaatgaaacctgtactgtgaaaagcaacatttggggctgtaggagagttcctccaaaacatctctaagtctccaaaagaaaagggaaatgaaatgtttgaaagtggcagcaattacttgagggaaatgatagagagggaacaggggactcgtggtgatgaaggagtcaccatcactatatgtcacactgccagtgtgtggattagctactgtgacctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcaaaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcctcaaataagaagttctatttctttcatcagtccagtatcctcttccctgaaaaatacctggcccacatgtctaaattattatctttttttcttgagtctcctccactgaaagaggaaataaaagcaatagatgtttcctttgtacattctgaagttgtttcctagtacccttgactaccacccttatctgtccttccactggtgctgaaagcacaacaaagaaaaacactccaaattcaattgatgtgaactaaaagccaccagtctgggagccgggccaataaataaaatggcaaaaacttatttgaaccaattagacagggatatgcaaattaattggccatgatatcagggtcaagcaataatatgcaaataaactggcatcttattgagctaatgggacaggaatatgcataataatttggctgtgatgtcagaagcttcatcataattttaggcatgaatgttacaatataatatcaattctgggatacttcaaaatgcttaattacaatattgataaaataatctgaattcgtaaaacatgaacagattggtctaaaaaacaaatgacaagtcttgaaactggatcattctagaaaatgagtaattagaaaggattatagccaagcccggtacaagttgggacccaggcacagttatccacagaatggatagaaatgctctgcctgaaggactaaaagttttagagaaatgagcagatgtgaaatcaagagaaataagtgataggctgtaatgtatttgttcagaagagttagcccaaaaactcctaagtagattctttagccagcaggtatatatccaatcagtcaacaaacatcatgtgaaaactcctctgtgccaggcaccatgccagtccttgagaatatgagtaaaaacagcagacacttgcatagcagaatgtgagcccagacactgttctaaatgctttacatatggctaactgatttaatccccagtacaaccctatgaggtagatactatttttaatgtgattttattgatgatggaactgaaggacagagaggtacataacttacccaaggtcacaggattactatttgacagagctaggatgtcaacccaagcagactgtcttcagactccaatgaataaaacctgatgtctaggtccttatcattgctcagcaggttcaacctggagaacaggtggataactacatgctgcagtttgaaagatgtccaaaagtgacctgattccaaatatcctctatactcaagctaaaattctatcatggaactcactaacataaatcagttggttgactgtttaattagttcttcagctacttagacagcaaaggtgagatcaacaagtccataacaccagacattgaatagttatagatgatttttatgctggaaaggactgtatcagtttctccctaatgtacagattggtatgttattttagtgacttattcttcacacacaaaagaagatgagacacaaaacagtgacatttcagctgtatctgtggtacagaagagaggttgccgaacatggtagaagagagtccaagtttaagggatttgagtgccttttagagattaaagaaaaattttacctacaactaaattttagcaagggctaattctgtaaaggagtatgtgatattattgggagaggggcagtatgatgtaggagtacaaaagcttactacccttgtaaattgttatgggactctttgggtcaaaattacatatataaatactaaaattaaagaaatttgaattgcaatagacaacttaccaggaaaacacatgtcagctagataattttaacaagagaaatctacagatgaagaagtagaaacagggagttccaaagaggtctgttctaaggcactttcaccagtcaccttaaaactcataattctgaagataagataaacgtttccagccattgaaatgcaaagctcagtggtaaatttaaaaaatctagctaagctgagtaagccaaaaaatgtggtagatgtgcttcatttgggtcaagctaaaaaataatacactaaaaggaaaacgtgacccaatttagagtatagagtaataggatcaattataaatcaagaaaaatgtcacatagaaccatccattgaagacattcaccaagtgaacatgtcttttttgctaccccaaaaaaggcttgatgttgtcacagaagattttataaataaaagggagggaaaatctcctacctttgtccaattccagagctcattcatgtgtacaacacacagagttttggttgttcacctcagaaaagacagtggtattagatgactatctgctggaggaaagcagctacaataaagggatgaaggggccgtgtgtgaggacaggctaggaacagcgggactttgtggtctgaaaaggatatgatgaaagtctgaaaatcatgaaaggtagagctagagtaatacctacctatttatcacatcccacaatactagaatcaggaagtcaccttgatgtttgaaagagaatagataaaagggatagctattcaggatgatctcaaaggcacctttctactcaaaaattctttgtcaaattttctttactactttacatttgggttgtaaatacgtgttgctctaggaaatggaacagattgaaatataagactgagataagtgtaggtctgttttgtgttataggcttacaaggagacatctctaaacctttgtgttgtcttgtaggaacccctcatgcctttccatgggtaaccataaatagcccacagctgcatatctcactaatccaacccagaatgcttacatttgcatccttcagttggccacttctattcccttctcttcattcagtatacagaaaaaaaaataaggagggtcagaatttctaataggtaattgcactgggaggaatagagtccccacaaattcctatttttaaaaattatgtttagtgggttctttcaggagatatttgggagtttctaataaaactattagaaacatgtagcaaaagtcggtgctattcccccttccttttacaaaggtataagattcctgttagtaaagcctataataggtgacaaaagcatgcaaagttttgagtctcaaacactataataatgctcagaaatggaaacatcaaagacagtcttttaaaaacaactgtactggccaggtgcagtggctcacacctgtaatcccagtacttgggcaggccaaggtgggaggctcgcttgagcccaggagtttgagatcagcctgagctgcatagtgggacccccatctctacaaaaaaaattaaaaaaaaaaaaaatagccaggaatggtagcgcacacctgtggtcccagctacatgggaagctgaggtgagaagatctctcaagcccaggaggtcaaggctgcagtgagctgtgattgtgccactgcactccagcctgagtgacaaagcgtgtccctgtctcaaaaaaaaaaaaaaattgtactttattataatcacttctgcttccaaaagtatatactgtttctacttggttccttaatcccttattcttaatctcagttataaaaatatcattcttgttcccttttcaccatagtcttgccacttgctgcaccatgagctactttgagagcagggattgtgtctacttatgtctgtgttctcagagcccctagcatatatgctgaagaaacagaccttaatataccctgcctaaacaatcagttttaaatttttaaattccactaatctaactgattattttgtcttcatcttccaaatgatctgacttaatttcatcacttaatgcaattattttggcatcatatagtagtaatcctattataatagaaatatcggctcataaataaaaaccagacaatggaattcttaaaaccaattggttattttagccatcattttcagaagattttacttccttccttcatttcccccctccccaccccctttaatggttaaacgaaagaaaaacagactatctccaagagataaaagagagtgacacagaaatgcacacattactgtagttatacctcaacgacagtcataaaggcattttcaagggaaaaagtaaagacagagaatgatcccttggtcaccttttgcccagcatgaacagataaggcaatgattcagcatcttacttgtccactgttttaaagactaactccttatcaaaggaagtcaaaagaccataccggctgacagcctttttaaattactaatggcctaaattttgcggtacatcattttcaatgatgactggacaactaggaggcttcctataattttttctttcagaaataaatgattttatttaacttaaaaaaagaattaagcgcatttattttatatcctcagaaccactgaaactgcttttagccaaaactaaagcaacatgattaagaaattaatagatttcaaactactgatttcagtcaacaatatgacagtgtaattaactaataaagtgtcccgttaacaaacaaaaagagccgaatgcacatttcgtgatagtgcacttgcagaattactacatatactacatatacatatgaaactgcaagattactcagtaatctactgacgcagctgtcatttttagagaatattatgaacttccatatccttattaaggaaacaaatgctttcacaaatagccctgtgtttaaatatttatctagaattttagttttaaaattataggaaagctcaagaaataaagttaatccacaaccccaccacttcttttcatacataagtaaaaaagtaactcaaatcagccccctctaatcctttcccattcctcagagttaattgactcaaggaaataatttgaaatttcatatccttccaggttttctttctgcttatatcaattctatacatatatatacaaatatatatacattttacaaaatgggattttaaacacattattctgtaattatttttaacctaccaatatataatggagatcctttgggccaacatatagatctgccatatctagtggttgcatagcatccctttgttcgaatgtatcatggtatatttagtaattctcttataaatataactatgagaaaaactatataaattcactgaaagacttcaaatgagacctaaataaatagaaaaataacatgctcttggatagggaacaatatagtaaagatgtcatgcttcccaaataaatgccataaatgaatttgaaagatgagtaacacacgaaaagaaagctttgcctcacataaacagatcaagtattaatatccctgtaatacaaagagtttctacatatcagtgagaaagaaaagcaataggagaaagtctctattttattaatgttcctaaaatttacttgctgctgcttctactactggctgctgttgctgagaagtaaaatgttacatttatacaatgtcattatgcatctaaataagaaaggattttaaagtaagatgcaattaccctaagttcaaaatctaaaaatgtgttgcttaaaaagacagcctagactgattgcaaagagtaccagaaaaaaaaaaaaaaaagcaggtcattagcttgtagattttcatattttcatcaactatatttgcaggagtctgaatccattaaaacactcaatccagcagcattattatgataacaacttgaaaagatatgtgacagtcactaaaagtcaaagtaaaaatacataccgctatgaaagtcattttgaagggaagttcccaatttctagactttataaaaacaattaagcatctgaaagctacttttactaaaagttgccaattcgtgtatctagaaaacactcctgcattttacagcactgtctttaatgtagtgaaaatattgcaaatgaaactagcctaaagggcaataatatatcacagtatatctccagttacagtaattaggaatctattctaatcttacctgaaagatatgttagtgttttatgtttataaggatttcaccaaaattttttaaaaatagcttagtagaagagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcagggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtgtgtgtgtgtgtgtgtgtgtgtgtgtgtgtgtgtgtgtgttcaaagaatgcctcttcattatttggatggcagttaactgctttggctaacttatgttggcatcctgaagctaacagcaaatcctcctcccatctcctgtaacttgtggccacaagacccagcatattttataagaaatcagaccagtagtatatttctacgatcttcagtttgttaagctatttatttgagttaagacaccgagttgtcttccaagtacttcttttatgataacagatccaagacagacacagctaatttgggcaacaagtagggacaaagaggaagaacagagcctctgtcatcctaattatcaagttaatgcctggttgctggacaaactctccctctctctaaaatgaaccaccgcaagttggaacctgctgttgcaatgttaatttgactagaagtggcaggacctggtcccagagcagctcctggttgtctttccaaataattttgccccaggtaataaatacctaattgatgcaatatgagtcagtatttgttgttcattgctacataattgagtggtcaaggtttcatctttcacctgtctctacaaattcttaatctccacaagtagtcaacattaaaaacaagaaagttacccatgtaaatttctacatgcttgcatccaaacaccctttgactctcttcagcttgctttcctctcgatgaaatttcattttccatattaaacatatctccaggctgtgcccatcttggcatttcaaaaaaaaaatagaaaaacctggttggattatacgtctgccttctccttaaatcagatgaattgctccacttgccggtaggataaatagttcagttaaagcatatactaagaatctcagataagtagctcagttaaaacatatactaagaacctaggtaagaaatgtgaaaaaaaaatattgcttattagtcctacagcagagatgatacctttttttaaaaaaaaaaattattattatactttaagttttagggtacatgtgcacaatgcgcaggttagttacatatgtatacatgtgccatgctggtgtgctgcacccattaacccgtcatttagcattaggtatatctcctaaagctatccctccccccaccccacaacagtccccagagtgtgatgttccccttcctgtgtccatgtgttctcattgttcaattcccacctatgagtgagaacacgcggtgtttgattttttttccttgcaatagtttactgagaatgatgacttccaatttcatccatgtccctacaaaggacatgaactcatcattttttatggctgcatagtattccatggtgtatatgtgccacattttcttaatccagtctatcatttttggacatttggattggttccaagtctttgctattgtgaatagtgcctcaataaacatacgtgtgcatgtgtctttacagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtaatgagatgatacttttataacactttgatttgtcattttactaattgctaaatttgcccatatcagtcatgttgaactgtgcctccctcaaacaactagcaagactgatctgaggttgaaccaattgcttaggaaacatcctctatgaagctataaacctgaaacctatctatattcagtctctggagatgaaagtgtcagagctggcagggcatggtggctcatccctgtaatcccagaactttagaaggctgaggcaggaggattgctggaaaccaggagtttgagaccagcctgggcaacatagtgaaaccctgtctctacaaaaattattagccaggcatggtggcatatgcctgtagtcctaattacatgggaaggtgaggcaggaggattgcttgagcccaggaggctcaagcccatgatcactcatactgccacactccagactgggtgacaaagcgagactctgcctcaaaaagaaaagaaaaagaaagtgtcagataaatttaagaggtacatttcagcctgatccatattgagattaagggctgctttctttttaaataaagatatgtttagtatttctacaataggattcaatacaatagaattgaaagtatgtgtaagtttagcccaaagctaaagagaaagatactattctcaagccaaattacatacagtatgtagatgtacctgtatctttatctttttttattttttttgagacaggcagatatatcttttaaaattgacttggcctcatacttttatagcacatgcagattttgattcttgtaactgtcacttgaaattttgttttttaaagctaaattagtccaatcatcttgcatgctgcaagaggaactagttattcaaactatgagaatttagtatttgcttacaagcaagataacaagaatggaatcttttttatcttgggtgggtcagtgagcaaaaagatatttctttttatttctgtgtgctattaatatgggtggttcttatcattgcctctctaactttccatttaaatttcaaaatgatttaatcttaaatgtaaaacaactgtgaaatcttattaccgagattatttatttcaaaaatgagtctccggcaacagagttcctatactctatgctgagagatctggaatattgcattcatttctgaaaacacacttaagaggagagacattaactttctgaagcaaattcagcaggaaatcagggtcatgcagagggcagatacagtctcagttaaggaacagttcaggcaattggagatgtttaagctgcaaaatacagaattcaaagaggacataactgtctgaaaaatgtgagaaaagaattgaacctactcttattaactataaagacctgaactgggatccatgagtataagtgatggaaatccatacttggttcttcccattttagttcccaaacaaaagctagaggaaagtttatcagaaatactgagttagggccgggcgcggtggctcactcctgtaatcccagcactttgggaggctgaggcgggcggatcacgaggtcagaagatcgggaccatcctggctaaaacggtgaaaccccctctctactaaaaatacaaaaaatttagccgggcatggtgacgggcgcctgtagtcccagctactcaggaggctgagacaggagaatggcgtgaacccgggaggcggagcttgcagtgagcagagatcgcgccactgcactccagcctgggcgacagagcgatattccgtctcaaaaaataataataataaaaataaaaaataaaaataaaagaaatactgagttagggatggtaccctacctacctgccataggttagggaattaacctattaaatccctccaatcttctaaagtttcattttaaaactctaaaagatcatgcccagcctaaagacaacatcagcccatggaagagcacatctattaaagacaaatgtatcctcaccaaaagtgattattttattttttccttaagataatacgaatgaaagactactactgctaataataattatagttataatctagtcagtgctttctctgctgtgcatttactaatttcgtcttgtttaatcctattcatactctcatgaggtaggtatggttatccccatatatgaatgagaaaactaaggtttggaaaagagactcgctcaaggtcacaaggtaaagaaatggcaaaggcccagctcctcactccagctgcatctgttacctaagcctgcccacttactcacagcttcccccacctagacagtgcacactgtaatttcaattggccataatccccaaatcatagaaacctcaactctagaagataatgaatgctcttgagcagcaaaatgatcatcagttgactcacaatgaatactctctatagattattttgacaaagtaacgctatccaactgtgcctgcaaatgccaacacatgcaaatccctgcgacttcataaacagcaaatgccctaatgagctaaagaaacaattgctctttattcattttcttcagtgtgtttcttatttctgctggaaaataatgtccagaaggaatttgtgttctattcaatgactataaaaaagaggaaggttagtgtttacaagtttacataatacaaaaaagagtggccgtgaaacagtgagctgtggcttcctggtgggaagacactcacatgcagcctgtgacttcctgggcagttttaatttacttttaatcatttcagaagtcatgcctcagaggtttgagataaaaagtttcatagcatcttacctttttcttttctgcccctccttttttagtttggtaaaatgtagtccagaaaaacaggtggagggggaagagccagtttaagtatttgctcctccaggaaacttcccacatatcctaaacccatctttgttcttctttacctttatactgtccacgttttttcacttgatcactgactgttgtgtttcttcaactgtgttctgtacataccttttctcattcatgagaatgaattgtttaatcatcagggttgccaacaccctcattatttctttttctgtgttcccatggtgcactggagttatctcgtcccatgatttatcacacactgtaggtattcgtggctctttctctgtgaactcctttaaggagaccaacttaattcacttttgcataaccgtcatctagcatcgcctagcacattgtaggcccccatgaagaaattaaattaaatgaaaactcgaatagttcacttaatccccagtgtttaacatatagtatgaactgaattgaagtaaagtgaattaaattcaatcagaacaaatcaaaatgaactgaaatgattataagacattattatgttggataaagttatccagattatatttataatttgtagaaaaattgattagcacagcctagctatgttgttgtgtgattcctatgatggacactcaggattgcccattatgttactaccatagaaaggtcagcagcctttaggcccaatattacagctagttctttaagctgaggccataagggtagacacagtctaaatcactgtgtattggctgagaaatgtagaccaaactccggaaggctgacagtatttctgaacaagcaaatgatgcttaaagtgaactgaagctgttgattatacaggaggattccccaacaagtagatctaaaatttcatttccagggctaagtcaccttcttggtccatggtttgctgtgatctcagagggagaggaaaccatacccacaacagcccctcatccctcccctctcttcttatctctagcttctaaatagttgtccatcagcacgcactgtgcaccccatctgagttcagctgtgtgttaggcacctgaaattcagtcaataccatgaacattatctctccacttttgggtcctaacttctcaaaaaggagaccaacaataagtaagtaccaaaaatattaatcataaatgatcacaaattctatcaggctgtgaaagagagaaatgacaagatatttccctcatccaaaaatgtagactctgatttaggagtataggcaattcttttctcaaaattatatctcttttcatcaaaaaaagtaattattggtaaaccagataaataagcattttgtaaaaatgaaaatgattgggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatttgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctctaacctgaaatagatgatcatttttacctgtaggcatgactgacagagcacagctgaagaagaggtaccagctgggtcatattctcatttctcactcgtgtttgcattatcaagttttcttcaagccacagttgttgttcaggactcattttaggcaacatgctcattttgtgaagagtagtttggttacaattaaataacataatctataaaccaatttaactgggctcacataaagcgcaatacatagaaaaatgctaacagcaaataaagtgcaggcccctctggcaccccaccccacggtggcgcttccatgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatgttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatttgaagaactaccctgtggacaaaagtatggaatcacatattcagcaaatatgtattaaatgcctacttactaagtgccacagtgaggagctggagagctggtggtagtgagatggattttgtgatacctgcctacaaagagcttggaacgagctcagggagatccactttaaaatactgtgtgatttagattaggagtaaacaaactttttttgtaaaggaccagatagtaaatattttaggctttgcaggccacatggtctctcgcaactaaatattcaactctattgcaacacaaaagcagccacagacagtctgtaaggagtagacatagctgtgttctaatcaaactttttatttatggatactgatatgcaaatttcatgtaattttatatgtcatgaaatattaatcttttttatttttttcaactctaaaaatgtaaacattttcttagcttacgacctacagaaacatgcagcagccagatctggtccacaggtagtaacctgccgggagctaattaacaggatttcacaagagctcagaggaagagtacttaacctccactggagatttcgtgggcgcttcctggagaaaccaagaaccgggttgagggattgtgcagggcaaagggataggccaaaaggacagtgagagctaaggcctggttgtacaaaacagatcgtgtagtgtagaggagctgctaagaaatgaagttagagaggcagagcccagtcaggaaagttgaactttatgttccagaggtggtgagtagccactgcagggatttaagcagggagtttgtgctgcaaactgtaacattaattccagctcaggctgtggaatcaaactgacatgattaggatcccagttctgccactcaccaagcatctgaattcaaatcattttcttatcctcttcaaatatcagttccatcatctgaaaaccaaagataatccctaccttgctctttgttattctctattcttgtacctgtctgcttcacttattgctcatagtgtcacaactggtaatataaatttcattgctaacttgttatttgactgatgccccctctagattgtggggccatgtcatcatccatataaaccaggtacctagcagggcgcctgactcaaaagtacctgatgaataaatggaaaaaaaaaatcaactcacaatgataaagccaaccatctcccaccttgtagttctatcactatccatgcttgcttcttgccttacaaggataaatatgttgtatcatttatttaaaacttggaataaagtcataaagaaaaatgattaatcatttctatacatctatcttatccataatgtttattttcttgagcaagttctcattacacttcattttgccacatggcttttccttcttccactgagacgcacttcctccaagaaactttcttaatctaaatgttacaggaaaggggtcccaatccagaccccaagagagggttcttggatcttgtgcaaggaggaattcagggcgagtctgcagtgcacagtgaaagcaagtttattaagaaagtaaaggaataaaagaatggctactccatagacagagcagtcccgagggctgctggttgcccatttttatggtcatttcttgatgatatgctgaacaaagggtggattattcatgcctcccctttttagaccatatagggtaacttcctgatgttgccatggcatttgtaaactgtcatggtactggtgggagtgtagcagtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccaatgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttactgtgtgccatgtattgttaaatcttcccttttagagatgtttatgtaacattttttgtttttttgttttgttttgtttttttgagacagagtctcgctccattgcccaggctggagtgcagtggcgcaatctcagctcactgcaagctctgcctcccaggttcacaccattctcctgcctcagcctcccgagtagctgggactgcaggctaccgccaccatgcccggctaattttttgtattttcagtagagacgaggtttcaccgttttagccaggatggtctcgatctcctgacctcgtgatccgcctaccttggcctcccaaagttctaggattacggtaacatgtgttttaaggtgtttattttctaaatagcttaaatcttaaccaccaatttatttttttcttctatatgtgttggtaattgtggcctagataaaagctctagcaattgtagtgacaggacaaaatataaaaattctcagggctatttaaattataaacagattttaagaagcactgtgtggtgtttctgttatccttctgctttccaagagaatatatctgcatcctgaaatctaatcacatttacttcaggcagagttgcttttggaaattcaggctttgcccatattgtctttgttgtataaacaacttagcttccctttctcccttttgttctagaattatttagtactaattatagattgagaatatccagggtcaggaagacctagtccaggtctagggagaatccaggttcaggaagagaggagagcatgggcttggttagggacatattaagcctatgacaccaattaagacaacaaatggagatgtctaatatgcagttagtccaccaaaattatattcttatttcttaagtttttcaaactgccatggaatagtccctttttcattatctcaaccatgacaaatttctcatatttatcactcccaatacatttaaaaggtgttagctagagtgtgtttctcacttattcctcatactatctaattcttaaagctcttaactatataaaatgcaggccataagccatggagttttcactcatccttatttttaattcacttgctagattatcaaattcaaattctcttctattagaaatctttgcctcactaactggaagaagctcaagtcttgattcctttatgcaatccttccaatccaaccccagtttacagatgtgtgcctttttccaggataaatttggaaaccttccgaaatatcacagatatgaccaacttttgaaggatcttctattgtggttatgtaatctgtgtcacataaacacaactcttaaaatttcaaagagaacagtccactggaaacaacctttttgattcttcttactaccaaacaggctagattacgtagcccatgaagccagtttacagaaatgaatttgtaaagaaaatcgcttttaaagaatcaactgaagagaggttagtttagtggcctcacagacttcattaaaaacaaatcttgctcctgatttggcagggattttcaaactattctgattcaagaaccacttgtgaaggtcaaaagcacaatttactagcctcattggctataaaaagaaacaaaacatgacccccagtggggtaaaggcttctgatgagacactagcattaaattgctaactcatgccaaaaacaaaagtataaagattggaatctaggtcagtagtgattaatccgaggaacaggctggaatgaaacaacctaaggaccctacttggggaagcattaaatgtcataaataaaaatggccattagatgaatttacagcccaaattaggaaagtttttctatcagttacttgcatacagaacttaggaaatttatggaagacgtgacagtgacttccaaaatcgatagaaaaattagtacatgtttgaaaacagactttgggtcaaagtgtttcttttcaaaataggggtgggagttggggatgtgttaccctctaaaatcttccatagtaatttcctcctgagaaaagaaattcatttcattttagtgttcctatcatgtttttgagaatttccatcctcattttctgttctgagagcatggtttagtaaatagtcctcagacccaataaacatatcaacagagaattttttagcaagttaatcaaaatatgaggaaaacaatgggatatgcttgaaataacaagtcacttgattacttaattaggttaacaagactgccacaaattgaaaccctgtcgttttttaaaacctcggtcgaaaatatttctgggtaatgattcaaggaatgaagaaaattggcctttttgaaggttaccaaaatgtaccagctgtgtaccattccaaggagtcctctgagaaccctgaaaatacatacgggtttttgttaatcattttaaaatctcaaagagcagtctgtgctacacaataatacacgaaatccacatgaagcctcccggtattttatggcaagtcctacttaggccaagctttttggatttgcttcagatctttatttccaagctcagtagcaaactcctgaaagctttgatttcaaataaacatctccattttgtcttttgcctcttcatgtagtaatcgtgtatatgtttatatactgaagaatcaatcatccaatagaaatctagctttgataactatgtttactaagaggatactaaaattacccataaggtaatttaagggaattcattacccaaataaaagactatgagcataaaaaactatagatattgctgagagtttacttactgtgcttaatacttcacatgtactattacgactaatttgccttcttgaaaagatgaggaaacaagcctaaggaaattaaataatttgctgaaggttacacccgagagcaagcaactgaaccaatcatctaacccaggccttctaactccatttgggtcatcttttctgatttgtggctctaaaaccccctttccagaaacaatctgacatttttagaaaccttcttttagaattgacgtattttactgaaaaagattccatttcttttgaagattaaccagagattttaaagctaatcttggcttttctttcaacatttcttcaccactgccacccccaccaaaaaataagagaaaatgcagtttctgtcatttagatattttgagaaaatattaactgcagaaacaaattagcatgctctgaaaaacaagtcccagagtttagagagactctgacaaagatgcaatttgagtgtgttcctcaagcacattcattgccatttataccttattcacaatcagcaaatctggctgtgcctgggatgaagaattttttgtttatttattttagagacagaactttgctctgccacccaggctgctgcatcctaggtgatgtagcctgctacatgatcatagctcactgaagcctcgaaactcccctcttgcctcagcctcccaagtagtcgggactacagatacacaccaccctgctctgctaatttttttaatacatgggggtctcactatattgcccaggctggtctcaaactcctggcctcaagcaatccttccacctcagccttccaggtatctgggattgctggcatgagccatcatgcccagctaaacaagttcttccctaaaagtgaagagggcttgtttaaaaggactgtaataagcttcccttgcaattccccaagtggactttgcaaaatgtcctcctcccctcaattcttccacctcctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccctgattcctactttaaaacacaaccatttccattttcgaaagattatagatccatctcttgcttgcctgaaagtaacacattctttcttcaaaggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttacctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataaacactaattatagagtattataatgatttctgggcttgcctcagaggggcgtctatctggctaggtaattacttccctgacagataggtttttacgtgagaatggagcatgatgagcctagtttattgcctgctgatgagaccacgggggaggaaggtcatgcggtatgcttattaagaccattttagtcaacgtgtttttcaatcagtcgtcagggtacccacccctggttaaagaaacgctacagatgaaaatgacacagtgattctcagtcgtgcgagtctgttgctttagggaagtgactaaatggtaagagacttctcaggttgaagtggaaggcatttcttgaaaatatgatgcctttgcctataatgctctaaagttgatccctagtgtgaaagagagtgctgctttctgtatgatacttcattccctgaaagactattttccccagctaagtcagattcaagttcctacacaattctggataatgtttaggaggtatcctgacttcaaggaatttatattcaaaaatacacaaacacatgcactcttctcccttctcccgtaacctaattgagtttgccaggaaaaaggggcaatgattttttccccttgttatttactaatagataataaagaatatatactaggggtaaaaaagacagaaaatcagagagtccagagaggaaaggaagttaaaaaaaagaaaagaaaaactaaatgaagcttttacaaaaatgcgatagtgtacacgtactgcccttcttgaaatgatccatcttattaaatgatgtggtttcagtgcttacctcttagtcctgctacacctatgggaatttggaagaaagctaggtttttcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacattcttgtatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatagggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttatgagggcacgtaatcagagtggctgtacctgaactaggtacaaaaatgcttaatactcagcttaacactagcatgtaaaatgtatgtgaattcagcaaaacatattttaaatgactttacattccattgctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcagctaatggaagggaccactggatttttttttttttttttttgagacagtctcactctgtcacccaggctggagtgcaatggcatgatctcagctcactgcaacctccgcctcctagattcaagtgattctcctgcctcagcctctctagtagttgggattacaggcacccaccaccatgcccagctaattcttgtgtttttggtagagacagggtttcaccatgttggccaggctggtcttgaactcctgccctcaagtgatctgccagcctcggcctcccaaagtgtcgggattacaggcatgagccactgcttctgggcaggaccactggatttccatatggaaaaaactactatcaaaaaaagatttttttttccaaactctacatagataaggattgtataatcagttactggaaatgcattcttaggattgtttgcataatttattttctatgtatttgtggatgctcaatcaagctttatgtatattcattgatttttttcaaatctgattgccctagttatgcgtgtttattccccccaaaattgtcagccacaattaaaattaaaattatgataccaaacttactggtggtagcatgctataatttataattcaagatggtatcagagccacattatatactaaactggttttgtatatgcagtttatcataggatttagaacaaatcagtgtattaggccagagttaccaactgaagggagcatcaaccaactgtggttatacaattacccattgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatcttgtagtcaaaaggaaaacaaactttgttatgtatactcaggctggcccacagaaggtggtgcatggcagtgctggtgaatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttccatgcttattttgcttttattaaaaataagaaatctgtattcctggtattccctggtgtttcgatcttttacacacctattagaaccataatttctgtaacatcataacgcttttcaaaacgtctcagtgcctgttcctgaagttattagtttccaagtctcctcaatgcctagcctcgtgcatccatgggtctgtagttgcgcctatagcattctcattgctacttcagtttccctgtgacctcctacttcacttctctacgggtgtgcactctccttatctttcttgctttctctctcaacgttaaattcacatatatgaaagacattctatgggaagaataacctactccagcatttaatagagccattctaaacatatctgacatagagatgtccgcctgtcacctgcctattcaggaaatgagcttgagattggagatagatatattattgcaaaccacaatcaaggctaatatcttaacctgattttatcctaatttatctctgtttatcttcattttcagcatttctgctctttctaccctctcttacccaccttgtaatcttcaaatactatatctaactgatacccttcataaagggaatatttttgcacatattatgcactttcagttgaagagacagtaaccctccaagacagcaatggcccagaaaagagactagaaatgtagtgataattcataagtcaacatctgcctctcttttctaccttagccaagtttaatgcagagggcattacacttagttctagtctcaagtctaccataattagaaccataatcatgggcaaatcatttaacttgtctgggcatcaatctctcaatgaaaaaactaagctatttgacacatatggccccttttatgtttaaatcaattttattgttttttactaaatgaggtgtagaacattgacccatcaaatgaaatcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcacatatgttaacctttttctttaaaagttactttgttatatgaacatttattttttaggttatatatttaatcccaaatctttgctatctcatgaagaccagtttgtcataaacacttaataaatgtcattttgttcaattaaaacagaagggcctgtacatcctatgcatacatactttttcttctactgcattgtacaaacatttaaacctgtgtgtgtatagcttcaggaaactgtagctggagctgggccagaaaatgtctacagtagccttacaatagttttctagttccttggtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaaaaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggacatgatctacatcattacatcacacatgagtccagccctctttgtctaagcctgtgacacatacttaaaccctgctgtttaacaaatcaactccaaagtaacccatctttgaatgtcattaaggatgagtatctgcaatgcaagaaactttgttatcccatgatgtttagaaaaatctgcttaataagtagatatattccacttgtttgttactctccataggtactctctctctacttacaacagaattatatgtaatcagttgttctcattcacataaacaaaccctgacaagaaataaaaatgtggtaatatcagttctctgcatcaaggaacatttttaataaactgtactatagaacgtcttactaatcagatcttttaacaaaacatatgttagccgtaatttctgtactaagacactgaatctatattacattgtaaaaatttgagtatgagctatctatacgttcccagcattgtatcctatgtaaaaaccctaaattaaataatacacccaaagaaattgagaccatttttagttaatttaagaaaataatgtcagatatttccagttgctaagcatttaatatgaatcaggcactgtgctaagaattttatagagagtagcccatctaaccctcacagtaaccctatatggtaggtactgtaattaatattattttacagaggaggaaactaaaatgttaaaagcttaattgtccataattgtaagtggagctagaattcaaaccaagtttttctggctcctgaattatatttttataccaccacctaccagtacatttatattcaggtttctttggctatctcaccataaaatgctgccaccccatcttaatggttgaggagattcaactctcagttctaccataagcagtagcatgcaattttagctatagctctagaagtatccaagattatttagctcaatttcccagctctgtaggttaaattcattgtctttaatgtgtttcactctagctacccaatgcaaattatgtcactaagaacaaaggaatagtcactacttgtttgtttccaataattcttttttttttttcttttttttgagacggagtcttgctctgttgcccaggctggagtgcagcggcgcgatcttggctcactgcaatttctgcctcctgggttcacaccattctcctgcctcagcctcctgagtagctgggactacaggcgcccgccaccatgcccggctaatttttttgtctttttaatagagacggggtttcactgttttagccaggatggtctcgatctcctgaccttgtgatccgcccgccccagcctcccaaagtgctgggattacaggcgtgaaccaccgcgcccggcctccaataattctttattatatactgtgctgtattgaattaccttggattccattattttgccaaatcatttatttataaggtaaattcctagaagtaacatttctgggtcaaacgacgttagtaatattgataggtacaaaggctttttgttattgtttgttttcatttttattaaagttatgcatacaagcacatagatttaagaatcaaacaattctacaatttttttaaaaggataagaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctagcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccatctgtgtgggagcttctaatgtcttcctctttcagtgttggctccatcttggtggcaaacatccagtagtaactaactgcctgcaaggtgactttgggaaagctgcttaacaactccaaacctcagtcctctcatctcaccttaattgtgtcactacttttaagattagtcatagcctcttgacccagtggttaaagcagttgttttcaattggcagaatgcattagaagttctggggggcatttgttaaaaatgctggtgcccaggcccaccccagtgatcctgattcaatagctctgaaatagggtgtatctgaatattaaaaatacctggtggttattctgatgcaaagtcctgaagaatcactttttaagaagcaccagctcaaagatataaaacaaaaataacaagtcagcagtgattttcaaagccaacagtaaaagaagctttcaaaaatcccttcccagttctaaaatgtatacattgggggatgccagaaatatattgcttaagatttttgaaaagttccctaggaattttaaaaaaactaatttaataaagaataacacagtccataggtcattaacttcaaatcatgtattaggaagatggcgaagagctaaagtggcccatttttattattttctgaaagtggaaaagatgttgccaaaagcaaagaaaagaagacattatcttttgtaatcattgaaatagaatttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatattgtaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcatttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttggttttctgtcctcgtggtattttgctgagaatgatggtttccagcttcatccatgtccctgcaaaggacatgaactcatccttttttgtggctgcatagtattccatggtgtatatgtgccacattttctttatccagtctattattgatggacgtttgggttggctccaagtctttgctatggtgaatagtgccaaaataaacatacgtgtgcatgtgtctttgtagtagtgtgacttataatcctttgggtatatacccagtaatgggattgctgggtcaaatggtatttctagttctagatccttgaggaatcaccacactgtcttccacaatggttgtactaattcacactcccaccaacagtgtaaaagcgttcctatttcttcacatcctctccagcatctgttgtttcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatagtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagctatagcaggggctgcattaaagacataatatgtcatttgtctgtaatctgctctaatgctttggcatctggtcacatgtattacttaaaatcagacaaatacataaactcttcacatagcccagatagctcggtgatagcacctggtaaatgctaggggtatgtagccgggtattaacttgaattgcaatggaccagcagatatgaaaatgatttgggatattaccaaagcagttgttaaaatggaaataatattgctcttactgggaagaaaaaattgaaaacagtaaaaatgcagctacaaaaaaaattacaggcagaagcgctatagtattttagatttaacctgtgtaggcaactgacaaacactgataaagacagatggccatgacagcatataaaacagtcctcaggatgattcagtatacaaatgtgaacccatttaagctaataaagatcaataccaaccagaagttgatgatgcataacccaccctttattcttatgtctcattttaaaggttaacacatttcaaaatttatacatttaaagatgcttaacttttaagataggaattgatttggcttattttatgttaaagaaaactgtttcagctcacatcaataaaatataatacctaactagaattcatcaaaaacaggtttctactgcaacatttcaacaaactagatgatatgttttacgcttattaattactcaaatgctaaaacatctggactgtaaatttaatcttccaatgaaatagctacacaatacagttttttcactattaaatacattaggttattaccctgtttacctaaagttacctccataattaccaatagaattaaggttaagttgataaatttcatgagaatcccaaagtttgaaaactattttcacacaacacacacataattttattatcttatattattttttaaggccaagataattttaaagaacttgatacataataagccttaaatacatttgtcaaagagatgagagaaaaagaggaagggaaagaggtagagaggaagactggttgtagaagagacatgaataaaccatggctgcatttaaaaattcctctgaatgatttatgaattcattacagagatcaacttttttggttttttggttttttggtttttgtttttgagatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaatactttagaaattgagtgaggtatttagtatgctgaccattttataaggtccaaagagtatgctaatggagttccaggtgagaacaagaaatttttataatgatggccaattttcatctgggaccaccctcaatgcagaaggattggttgatgtcatgtctgccctaaactgaaactatttcacttgaatacaaatttagaaaaatatgttgataattcttcagcatattgcaagtaaatattaatttaaatattaaatgtataagtattaaattaaatattaatccagtctttctcaaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagacaaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccaaagtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgaactcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaaagtgttcagtatgaaaggccagtctgatccacagaataagggtaggagggctcttgctgtaacataggctgagctcctctgaactaacagggaaaatgtgatcaaatgctattgaatgaattccatactttaagaagacagaatactaagggccatgctctgagttcatagcagtagttatctcatatttaataattgacttggcttttaaatactgtcttaaaatatcttctgaattattatgtttaattcttaatttatcctggctttgtactgttagccaacttaattttaaatttcctgataacaaggagtaggtattatatggggcccatgtgtgttaagcctattatgacataaaatatgtaataggaagtcagtaaataggtgccgaataaagtaaacgtttaacagaatatggtccttatatggtccttattatggtccttgactctagaagtcaagaataaggtccttatactttagactttaaaatgcatttaaaatatgataaatgttaacttatacaaatcaacatatataaaatttgtcaacagtagacatgtatcaaaacatttgcaaataggatttattgatgaggaaaattttctgggaaaacatctaaattgctattttagaaggaaaatgattgtaatatataaaatggacatgttttttaaataatgcattttgagtaggagagggtacagaatctaatatcggggccaaacaattttctattcaacagtaattccttttacagtatttttgccatggcccttgtagctgattcttctccaacccctgctccaagtcactgtccagctcaacacgaccatacgaataaccagtacagtagatgaaaataaatcatgtagtctcagaaagtcttctatatttctgtctgcttagtcagtcaatgttgacaacattaatacatagtccagtattgttgtccctggtttcctttgaaatgctacaattttagaatcctattatttcagtgacatttattttcttaggggattggattagggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttatcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcctagagtgtatcagacggaaactgaaaaagtgaccatatcagacagcattttcagttttctagaaggcagaaaaacacaaaggggataatttgatggctgcttgccagaaagtagcaggacagaaattagagctatggaaatttgtaactgtcttaatcacctctggtgaaacacaacatccggcagaacataacaaatgagaccacgccatgtctgatagtaagttttagactgagggcacattgctgaaaggcaggtgttgttctgatcacctttgtactcactgttgcctgggctattgccatgttttcataagcctcagtagtgcatttggtttccatggagtccatccatgaactaaaagaacaaaacatctaatcccaaagcagaatacagatctcttgtagtttcattcacccttttaaacaatatcacagtaatttttagattcaaataatcattgagagaccctgtactagcagttagggacatgtcatctgggcattggctctattgaacaatatgatcttaaataaaccttttcagtgccttgggtctatggcccatctgtaaggtggacataatgctgcctggctaatctgcctttcattgttattataatacatatcaaattgcattgtagaataaaaatgtcaaacaagggccaatggaatactggtgacaaagttgaatagcactagtaactagaatcaagtcaattatcagctttcaaacataccgaatatcaagaaagtaccataaggccaggcacaatgactcatgcctgtaatcccagcactttgggaggctgaggcaggaagattccttaagcccaggagttccaggctgcagtgcactatgattgtgccactgcactccagctggggagacaaagcgagacccggtgtcaattacaaaaaaaaagtgtgccataataatctcataatgctttcacttcgtattcatgaagctagtaacataagcccccttgataatacagcctattacaaaatcaaagttggccccttctactttggaacaaatgtattttatgagtgctttggttggctaatgaatttctgtagaaagaattttacttttcagttttcttcattttgataaaggagattaccacatggaagaatgatattaaagataataattaaaactcaacaaaactcaaactttttttttttttttttggagacaaggtctcaccctgctacccaggctggagtgcagcagcacagtcatagctcactgtagcctctaactcctgggctcaagagatcctcctgcctcagcttcccaagtagctaggactacaggcaggagccaccatgtccggctaattatttcatttttgtaaagtcatggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcttgagtcagtctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgttttgatgtagagatctctgtgaaagctcattaaatcctcagtgtgtgaggcagggcttagggaaaaatagaaatagggataataagacaccatatccatccatactgacatatttgcaaagcattcattagttaaaatcctccaaggaaactccatgtgactcctcagcatattaaggacctgaatcagctcttctggttaaaccacagtccagattaacagttacatactggagagatacagttagtttttgttttgttttatttttcataataccacgaacaaacctattgcaaaagcaattcaaagcatggttcccataatgaagaaccagttgggtcctcttcaggaggaaagatagccccatataccatgaatatctaatacatctgaataaatgataataagtcattagatgacgggtgtatatgagaaaagccaaacttactaagttaggtccccactgcttttattttctggaagacattcataaggaaagatgtatcttcatgcttcagccaaaacccagatgggaataagaccttctattatacaggattccccagagaaacagaaccaatagtgagggggtcaggggaagaggcagttgggagagagggagaaagagagagaggctttatcttaaggaactggctcattcaattttagagtttggcaagtccaaaatttgcagagtagcccagtagactggagacccaggaaatacttgatgttcagtccaaaggcactctgctggcaaaattccctcttcttcaggggaggtcttttttctcttaaggcttctaactgattggataaagcccacctagtgacctcattgtaatttaattacttctttaaagacattgtctccaaatacaatctcattctggggtgctaagggttacaacttcaacatatgaatttaaggggacacaatttcacccataaaatacctcagtgggttttattatgatctagatattagaaagagagagagagacagagacagagacatggggaggttgataaatagcagatgtatttctcaaagcagtgattctcaaagtataggcccaggcccagaagtatcagtatcatgtgagaattggttagaaatgcaaattctcagcccctaccccaaatctgctgagtctgtaagtggggcccaggaatttgtgaataaaccttccttcctggtggttccaatgaaggctaaagtttgaaaacaactctcttagaagttgctttattaaaagaatgacgccacctaagaagttttccaacaaacatgggtgtaaatatcgtttaatctgtgtgttttcattaaatatatcaagataagtcatattttataagtgagccttggatctattttactcttataaattgaaaacaaagccagagctccaaggataagcaccacaacactgcaaagaaacttggcctctgagtacagatttcacagggtaaaagcaaaactgtgagtacccaataaagctaatatatcaaataccagagcagtctaattgctgtctgtctggttggaagcctccattaccttatgtaattcccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacactgagcaattataccagcaggccattgattgggaagttgatgtttgtctttttccacatgaacaagggcagtcccattgctggaagctagtgctctatcatttttaaataaacagaatgtttgtcattagcattttctaaagtattggagatatctgatctggatttgcttttatttcttcttgatcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctctttaccagtaaagcaaagggtttctcagaaatcccactcagactttccttagatcttattaactggagagtcaaagggccacttttatctaaaagactaaatgagaactaatgggacaagatcatcatggctggcttttaagtacaagaatgacaggaaagtaatggtttaaaaaaattaatatggaaatgaaagaggagaaagggagtcagtaagaccaagtggagcattgctaatataattctgtcataagaacaagaaggtctaggtaatggatcctcttatgatggcttagtttgtaatacctttcatgaaagaaaaaacattatggacaggtggtcagatacttcctaaacaacagtcacaagttgcactgcactgtggtgactggtatgtctgtagctgcaggttaagcactatctcaagcatagaggtgacccttggggcaagatagtgcctctgagcttctaagggttacatgttataggtctgatttccaccttattctatacactctctgaaacttccaaagattctgctacataaatcaacctcatgcccaagttggtggcagcagaaatgaaccttaacttagcccaaaagggtttgaagagaaccaagaaataaagctagaaccagatccagcactatcattattctcatgctactttttaaagtcttgtccacattagtcagtgatagaaaactgatgttaggaacactgagcacctaagtgtcactcactctgatctctagttgctgcttctgataaatttcaccaattagcacaggcttagagtcagattatctgggtttgaataccagttctgctacttgatagtggtgtaatcttggggaagtgcttaaattctctgtatttttcaataaaatattgatcacaatagcacctacctcacagaattgtagtgagaaagaaagtgagttaatatttgaaagtccttgaaaagtgtgtggcacatgtcagccctcccggaatgtctgctatttttattactgcagccattattattctggtgtagaggtgaactaccctgctttggaggtcataaagaccttgattcaaatcctgccattatcacttactatccctatggccctggacaagttaattcatggttctgagcctcagtttatttatctgttaaaaagggataataatgcttgtttcatcaagctatggcaagtattaagatggcatgtgacagtgcttagcacaggccctgacaaataagtaatttgtattcttttttatcctccatgatacactcttttctctgggtttatcactagaactcccccgggatgatctgttacttatgactaatcatactctgtgtacttataccactaatattatttgagtgaaacaaacttaaattcagcatcaggaactaccttgaaaggaaaatagactcataagagtagtctcttccagttttgagaagaaaagatgccatcctacaagtatggtaaaggtcttgatgagggaggtaagaccatgacagtaccaccatgccttcgtctcacttccccaccacaactgagtgatctagccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctgtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaaatcagtttatcctgggtattacacttgaatttaaagcaaatgtatgcacaggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccgtcttaataaagcaagcagttagttccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaaggtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaaggaaagaaagaaaaagtatcactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaaacagaacgacaataataacaacaaaataaagcaggttatacaagctcgtatgcatctcagatgaagaactttcctctagtaataggctccttttccctaaatgtatttactgaaggcctctgtattttaataagctatattttcactggttttaaaacttcattattttcaccattattcacatccatttaatgtgttacttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagcccgagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaaattagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaactcaccacccagaaataagtgcagttaattttatggtacatttttccaggttgattttcatatacacatgtgtatctatatacttctcttaatacaattgaaacatacaaagcacatcatttttaacctcttttttttttagcaatgatatattgaggcgtccttctgcaccaatattcttttcaacattgttttaaattgctatagatcatttcatgatatcattccacaatttaaccaacgtcctattgttggcatggcgagtctgtacaggtctgaaatgttacagtagatagctagtcagacatgaacagggcagtagaaagtttattaaaaagctttagagcagaaagaagtaaagtacacttggaagagggccacacaggtgacttgagagatcaagtccacagtttgaccttttgatttggggttttatacactggcatgcttcctgggtcttgtgtcccttctgccatgattcttcccttggggtgggctgtccgcatgcacagtggcccgccagtgcttaggaggagccagccacatgcagagtgtgtttactggagttgtatgcatgcttacttggggcactcttcccttaccagtcaagtgtccctataaggtaatataccagttaaactccaccatcttgcctcttagtttgcatgcttcagcccattcgcccaactcctgagatcttatcaggaagctgatcactagtctcaggtttttctatgtattgggagactactttccctggggctggctgcaaccaattattattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctctaacagcaaaatcaaaaattaaatattgaaccataactctcttttcctctataagcctaacagttcttttccatatatgtaaggaaggcaaatatgcattttttgtttacaatttaggctgggactgctacagtgactcacctggagtacaccccaatgaaaatttagtgggcaataacacagaacaccatgcccataaaattataaaacattattggggtttgcccatcctccaattgtcttgctgaagtctatttttcttcctctataggagaagctatttagagtcaagcatcattaaatcaaaatgcaaaggaaggagaaattgaatgtgggttaattgcattctgaatgcaactgaaccgcagttggtacaaattactggcctataagaatgcattgtgcctaccaggaagacaagtattttggtgaagccggagtatgggtgtgtaccaggaagtggcagcagatgaggattctgagtgtgtttgtgtgtgtgtatgtgtgtgtgttggcaggtggggacacattagatccttgtatgttgtactaagcagttggtactttgtcctgaagcatagctctcccaggagaattgcagctactgtccaggaggatcccagtctatgcaatttggcacactctgtgtaatcttctctcctttatcgcacaaagaagtcctatacctgcaatcttgctagagaagtaaaacctgtattccttatcagtagatctacagggtaataaagggaacactatgatgggagcagctgtaatggaattgaagacctctttcttcttggcatcaactgcctgaagataaaaggaatacaattaatataaataaagggcagaaaggcactgactctaaggcaatgaaattttgtaataggagtggaaagaaagcagagatgaatgagggctacaagaatcacaacaggctcctgggaggaggtgatacttgctgtccctgccagatgtaaagcataattttcagggtcctcaagaattaagtggcaataggactcaaaaaaccatttctccaaaaggaatatagtgatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataaccaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttaccacttaaacatttttgtatgatagcacataaatagctgcctacgattccctcgagtgaatggaccataatttattgatcattccccaacagtagacatgcagattatatgtagagtttttgccttcataaacaatactattttgaatccctttgtacaaagcttatacttaggcaagggaacctataacataattcctataagcagaattcctgactgaaagggaatatgcattttaaatgttaatagatgttgccaaaattaagccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggagttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatatttaattggttttaattagcttctcactaccttcatgatgaaattcgaattccttagaatgctctgcaagccctttcatgacaaggtccaggcctgcctctccaaatggcatcacttgtaaatggcatcatttaccctatgctccagcagtaataacactatgcattcacacaggggaggttttgtgggtgtcagtgctctccctgaactgtcatcatagtatccccccactcccaccccccacttcaacctggagaacctctaaagttgtgcttttctgtttttcttttgcatatcatgtcctgagaatcttgttaaaaagactttacttctgtgggcctaagatggggcccgatgttctgcatttctaatcagttcccaggcaatgctgggaacacatattgaagacaaagctgaaaaaccttactctaccgttactccctctgtgaaaaactctcctgcaaagctgatctacacaaagcgtcctctttctaatgtttatgacttgtatatagaacatgtacaggtcttcttagatgtctcatgtcttatttaattacttggttataggtctgtccctgtaatcacttgtccatcatcaagggctggaacagtgactgctgctccttgtagtcccagcgctaacatttggtccagatgtataggaatttcctagaagtattttgcatggaaattagcgaaaatttttcacttggtgcccgaatgatcatttcataaggtgttgttaaaaatgtccactggatggaaggttacactaactttttagctctcaaattcgtggtttttctttatgttattgacaatctctccaatggggttttggttagggggaggcttaaaagtaattgatttatgattcttttaaccaacatgtaagtcaagaggctggccaagagtttgaagagcccgaacctgttagacagtaaaccaattatctttgtgaccttgtgggtgacttcaccacccccactgcatagcacagccctgcctgtttccaaaacacctggccttgcacaaaagaatgaagaaagagccaaggcacagagaatattctccagcagagagtttgggcaagaagtcttaaagatgtctgagtagagagacaattagtggaaacaaacatctgtccaaggtctctcccatcatgtcatgaacttgacaagaaaggccagcagtaactcttccaaccgtggtaaccaatggccctgaaatgtgttcaatatcaggtatatcagagcccgagagataagagtggttttcaatgctgtatgcacgttagaatcacctgggaagtgatatttgtaaaatatgaacacctgaggccccaccccagaacagctaattcagaatttctgggggaatggccaaggggtcagtagattttaaaactcaggtgattatactgtgaagccagagttaacaaccactgatagagggtagtaccttcttcccctataggtgcctcagaagtgaacatctaacttcagcttacacatcccactaattgaccactgagtcttacttattttaggcaaaacgaaaccaatagaaagttttgccttttctctatgtagaagggactaatgattctataagaatttttaaatttctactcacatttcccatcacacagttgttgagaaattggtaagttgagaaaaaatgtgaggtgtagaaagaaggaaattgaattcatttagaaaagagaattccaaatgagcttaatttccttttttctaaatcttaataatctaccttgcttttcttctccttccactgcaccctttctccatgaattcatcagtcatagtggtaagctcacagtatccggcagcaggtcaggtgggatcacactggctaacaaaggatctgagggtacaatgcagaagttgccagataatgggattcaattacatttctaagcatagacttctccagtgttggctgttacactgcccaatgtggaaaagcactgctttatctacatggcaagtgcttcatacattttagttgaatctgactcggagtacctcaatttttttaatgaaatatttgaggtctacaatagtaagtataaataataatataatgaagactcttgtacctatcacactaaagaaataaaacctaacatctataatcaaaatagcctatgtcctctttatctcctttctctcattctctcctcagaggtaactgttaccttgaatttatgattcccaaccctgttttctcattttgtttgtcattccaatgtatgtttttatgacacacacagttttggttttgtatgttttcagccatataaatggcactttactgtatgtattttgtgcattttcaagctttatataaattgtatcatatatccttctgcaacttgactccatatttcattcttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccatgttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctctgacaaggaggaggtagggaaacagaaacaagtcagtctggaattaaaacactttttccagttcaaagtagcacaagagagatatgatgtgagtagagagtagtcttccaccattctaaagcagtggtttgtaatctaaatagaagggcattgcacactatcaaaaactatgcttatgtaaatgggagaaatactgagaagtaggaaaaagtattgcaaagtggtagtagcattgtttttcttctagaataaaagatatttactcctttgccttctcagttacattgttcctggttccctaaggaaaaaaaaagtgttcagcttcagaacatctcctagaatttctctcgtttaataccaagctaaagtcctgccacttccagagttccacagtgggaatgcaaccttcacaaagatgctttcctttaaacaaagcagatgtgaaattgagccatgcttaaagatttgacatggctgctttaggagggaatttattgttagtactttcaaagtagacctaaaaacaccactctgctttttttattcctgaactggattttaagatcgtattgctttaaaataaatgaatgaataaataataacattttattttggggaggaggaagtagaaaaataaatatgaattgttttggaattgattgctattttgagttattaaattgttttcccatccattgtggtagatgaaacttcctccaaatgagatctgctgctttttcattactgtcttgaactcttttatatgctggtgtgttttataaatttctaaggtgcgccatttagagagtctgtgcttctgaactgtttgaccatagtttccttgttcaaggaacacctcactggagttcaaaggtcacactttggaaaaatgctagcatagctattctaaaggtggctacaccatcattactaaccattctggccagaaattcacaagacccaattatatgtcatcttgactgaaattctttcatgatagaatatctgtcttgacatgttggttggtatacatattgctcttgcattgaatgctgttatggagacatttgaagccagtctaatttttgctttatccaatgtgacactttttttgtttttttgttttctgttttttttttttattgttggtggtggtgggtgtttttgtttgtttgtttgttttctcaaattcccaaggaatgtctttatacttgaattgtaagtattcaatcagggctgtgttaagcattctgttaccagtatttcctagaacatggtatgttctttcaatctataaatgtggttattctttctctttagtgaaatttccttgtgtggtatttgtgaatacttttcctgttccatttattgaaacttctccttcagggacatcaatttcctcatgttaagtgcttttgaactccaatctgtcaccttctaattcctttggttcccttgtatttacaagccattcctcgaggccggtaattttatttgcagccatgtttattttgttccttgctctgtcaccttttaaaaattcactctataatattgtttttgtactcagcctccttagttctgtaaccttcctggggttctgtcaactcatctttgagctcttgtttttctgagttcatgttctcattaacttgattcatagtacaaagcacttctgaggaattttgttttgttctttggactatgttttctttaaaagagggagtttcatctttcttttgcatgctatgttcctttcttttaaggttgattggttttgtttattttcatttgggagcattgccttagcatgtttggatgtttgtcactgatttcccccatcttactcatacctgaacgctttatctggatcttctctgttctatctagtataggtgacttattgactcaatttccatagactctaacttttttccccaaagctatggttaaagaacttgattttggataccatccacttaactgcagcctaaggaaatggtgcagggagtagagagggaagggaaagctctgctgaagctgtgtgacatctgagttagaactcctgggctctgcacttttggttgctcgtgctctctctctctctctctctgggatttgttagatactttgaactacattttaatccctctctttaatcagaatacatatccatcctgaaggggaacactctaggattttttaaaatcattcagcaaatttttattgagcccctctcctttgcaaggcacattctaatctaggtgctggaagtaagctgtgtgaacaaatgagacgattcccctttctaatgagtttatatgcaatgtggtatctttaccgatacatgctctgtcagaaagaagcagcccacttctgtccaatagccaatccactacccttcagacaaaaatgagaaaaataaggatagtcatttagttagtttctctccagatctgaagactatagtgaggtcttgagagttcagtaattcaccagtaaggttccaggggcaggaagggagttcagggttagaagctacactgtaccactccaagatctgttcttttgtgagccagcattgtatgtgtgtgtgtctgtgcgcccacacatgtgtgcacacgtgcatgcatgctttgttttgttttaatgtccatattattaggttacagtcttttccttatttcattgctgacttattactagaaaggagggagctagtggttttcattgttggtatcccttgtttttagttctgagagaaagagaaagagagagactctataatctgctttcattctatcacctgagcctggaggcctcaactagttcttttaactctaattaagccttagagtctgcaagtataagacagctgtgaagtagctctgccctcagaattttgtaagtactttaagacatagacaaacacacatacacacaacaaaacaaaacaaaaacataaagctgaggtggtttggttgggttccttgccagcttagcctcttactcttggctaaaaaacatttcaaggacttaaactgtggaatagttctaagaaattgcttagtcttatccctggacactgcaaaatggattgcctcagatctaagaaacccatttatcagaaaaattcttcaatttcatgatatgttatggtcgagatgttattgcacaatcccacagaaatctagtccctctcctaaatatgccgaacacctatacagatggaggcaagcagagagaggaaggtgagagtgaacacttgttcctgaaatctcccaagataccggctctgggttagcattagaaggcctaagcacctggatctattaacctaaatagaaaaaagaaataaccaaatacttgttgaaataaccaacaagtatttggttatttcttttttctatttaggttaatagatggagcattacctaaaaatgagatgaagcatcacctacaaatgtccctcaaacaagtcatacttagttcagattataaagagagtatttgataaatgctgtacgtataagggaattcgaatggcactagcttacagcttcttgtgtcactaccatgcctctaatgcaatttcccccatctagaaatgtaaccctcagccagttgccttgaaagctggttaccgtggagatgattatcagtattatgatgacctatttagaagaatttctgcatcaccagaaaacaaataaccacagagagagcctttcaaatgaatcatgctctttctctgaaagtgcctttacaaacaaatgccatggatgtattgtgtttgtgtgctgtgtgtggatttgttcattatttgtatttgcaaaggttttagtgaaattccagttgtctttaggcatgccaagagtagagagggtagtacaaacaacaggcataagcatatagacatctgtcctcttcctacaatttgaaatgcatggccatggctgtattgatttctcagcaatgttaacatttctttcatttgtacagtttttcttgctcatccactgctttttgaggctttttaaggactgctggaatgtggttggcaggtggttggtaaagactggtttttacaaactgattggccattaatagttcctaaacacactatgactacttgatgactattttgattttctcaaaattatgtcatgaaatattctcttaacttctgtttggtctcccatttttctataaaatagttttgtgtgtgattgtatgcagacctagtgttttgttttttttttaagtttttaaatttgttatccattaatcattgccctgctccttataggaaagactgattttcagctgctgccctttttggttttgttttgcttttgatttttcttcttctttttttttttttttttttgagacatttaatttgcacttgtaaaaatttcagtgataaaaattaaacctttattatgttcatagaagcagcaaataacaatataagccaaatgttaccccaaagaggtcaaacagatctaatattttccttccagtctatgaaggtcgtgtattatggcatttttatatttgttcttattgtattttcaggcacactcctttttctactctcatccttccacccactgtcacttcttctaaggtaatggcaggaatgttcatattttctgctgttatttcatatcatctagcaaagtgctggataatcgatgtttaataaacctgacccctcatataacctcaaaagtttcaaaagttctttaaccagataaactccatttttgtctgttcatgttcacaatggccttccagtctaggaatctccattttttaaaccatgtacaggcagtctgttttccacagaacattttgggtttaagtcaattaactaattttggccccattttcaatttctataccatagacttgtccttatgcccaaaatcacattgctctgaactgagggcaaatatcaaattcatattaatcacctcactaatattcttaggctggtctgaatgctatgtaaatcccaataaaaatcttagtgtgaaaaaattttcttcaactaaatataactccttctctttcaatattttttagaagtacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccagacttggagtcctaatcacccagaatagttccagacaagattcagaatcagaactctgactctgcccaacaattccactaaattaattcactctgcactctcttgaatggatttggaaggcaaatcatgagcttgctttagagtatttcctctttgtctaatcttcactcctagaaatgatagtgcttagcatttagcacttgcaatccttcccaccctgaagctaaactgggaagaatgagagcagagtgttctaaccttattcataccacaggcaattattcaaggaaaaaaaaaacatatttcacagcctttaattagataaacttgctttgtgaatagaacacaatcttcagaagaatgatgtggaataacttttctccagaaacattccatggctttattccctcttctctaagaaaattcatgtccttaactgctagctatccaaagcaaatgattaacaccccatgtgtcttgcaatattgtatgatagcgataatctaatattgataacctgcagaactgctcactccaggaagctatcaaaaaaatgataagccaagtgaaaaaagtacagccacacaacagaatgttaatatttatgtttctaataacattttttaaaaggtttctaattaatgtaaatatattatgatatggtttggctgtgtccccacctaaaatctcatcttgaattccagtccccataatccccacatgtcaagggtgggaccaggtgaaggtaattgaatcattgggggagtttcccccatgctgtcctcatgacagtgagtgagtctcaagatatctgacggttttataagcatctggcatttcccctgcttacaattctccttcctgccaccgtgtgaagaaggacgtatttgcttccccttctgccatgattgtaagtttcctgaggcctccctaagccatgctgaactgtcaattaaacttctttcctttataaattacccagtctcaggtatgtcttcattagcagtgtgaaaacagactaatacatattaactcactacagttattccagctaataatttttgtcatgttctatccaatctggaacagtacctgttagggtattcctgatgagaagctcagggagggcactgctggataaatcagctgtttacaagtttcattcaccattatgttagtgttcagtgagtaaattatgccatttaagatttccagggacaattcttatgggcctgtgcccaagaagtccccataaggtttagcgccctcactccaacatgctaagagaataaaccaaaaaccatgtattcattaaagaagtgatcattgaggacccactgtgtgccatcaggttctcagctagtgctaaagatatggtgggaagaaaacaataaaaacggaaatggttcctgtcttttgaggcttagagattaggagggaaaaagacatttataagtcacacaaatagaaagaatgaattggcattttataagaattatgaaagtaaactctgctttagaatgaggagtcaaaggagtttccgtgaataaatgatgttggagctgagcttaattgaagaggtatgggaaagggacatgaggaggaggcatcccaggcatgaggcatgaggagtggaacacattcaaagggctaaaaggtcactgaggctggagtggaggcagcaagtgggagcgtcctgagagaagaaactggagaggtagagcaggagccagatcattcaggctctatttgtctagctcagacatgtctgcatttaacttatggtataattactggattaaaaacaatataaggagttatacaatgttttaatccttctttacacaatgtgtataatctaagttgataatgcttatgaatgttgaattacaatgaatgttcaaagtcacaggacttctgtgataactaatattaactgtgtgactgtggagtgataacttttagtcttaagtacctcatctgtaaaatggaggtcatagtacctacctctcagggtagccactaagtcttcatagataaattggaaagactggatggtacagtgcctggtcaaagccttttaaaaattagaagaaatatgcagcacagcccttatacctgggaaagaatgaaccctatcctggaacccagagtttagagggccctattctggttctcgcctagctacactctcaaagggtggagagtcttcaagtccaacagaatacactcacctggaggccacactgaactctgtattctagatgatgctctggatacctgagaccccaaagtttcctaccaaaatgatcccatgatgattcacgaggcctttaagtgtcttttccccaagcatgcaccatctgaagacagatgcataccccatgtctgaggggtggctagggagcagtggtgaatagcacttgtacatacaggcagagtgtcctcaaatgtatatgtgaaacttcttgcaatgcacgttgtagcttagtgtgagaagaggagggggacgggacagggccagaaataaactttacccacactaccaggttctattgtgggaccacagtctgagaattataaatgtaaagctggattctctggtcattattaacatttatttgtcaagatatgagaacagaaaatacctattgccttagtccacttgcattgctataaaggaatacctgaggctgggtaatttataaagaaaagtggtttatttggctcatggttctataggctggacaagaagcatagtgccagcatctgcttctgctgaggacctcaggaagcttccaattgtagtagaagaaagggagcaggaatcacacaacaagagaaggtgcaagagagagagtgggaggaaagtgccaggctctttttaaaactcaaatttcttgggaactgatagagcaagaactcactcattaccataggatgacaccaagtcattcatgagggatccacccccatgaccccatgaccaaaacacctcccactgggacccacctccagcattggggattaaatttcaatatgaaatttggaggggacaaatatccaaactatatcacatatgttaacagttggattttttgtttttgtttttgaaacggagtctcgctctgttgcccaggctggagtgcagtggtgtgatcttggctcactgcaacctccacctcctaggttcaagcgattctcctgcctcagcctcccacatagctggaactacaggcaccagccaccacgcctggcaaatttttgtatttttattagagagatggggtttcaccatgttgaccaggctggtcttgaacttctggcctcaagtgatacgcccgtctcggcctcccaaactgtggggattacagaccactatgcccagcctggatttttattatgatttttttgtttgtttgtttttgttttttgagctggagtctcactctgtcacccaggatggagtgcagtgacgcgatctcggctcactgcaagctccgcctcccgggttcacgccattctcctgcctcagcctcccgagtagctgggactacaggcacccaccaccacgccctgctaatttttttgtacttttagtagagacggggtttcaccgtgttagccaggatggtcttcatctcctgacctcgtggatttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccactatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaatttaaatataacttttttaggaattgatgtcttctcttcccaactgaactataagttctttgaagaacaaattggaatctgctgttttctgtatgccttcattctcttgcagcccctaagagttgcttaggaaagccgggcatggtggctcatgcctgtaatcccaggactttgggaggctgaggcaggaggatcacttgagttcaagagtttaagaccagcctaggcaacatagcaagatctcatctgtactaaaaatcaaaagaattagccaggtgttgtggtgtgcacctgtagtcccagctacttgggaggctgaggtgggaggatcacttgagcccggaggttgaggcagcagtgagccatgattgtgccactgcactccagcctgggcaacagagcaagactcttgtctcaagactaaacaaaacaacaacaacaaaagagacgctcagtaggtatttatacttaactggttcattcaggtatctagcaaatattgactggattcccaccatgtgccaggctctgtgtcaagcatggggatacagagttgaacaagacactggctgaaagataaatacctggcacataacagacactcagtgagtgagtgaataaatgaatgaatgaattctgtaccacaaagttaagagaaaatatcaagaaaactggaatcaccatttaagttgtcttacatccgaagttatcaaggtgaaagatgtcagcctggcagaatgcccacaattctagaaaatctggggaaaacaagacagtcctagcatttgttcctctggatcatctccatgactatttagtatgtggtgctagaatcttgcaaagaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggattacaggcatgagccaccatgactggcccttgagccaccatgcctggccccatagtttatttttattttctccttctaatattgtaagaaaactagattaccaaggtagaagttgatctctccctcaaagctatttatctccttgatgtgcagtatgcaaactgattttaaacagaattttgcagctttatgaaagagaatcacatttggtcatcaatgaattaaaatgaaatatctctctggaaggataaggaaaatcaacattcaaatataaaaatttaataataaaccaactaacatgttcaaggtttctctttttaaaaaagggcctacattattaatactataaaatttcaaaccagatattatagatcttaaaaaaattgtcattttttctttttttttttaattattatactttaagttctagggtacatgtgcacaacctgcaggtttgttacatatgtatacatgtgccatgttggtttgctgcacccattaactcgtcatttacattaggtatttttcctaatgctatccctccccctgccccccaaccccacaagaggccccggtgtgtgatgttccccttcctgtgtccgtgtgttctcattgttcaattcccacctatgagtgagaacatgcggtttttggttttctgtccttgaacattatcactttttctaatgggagaaaacaactgcattgttcatcctcttccaagtccataggctcaacaaagtcacttaaggttaggaagggggtagcacagggaaagaaactcccttaaaaaaataagtttcttttcttttttttccagagggagtcttgttctgtcacccaggctggagtgcagtggcacaatctcagctcactgcaacctccacctcccaggttcaagcaattctcctgggccagcctcctgagtagctgggattacaggcgtgtacaaccacacccggctaatttttgtattcttagtagagacagagtttcaccatgttggccaggctggtttcgaactcttgacctcatgatccgcccatctcggcctcccaaagtgctgggattacaggtgtgagccaccatgcccagccctattttcttttttaagcagagaaagaagcactgagacgttttcagctaagaaaacttagaagcattacccaaccccctaggaaatatactcaaaaactttgaaaagtactagaaatagttcaaaatgaggaaatgagagtgatttttttcactttttagaagcatttccaggtctccctcagttatcctaagattatctcagtccatacactgcctaattcttagatggcagaatgtttaaaaaacatgcagatatcttaaagcaagtgcgttcaaggaatagagagttaatgaaagtaaaattgattctggccaaaccaattgtagaactgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgccccacctgagaattctttctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcataatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaattatttgtatagtattaaatgattggcttactgatgaactaaggcttaataagtgaacaagaaaacttgcagttggcaaagaaactctgaatgttaaatttattatggtttaactctgtctctgttactactggaccacttatacaagtgcctgatggctcattcctagggatttgatctaatgtgggaggaagatgtctctctgcaaataagtgcaggcacacacaagtttaggcagagatggtgttctagtgactctaggttgagaaactataaatattggttggttgccgcccaccttccatcctgccttcttttaggtagagacttctggcttctgcttgaggaaccaccctatcctactctagccttgtgcttagaataaaattgagcttacccccaattccaaaggtaggtctacctggccttcctaatgatttaaagatagacacataactcaacctagctcatcacattcttttagacacagggattaatatagaataagcatttcatctatgttagtccaatcagaatacacttaggacttgccctgggaattctggatgtagactgtcttttcccttgggtggtatagtgtgatgatataagacttgtagctggtgcagtcatttgcatccataagaggaaagcctagaatggctggaaagcaatggctgggaccttgctgatactgttggatttatgttagatagggaacagaccaaactgctgtaacaaagagattctaaaatacagggactgaaaaagataaaatttcctttttagattctttttttgtcttttgttttccttttagtggagaatggggtcttgctatattgcccaggcagatctcgaacttctgggctcaagctatcctcccacctctgcctccctaagagctgggactacaggagtgagccactgcaccctgctaaactttttattttccttacgtctctgtctatctacctcataactatatggctggccaagagtgataggcagtttggggtcatggggtcagttagggacccaggatcttcctatcttgttgttctgctgtcctgctagggtattgtcttcatgttgcaaagccagtgatgcttcaccaccctcccatcacagccttgtttcagttacaagaaaaaagaaaggaatagtggagggcaagaagcttcttctaatgcagggcttatcaatctaagctctattgacattttgggcctggtaattattttctgtttggggttgtcttgtatattgtatgtttagcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgaattttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcaggcatcttgcattatttggctttgaactgctactttctagttctcattgtaaatacaaaaagcgtttagtggctcccttatatctcacacaaaaggatcattgcttacagccagctgtttggcaattatatttctatgaagttagcataatttgagattagaactgcctgagaagaggggggtggtgataacattctagtgtattgaagtagggtatggaatagtgatggtggaagctctgattttagaagtgaatggcctttccaaagttcatctcgaagccaacagttctgaattcaaaacatattttgccataggaatcttatttttttaagttattagattagcacaggagtcctccaataccagaaaagaaagagacatgtactttacggtagtacagaagaaaatgctgcagggcaaaggaagatttgtctgaaggttcagactgaggaaatcattagtaaaatcttcagggaagtggtgacttttaaactaagctttagatgaggaaagagagaaagggcctttcagggtgaaggacggccagttcaaagacacagtatttaaaattctccatgaggaatagtaagtgcctaccatgagtacagcataaggtttatggagatatgacaataagttaggacggggctgtgaatgtatggtggagtttggatttttttagtccacaagccactaaagagttttaatgaggaggatagtatgatcaaatatagctttaataattacatgaagaatgctttgaaattgaggacattactgcaagagaattggatttctgatcttgagacatggcagtgggttagaaagagagaaatcaccagagaaacaacgtgaaggtaaattggcatgggaggtagagaagaaagaatcaaatatggctccaaatttttaggtctacgaggttggaatcatggcacaaggataggcttaaaaggaaaggaatgagctcagtaggtatctgtctgcaggataagagaagagttaaggtggtcatggccttatcgtatagcatatgggctacatttacatttctgcaaagcttgcccattggggtccctataattggagaaaaatcacttactgaattttgtacctagttccagtcttcctccaagtttactttatattatttgtttgggatatagctccacatgttgaaactgtgcctctaacaccagtgttggtgaagacattgcattccagtgccagattctgtggtcagaaattttgtttaacagaggtagcaataatattggaagcataggttgcattgtagagtgtctgagaaaaggggtgcagagaaaaatcctatcaaacatgtgttaaaataatgtcaaatctgatatactcataaaaacatgcccttgaacatcttggggcagaggaagggatgggagagaataaaggaggatcatctcatgctcaaagagagaaaaagaagagagcaaaggagagtttcgcaggaagggtactgtggaaacgccagcaaaggtgggatcaggaattatctggaaaagagagaatttctggggtgtcttttgatccacatcctacttccttatttctattccatccaggcagttgaagtcatcaaaccaaccaagcctttgtatagcatggtaggtgatggagaaggacagtaattggaacagtaaggaaacagaggcatatctcatatgccatatatgcctgtatatcatatatcatctcctcttactccctggccaaaaaaaagatggcagattcattgtatccaggatatactgatggaggcaagtaggatggaatgccatgcctgaaggactaggtggaggtgatagttcatgccacctagagctagatattggagcatcagggctagatcaacgtgctaggtactgattgctggaaggaacccttcagaaatgaaactcctaccaattaatatgagagatctatgtttcactcaaagtttatgccagaataggactaaatgaacaaaaaagaatggcaccaggccgcaggtgtctgccccatgaattgtattcagaaggggctgcccatttggcagagttgtagaattgctagttcatctttagagttgctcatagactggagctgatcaagtaattacaaaaccagtcaaacaaggtctatatcctcttccttgaaaatagctagtgagaccaaagtagtcatctggtcaccatgctaggatcctctgcttccctctcacatggcatagtcagtgttctaggtctccactgtcttggagctgaggaacaatttgatttgatttggtaagtcatatccccgtagctttaacacagtgacttcctattcctcattctgaataggaaagagtttggggtgcagggtagttttacagctaagtggaaaccagaaagaagaaaacagacagtatagagttttctcagagtagaaaggagtcacgagaaaaagtaagggaagaggtatggatattacctcactccaacaaccaatacatactaccacatctctaacaaaaataaacctcaagcctgagggattccttttctctaattcctcattttcagcagaataaggaaagtagatacttcaggcataatatgcctaagtgtatcaacattagctggcctcagaatctggaaagaagctcagtaaatcagttttgatttacactatcctacagcctcagtaataagattccacctggaactctgagtttaacttttcagctgtgtgtaatttgatctattgatgtcaggaacaggagcaaactgtacaggatgttgaatcagtttcccatctcacgctgcgagaccacctcatataggtggtaatgaaagaaatgttccctttgtcttttatctcatacatgatgacattcttcaaaatgaaccagttgtttagagcgggtatgcttctttccagaaataaattggtactgggatagcttggcttacttgtgcagcaaatgggaagactctttcccatttgctaatggtggttaccaattcagcaaagtgagttgaaggagagtctgattcacagatgctgacttagatgttagccctctcataaaaccatagtaataattaacaatgaaatgtgccagccacactttgaatcactttccatgtggtaactcaatttaattttaacaactttatgagctaggcattatcattttcactactttacagttgagggagttatgccacaaagaggtgaaataacttctccaagaccacacagctagaaaaaagcagagccaagatccaagttaggttggctctagagtctgtacttgtaaacactgtactaaattgtctctctgacatatcacaaagagcagcaggtttggagtcaggatagactggcttgaattctttaaaaaaaaaaaaaatcagcctttctggctgggcacaatggctcacttctgtaatcccagcattttaagagtccaagacaggtggatcacctgaggtcaggagctcaagaccagcctggccaacatggtgaaaccccgtctctactaaaaatacaaaaattagctgggcatgtgcctgtaatcccagctacttgggaggctgaggagggagaatcgcttgaacctgggaggcagaggttgcagtgagccaagactgtgccactgcactccagcctgggtgaaagagcgagactccatctcaaaaaaagagagagagagactcaactacttttttaagataagttaaacaaaagaagtgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaattgtattcttaaagcacaaatgtgactcataggcaggtgtatttccatttagagaactcaaccagtagctgaggatataggagcaaggtctagatctcagaaaaagttacgaacaagctaagcaagagattagggatatcgctaaagggacccaagttcaggacgagacttcaatacagtgaaagaactagaagacacttagttccttggcaatcaagactggagaaaatggagactcaatctaagacttcagattgttgggctaagaagatgctcaaatgtgcccatcccaggtacataacatatagtctaggcttatcgaggcacaaaagctgataaagaaccctaagtttcttccagcttttgttttgactaagttgggaattttgcctgcaacgtaagtgctttggtacctgtatcagggtcaatctgcgaaggcaaagaccgagacttcccgtttatagcagttccaaacctgctccgctttcagccctgttttgttgttgttgttgttgttgttgctgctgctgctgttgttgttgttgttgtgagattctgcctctgttgcccaggctggagtgcagtggtgtgatcttggctcactgcaacctccgtctccctggttcaagcaattctcctgcctcacctttggagtagctgggatcacaggtgtgcaccaccacgcctggctaatttttgtatttttggtagagatggggtctcaccatgttagtcaggctggtctcaaactcctaacctcaggtgatctacctgcctcggcctcccaaagcgctgggattacaggtatgagccactgcacccagcccccaaccctctgttctcttttttatgtatcatgaaatagtagaatacatctgagtcatcagaactgacagcctctgcttacaaaagcaacagatcagcaggtcctaagttaacgctttgacctcaccgtctacctctcttccccctgccttcattgtttctcaaacatgcagaaggaggtgcaacttagggcctttgcaggtactgctccttctggctggtacaagcatcaccatacagccaaatgactggttctttcttgtctttcagttcttggctaaaatgttgccttctcaatgaggactttcctgatcaaccttttttaaattaccctattctccccaaggcattaataacatcatgtcagagctcttagcaaaatctgaaactatcttgttgggttttaatttgcttactgaaatggcagatgtgcaaggttttttcttatcacttattgtgttaaatgaatcaagatactcagagtgcttctcttgagaaaacctatgcctcacttaggttgacaaagtttcaacacatgaacacaggaggcatatatagtatatacatgtatttcatcagtcccaaagaacaactggcgacatgactagctttataaaattgcaaggcgttggatgggggagctagggaactttacaaaacacacaaggtctctgaaccaaaaatcaacattggctgtgaacagtaacatggattatcagtgacattttttgcttccatttacaactgtttacagtggatttttttttaactgaccaactctttagtttgtggagttggttttacatctctaggcctggtttttaaagatattcttaattttgatgaaaatcttcattatgatctcctggactggatgtaacatttaaaaaaatctcctaacaacatatatcctagtaatgcagtctctggggtagtgggaaaaagtcaggactgggagtcacaagacccaggctgaggccctaaataagttccacttattcaacaaaaattgaatatgtgccaggcactgttttagcaaattcaaatagtgaatatgacagacaaagtgtctgtcccttaggaattatgttctactggggatagggagagggtgataaaaatacccttttttcatctgcagttttctcttctaaaaataggtgggcattagactagatcatctggaaagtttctcctagctctacatgttccgagagagaggaaagaaaatttgaaaggcttcgcagtagttattttagggaagtaaaatcctagatttaaatttttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctcttttcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaagacagggatagtctgttgtgttgaggctatattcctagggcctaacagtgcctgtcacatcatagatactcaactaatattgatggagtaaatgaataaatgaatgaatgaaatggctcctttgtcctctctctgttaagtgttttattcccatacagtgttgtgctgcaggcaagccctttgccagctcacaagagtgaacggttaatttttcagggattttgcaagccaattgttaagcttagtggcttgacattggccttggttggggtatatatataccatagacatagggaaatgctgcatgttaagactttttattcccacaaagagctggtttaccagcatacctctactctcatcttctaaatcaaactataaatattgagctatcatgcaaaatcatgcccataggttatttaaaatatttcaataaaaaagtattgaatttaaaaaatattaaatacatgctatataattatttacctgtgggaaatagttcttttataagctaacttataatctaaaatatgtgtctctgatctcctaaagtttgtttcctgtttttcattcagatccttatgtgaagattcatctgatgcagaatggtaagaggctgaagaagaaaaagacaacaattaaaaagaacacacttaacccctactacaatgagtcattcagctttgaagtaccttttgaacaaatccaggtaatgtcaaacataactttgtcttcccactcaatttcattccttcagaccacataaattatacacacagaccttgtaagttatcagtgcacatgccttcattagaactgccattctttctccccatgcacatttgatgcttgagctacatcaggaaggataaaatatacagcacaggatgtgctgactcatcagcccaaaacagctggcactgtgttgagcagaaataaagtaggaaaaagaaaatcaacagaacaactctgctaactcaaaaagtgcatctataaaagttaaaaagcccagagaaaactatgagctttcactatttactcccaggccataaataagtctccccatgagatctttagagcaaaaaatagtgataagagaaatatttttggttgatgctaaatatgcagcatattgagtctttattaaaagatgattaacaatagaaaaattaggctaagttgtgttttcaattatttaaatccagcttcctgtgtctgagttggaatggatggctattttattaaaaatggagccttaatatgccagacaataattatgaagggaaatattctattaaatatccttgtagttaatatgttcatattaagttgctatatgtagccacaatgataacatgcaatcttatcatttaggggtttttgaaaatatttacattttctcaccccatctccatagttagcctataagaatctaaagataatatccaataattttgggccatttcttgcaaatctttaatgggcatcagagagtcaaactgcataaagcaacactatttttacattttattaaataattggcgcaggtgtatattttcagtgatacacaagtttgcccataacttgaaggaaaaacaaagagcagacatcaaacctacaacaaagaaccttctaaaggtccagaataacaaatactctttatttattttattttatttattttaattgccaaatagtagttgtacatattcatggggcacatagtaatgttttcatatatataatgtattgtaatcaaatcagagtagttagcatatttatcatctcaaacatttatcatttgtttgtcttgggaacagtcaatatcctacttgtagctatttgaaattatatcatatgttattgttaactatagccatcctgtagtggtacagaacactagaattcattcctcctatgtagctgtgattttatatccttaaacaaatctctccctaccttccccttcccagtctttagtatcctttgttctaccttttatttctatgatatcaacttttctttagcttccacatgagtaagaacatacagtgtttactttctgttcctggcttatttcacttaacataatgtctgccagttccatccattgccacaaatgacaggattcattcttttttatggccgaatagtattccattgtgtatatgtaccacattttatttatccattcatctgttgttggacacctaggttaattctgtatgttggctgttgtgaatagtgccataccactcttaatatgccaaattgtgtcttcatttacctttaatctattcttagaagacagtatcttatgaattaatcacagctttattccaagaagaaagctaatataatagctacacttattttatatatataaaatatatattttatatatataataagtatagctatataatatatacatatataaaataagtatagctattatgttagctttcttcatggaaacattaatccaaagacatatatatatatatatatatatatatatatatatatatatatattatgcctaggtccaagttaaccactttatgtatgtaatctcatttcatacttagaagaactttatgagaaaagtactattgttattatcctaattttatatgtgaaaaaactgaggcttagaatttctttacatgtaaaataagaatgataacagtccttgtcaaagtgacattatgcatataaaagcacttggaacagcgcccaatacataggaacacacagtaaatggtcctgtcatcatcatcattattattcacatgctaatgtcctctctttttcaagttaacattttattagaaaatagatctaacaataagattaaatcagtatataaatcagtgctgtctaatagaactttgtgatgattgaaatattctatcatccatgctgtccaataatatgatagccacagctggccaatgagcacctcagtcactaatttgaccaaggaacgttatttaacttccatgtatttaaatttaaattgatatagctagatgtggctggtagctactctgtagtatagggcagtcttaaatgaccaaaaataaccaataactctaccatctttgtattggttgatagttttaaatacaacctttatcatataaattttcacatggtgtcaaattatacatacttatttactttcaacatctgttacataagtaaatgcagaggacactggttccctgttcccaataactttttcactagcctgaaccagcgggccccctgctttggacccactcacaaaccctcaagacatcaattttttccaacgatttattttgcaatatttattcagtgaacttttttgagttctaagaccttattcctatggaaactaacacctcctggcatttaatttttttaattccacaaaataaatataaagcaaggcattgagatgaaaactcccattgagctacaattctatgcctttaaaataaatatccttttcaactacaaactgcagaaaatgcaggtatattgaaagtgaagcacattaaaaataagacacatgctaggtttctggggcagcatttcagaggcaatagcgttttgtcaggacagacagaaactatgcccaatatagaatacattagacatggaaataatgagcattcctttgactgtatccctctttctctgctccttgagtcactttgttcttttttttttcctttttttataggaggcaacttttctagtcttcacctttttctagaaaaaaataattgagtatttcacatgctaaaatagggtcttaagtttgccttatcctgaggttataagacaatctgcctgtccttctgtctttctctatccctatgaaatgtattatgaaagaagcaaaatatgctaatttccaaatgcatgtgagaatgtaagcccttctcccccaaatgtagaaataaactacatatgcagctggaaacattaatccaaaggcttcacaaggatattttgtcttgaatgctactaatcaatgcattcctaagtggaataatcaaactctaaaaacttctgttacctttgtgtgtcatgtcccccaccccattcattacaatatgattgcttcctgataaatttgcttagaacaagctctaagaatcagtatagccctcttctttgttccagaaactatccagtggatagttaattcctttcacaatggaatcactccaagggaagattgtccgttttattgacaatgtgttgcatttcacattctaaattccacttgcagaagtgattgttttctctgctctgaagctgtatatcaatgacatttctcatttcattaatataataaaccagtctccagcatataaagtccactaaagggccctaactcagctggttcttaatctggccctagcttttataattacattttctgctactttcaactctggcaataaatgttacatattccatttattttaaactcttacctttacactcagctgctagattgaaaccatcacatattctgctaagtaaattcattacttaggaagtagaactgaaatttgcttttaaaaagtatatattttataccataatggtataggtttgctttcatcagttcaatcattcagaaaaggaagtcatcaaataaactttcaaaatctgatggaatcattgaataaatcccgtgtagcctaaactgatatttccatttgatatcaatgccagatacattgtagttactcagtaaatgtttactaagagaacgtatggatgagaaaaaaatatctttattactactttttaaccatacttttcactatactatcatgttttatgctcacaatcatatgattagttgaaattctatattaattctatattaatttttttgtaacatgctgtccccccacccttaaaatcagattattgcacatggttgccttgggaattgtaatcaaatagagtgggctgaacaccaatgccagaactttcactgataagacaactgaagcaaatgaatttagaggttagcacaagttgacacagactccatggcatggaggttcacagcataggctctgaaaaccaaacaactcattccttaaacaacctcagacaggttatataacttctcagagcttcaagcatccttacctgtataatggcaatattaataggatctattatgagaagtaactgagttcattcatgtaaaagacttagtgcaaagtatataataaaaattaacgtttgagtattaagattcaagtcattttcatcctcatcctagtgcttggagattgattcttctatttccaattctttagcgctcaaggacgctttatagtcgggccttatctctagagctagatgattcatattcatttcatggcttctttcagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttga

SEQ ID NO: 806 - DNA, 587341 bp, Homo sapiens
ccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcctggagttgatgttgggcatcccccatcttcttgcttcctctttccttctcttgttctctctcctccgtcccccacccccaatctcaatcttttctctctttctctcccacacctcccctctcgccctcctcccaccctaagcacgcacagcgtttctttctcctcctggagaggattgcctttcttagaggaaagagggggagtgaagaaaggagaaagatttctttctgttggggagagggatatgggggggggggggaacgtaaacaagatagaatacaagctctgcgaaaatcagagcacataaagcaattaaactgaataaggggagtagacaaccagtccagcttgggctgtcagagagaggaagcgtcaagtttgacttgatttcctccttgcaagagtctatgtctctcacttgattcgttcaaatggaacaaaaataaaccgacaatccaacccactttcaactgcttaattgcttttgcttttgagtgccaaccatctgacttttcctgtttccatctgtcctgtggggctaacaatttggtattgcacatcagtgttaatatctgaactttgaaagctttcttgagtaacaaaaaaaaaaaaacaattaaaatagattattactttcctgaggtttcttggtatggcctgttgttgggggatcaaaaaatgtaaagtttcaaaacatttgcaagggacaacaattttatagggaggcttggatttctactttgagaaagctaatcttctagttagctttgtgtacatgttgatattcactttctccagtattaaccctttcgtgaaataaagcaactgtttaacttttgtatggaagctacatttgtgtagaattttcactttattctacctttgtactatttgcattttattgtctggataccaaacttatgcctggctttattttcttttaataggacaatatttaatggatgtaaacatgatgtttatacaatttcagcactccctttagaaggcacatggaggctcagttggacaagaatcctcctgtactggaactaagtttagaaagtaatgctagaaagataccctaaattttaaaaatcctgaaggggaaaacatttttgtaacgtcttgttaaaagaaagaaaaatatatcaaaacaccaacatgcccctggctgcctgcataataggtcaagtaaatggtacttgttggacagagcctttacagcagcttcagcagtctctaattccatcattggggatataagctttcttttcttattattcttcagggacagctaagcgatagtactgtcagatggaaggaggtatagagaaatgcctcgtttgatgtaataggaaagcattccaagtgggtcttacctgaacacagagaaatccacagatgttagtatacaaaacacttctttttatttatcaggggaaatgcagagtcttacttttttttgtctagaactccacttgatataagaaaagagaatcttctatcttaactgtgtctgaccttccacactaattttgtatctcagagagtattttttcactacgtacgtttaatatataagtttacacaccaacttagagaagagctgaattcatttgccatcagtgtaatgtgtactattttccaaaccattttgcatttgaggcaatgatctctccctaaatagaattaccaagtcacgaaaaacgattttctttctagggctttgacatttaaatgaaaaaaaaaaaaaaatagtgtctctgttgaaagctaactctggtttttagaggtgccaccttttggttacaaggacaaagggacaatcacttaattacctcacatgtatgtacaactgaattaacaagtttagacatgaaaagatgtacaaaaaggaagccagctgccttcatgtgagaaaattaagattttgttttctcatttctccactgtcttaggaatatgtgaaaatttaggcttggtttgtgacatttattttcatgactctttacaaatgttaattatagaaataacatctaaaaatatggatatgagtagtttttcaaatacttctaaaaaattcaatatctgtgtattggaaatcagaactaattccaatatatagtgagtggattggggagagaccttacatgatatattataggaaattcttactttgttatcccacaaaatagtctaatgtcacaatttcatacaatctttgttttttctccctttgacaggatattttagtaaatctcattaatgtttcagagtaaatatgataattatgcctcgaggtatttttgtcagaattgaagactgctaatatatagggaaaatcctaaaatactaatttcacaaaaataccacatgattgagagttgttgctgagtagttttgaacttcatttcataatggagaatattagttatttcatctggtcaaattatcagatagttctaatcaacaaatatgaaaatgaataacattgtatttatacgatttgcatattagactgaaattgaaactaaaaaatagtattaattatatgcttgtattaattatatgcaagatgagctggaagattaataaaataaaatgtagaatatgttagaaatctgaaagttaatttgaacttcctgttagcctaataacaccattaacataatatcagttcatcacttttgatgtcagtatattaagttgattttgagaaaattcccaaaacagttagagccatctaatcttaaagaacacacacttaatgcagacaattatacgagcctgaaatatagttcttatgatttccagtttgtgcaacaaccaagaagagctatcactaattccaaattgaaacataatatttattttcctaatggtaataattaagtaatttggggggaacaagaaataaaaacagtttgattatataatggaacaaatctttgtctaatattaccaaaaacccataccaaagttagactttctgccattgtgtaatgtaggtatgcgtcttgcatgcattctgcagaaaatataatatttttaaaaagtaaatatctgatgtagttgtgatattttaaaattcttaaataatttatttatcataaatatatctgtaccaaaagttcaatacatgacgtggctgattttagctgaaattttttcactgaaattgaccaaagccatttaaaaagagacaaagtatatggcaatatacataataatttcagctagaatttaaggatatgtgtgtgtatatacatatgcatatatttgtgtgtatatatattccgaaattatctaaatttttcaaaaaggtttagaaactcatggacagtagactataatttgctgaaactaggggctattcatgtacaaagtaccatttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacaggtaacaaataagttgaaatcatatttttacatgatttagatatgatggctgataaaacttctgtctttctaaggcttttggcagatgtttctttcaatatttgcattaaggtaaacattcttaattttttatgtaattgaatggcatgattatcattgcattgggtgggagaatgtgggttgatatgttttcattaaattcctcaagaaatgatcaacattttttcagtctttttgcaaacttgacttaaacttctccactaagtgtttccatttccttaaggagaaatttaacatttccaaaaaaaaagataaccagcatttttctttcagctggtcattttaagagtgttcttgaggagctagttttatatggactgtaagataaactgtggtagccgggtatgtgaacatcactccattcatatgtactagcaatacaaaataaacttatttaaaattatagtgcaaatgtatgctacctattagaagagagcatgccatcatttactgtctacatcaataaaattaacttttgttttattaaaaaaggaaaacttttctttaaagtggacaataaatatattgctatgttgtagaaatggtaaacactagagatgctatttctgcaatttaaaatataatattagagattctattgcaaagaatcctagttttaaaatggcatctacattacattattttaaaaaagcaatatttaagagagtttcaaaagaaattaaaacctacattaaagtaaaataacacctttatggtagtgttagaaatgaattttctagcatgtctttgacacatgcaaaacaaatattttaaagaattatttctgtaattgctctaatttttatatttatttaagccttaagttctgattgctgatttccatactttactaataatgcaaatgagaggtcaaagtttatcttttttggttactgctattgcggaaatacaaagaaagcatactggtcactcctataaatgtctcacacatagtatgttttatgtttaacattattacttatgcacataaaaaggcattttgttaaagaggagctctagaaaatcataaagcagatgaagatataaaacacgccttctatttctagctgtttgtacaaaatgagagctggggaatttccatgtagaacgggaatggcctataaactagtgtaagaattcggtgaaactacttggttaagatataatttaagatattatttccaagagttcatacagccctgttggacaacatttcatcacagatactagcttgcaaccatgctacggcaatcataaatactgttaaaaagacatttagctaagtgcctcagttagaaattaatttctgattgaaatatccacttaattaaattcaggtatggtactgaaacttggtcatatcttacctcaaagaacctatttctgtacttgtgaaatatagctttattaataattttaaagtgcttagagttccgatatttttttatcaaagggtattatataagtaaaagtaattgtgtcttatttcctgtgatagataaatgttttctttctcttttgaaatcaaagataaaatgcacatatgcactcaaatgcaaacatatttgaagagtttgaaatgtaaacattcttattttgcaattgcttacatgagaagtatatagtctcctgtcctcttccatcatgctccctgacagcagccatcatttcagtcccttgagaatagaaaggaaagcagacaaaccacctgaaaactctggtgaaagttctcatgatgtggcctccagggaacagcctcttgttttacttgaggctcatttccgctgggccatcctccttgcatgtcactccatgcctactgtgggtaggaaacaggtacttggattgactgattgctgctttgagattccttgacatattttttcatcaacatgaaggcaaaaggacatgaatactcagtcaaaacatgcagagctgtacttacgtgaacacttttaaaatgcgatactgaatcttatataattttaggataatttatgaaaaagcttttctttcttggaatttcttttgtttactcacaagtgatccaagcaaaagatgaagctgttaaaccatgagtcagtatagtatttttttaacttaacacctgagaataaagctgaaaggattgtttaaaaagtgtttcaaatcatactttcaaaatccatctgtgtctggagacccttaaataagcacatgcttcatggtcattatcccagataactgacaatttgtttttctacaaaatctctggatattatgaaacatcacacacgagcttgcttttaggatagattattaataatgtatttttcagacacaattgtatgtgagagtttctgcaagtataaacaataagataacattacagcagcaggcaacactcactaaaatatcaattttgaattgtctgctctctctttgagaaggagaaagagctaactgagtatctttttccctcatgatgtacttactggtctccaatatcctatgccatacaaacagtggacatggtccttgcttagctcctatgaaatacggaaactgcctacctgcttatttttgagggaaaaaaaacttttctagaaagatttttagacaaatgatttattggcctttgaagcaaggacaagtgctataacaactcattaagggacagttgagctctagcaatcaggttttgagttatcaagattattaggaagaaaagttgacacagtttctcaggaaaaagacaaggaagcaaagcattgaaatctgtttctgacttggagtgtctgccagatcctagtttacaaggctggctttctgcctaatccctagcattttcatcagatttgaagactgaataaagtgaactattgggcattagagcatatttctagagcaccgagacctcttctataaatagcataacatcactcttctattttaaccaatgttcagaatccgaggccacaagtttttatatttaaatatgtataaaccagatcattctatgcctgaaagtactagggttttatctgtctgtgtacaggaaattcttctgttaaaagcttagttaacaatatgacattacaaataatgtacctatttttagtggttttattaaattataatgttaaatttaaaaagccaagcattcaccttgagctacatctgagcctgataattcaaaaagtgacatttcagtacaaagccaacatacccttaaattgacaaaactgccctgcttttaaattgttttgtaaaaaagtacttgatatgcaagtttccaacgacttgttttttttctggagaatcttagatactttctgaaccactcttagacaacacagaatgaatattaatgacaggagagagctgactccttcaggcaaaagtggatgagacaagttcttttatgcctttgagaatctgtttcatcatttatatattgaacacatagcaacagttttatttctcttgatttctggacttttagacctgtatgcatcgaagcatattacacctcacagcctgaataggaaagatttgttcagttctctggttataagaatgatataggaattcctttgtgttctcttcctttctgtacattttattcctttctcatgtcttctcttcctactctgcccttcttccttcttttcttcattcttttgtctttcctttctttttttgtatcttaattaaatattttcctatagaatcactaaatgaaggtttagtacttttgacccatagtaatcttcaccagctgaattaatttgtgtcaacaactaagaaatgtaattcttagtttgtatacattttaggttagcttcacaaaatatatgtatagataaataaaggagcagccttttaatttgtttatgtaattggcacacttaaatggaatgtgtcatcatatgaatgtttttaaaattttgcatgtaaagggcttgcggataatttttaaaccgtaactttttgcagagagacagaataatgttttagagtccaaaaaactggcatgtactatttggcatgtttttctttattttctattttgccattgcaatggtaacaagttactgtgttcatgacaggcgtgcagcactgtatttttatttgtttatttattttattgccttgtttgatgttgataatgaagaggttctctctcttaaagatgcaatgaaggagactcaagtgttgttacttgcctgcaattacacatttagaaagcctcttatattttttgtctgttggaacttactgcctcagcacttaataaagcaggaaaaagcatgttttgtaattctcttactatgtaagaactagtttgcttttgcttatctaacatcattattgagtataagatacatagtctttatttatcccactgaaaaaataagaaagatttgatataccattatttcttctgtgactctaattgcaaaataaattgagtttgtgttttaaaattattcaagggacatttttgtaatctacaagaaaagtcactaagcttgagtcactaggctaagttggcctttagtcattgctatatcactgtgatgttagataagtcaccttatttgttttcttatttgtaaactccatagttccaagccaccaagtagggtgcaatgagaagtgattgtaatcataagtgttgtagctttatcactaactctccaaacttatctcttattattctcctcattgatattcatacacaccttcttgctgttccttcacataacattagtggaagttgttgaatctattgatactttttatcttctattccaaggtagaatggttaaacattctgctctaagtgaacatatccaaaccacaattattattcaattcaaatatgaagtctatcagttggcaattctttgtgttaagaaacacatttgcgagcaatagctaatagccataccattgcaatgtggaataatataagtgtgtttgtagctaatctgatttaagaaaacaggaattttagttgggaagggcctatagaaagaatacaaaattatatgaaacataggataggtattaagggagatatttgaatgaatacaggtattcatattgtttcttacaatatgtcaggcacttttctatgtactttccatgcttcatcccatttaatattctcaataactccttgggatttgtgctaatttgtttataatttttaagtgagaaagtagtggaaaaagaataactgagcaacttcccagggtcacattatgtagtaagatgtagaattaaacccaagctacctatttacagagccaatactcaatcataggtagtcacacaatcaataaactcataaatgtcagaagaagagaatagatggtggcaaagaggtagaggtacccaaaagagattaaatagtgataggcaaattgatccactttataggttaggtcaatatgagcatgatggcaataggataaaagtatgaaacttagagagctggattcagatagccaactctggaatggtgaacttcaataagatagttccccaggaatgaaaatgcaataatgtttgcaaattgtctggtgccctgttactatatggtagatttgaccacctttgctcctctttctctttttttattttcagaaattctttcacttgtaaaaatgccacctgactcaaaatgcttaagcaagaaaagggattttggtgctcatgtgaccataaagttcatgaatattctggcttcagtcataggtggaaatgggagctcacaccatgtggtcagaaccaagcctattctccttcctaccactgtaccactagtactcaataatttaacgactggtatgattataccagtgtgaaaagtctacctataagaggatattggctgagttgattgttatttaattctagttatgtccttgccttactctgtttggcttcctcactttttaatgcagaagggtagatagtctttattcatctcattgcaaagataagaagaaagtcctttacaagacttgaagaaattaagcttagtagaaccaagaacagcaaattgcagagccacttgcgtgtaaatgagaatttcaaacttttattagttttgtaaggaaggaggggttatttcaaggagtttataaagttttaacctacatatgctacagattaaacgttatcaatttgtacaaatatattatacatttttatctttgttgtactctgaattgaagaggaaatatttgggaataatatatttcttcggtaagtatgatgatgttcctattatatgccaggcaccatttggatgctggggatacagaaataaaaatagtagacaggtttcctgcatgtaggagcttacattctaaggaagaagagagaccattaaaaacaacaacaaaacattgctatggtacttatataataaatactataaaattgtaaaataggctaataaataaaacagagcaatagtggggaatgtgatcaaccaaaaggaaaaggagccagccctgtaactatcaggggaaagcactggggtcaaatgaagcaaccagtacagaagctctacaatgggaacagtttggtctatttaggtataaagacactggttttatgtgtttcccgtgccttaatattttaattaaaaataatctgcaaacattattaagaagttttcaaaacagtgtaatcatgtataatctcaccatgctttaaatatatgctgtctcatttctgtgtaatatgtttccagtgtgtgttcatatgcttacattttttatggcgacaatcatagaatatacactgtttttactttgacttttaaaatgtattctcagatgtcttgtagacatgtatttttatactccagttttatcttcggaagagtagctgcttttcttttattctgtatattcctcagacactttctacatatcttccgtttcttaaatcttaataattctttccctttcccctcatttctaaagaaattaaatacatggcctaactccagttttattgttcctataaatttaagtcaacaccttaactttttatcacattcatgacacttgtcaatgcaatttccttttgagtatatttttgattatatcctacaaaactctaatttagattttgaaacaaaagtaaataaacacagaaaacataatgaaacaaatcattttgtgtcgattatcacttagacaacacagttcttgtagcattaaccggaaattatttttcctctatctagtctcatatcctggtttcaagaactcaataacctaagtctacctaggttgctatatgatagtaaaccagttgcctacaaaggcatattaacttttgtgagactgcattaccacgcaatctgctacacagtaatgaagtaataattaaagcctcaatcataaatgttcctcttttattttctgctaatgctctctatagacattatattctgataataacatgttttgaaaatggaggtgttttttttttttttttttttgccaaactactctgctccatcaggctcttttgtatcctaaatattttatgttatactatatatatgagtgtgtgtatatatatacacacatatacacacacacgtatacatatacacatgtaaatatatacacatatgtatatacacacgtgtacacatatgtatatacacacgtgtgcacatgtgtacatgtgtgtatatatacacacatgtagtatattatataatatattatataatataattatatattatatattatatattgtatattatatatattatatatttatatattatataatacatataatatattatatgtaatacatatcatatattatatgtattatatataatatatattatatataatatatataatatattatatgtattatatataatatatattatatattatatgtattatatataatatatattatatattatatatagtgtattttgattttttaaatgcacctggctcctctagtaaatgccagtttttcagaattttgcgatgacatttttatcatctctgactcttcagtacctgaaagatattaaggagtgaatattttatagaatatttattgaatgagtgtattagtctgttctcacgctgctaataaagacatacccgagactgggcaacttataaaggaaagaggtttaatggattcacagttccacatgggtggggaggcctcaaaatcatggcagaagatgaaggaacagcaaagggatgtcctatgtggcggtaggcaaagagagagcatgtataggggaactcccctttataaaaccacaggatctcgtgagacttattcactatcatgagaacagcatgggaaaaaccttcccccatgattccgttacctcccactctgtccctcccacaacatgtgggaattttgggagctacaattcaagatgatatctgggtggggacacagctaaaccatatcaatgagtaaatccagtaactctatattttctaacatttttaactggcatccaaatttagtgtatgcatacacacactattagcaaaagttctatgaaatattacttgttatgctttctgatacttttcaattatccttttctatttcattaaataagtactggtcatgatcaactaagtttatattacaatctaacaatgtataacagcctgtattttttttcctttttgagacagattctggctctgtcattcaggttggagagcaagcacatgatcctcccaactcagctacctgagtaactgagactacaggtgcataccaccacgcctggctaatttttgtattttttgtagagacagggtctcactatgttgcccaggctggtcctgaactcctgggttgaagagatctccctgattcagcttctcaaggtactaggattacaggcatgagccaccacacctgtcctcaaaagtataatcttcttgctatattcacatacaggtaattttgtgtgaatttataatccattatttttaagtccacaatgaatctagcaccaatgctgttattggccactcttaagcagattcacgtcagttggctaccttctaagggattcagctaatagctcttaagcttccttttggttgtcatggggttgatatattgcactcttttttgtgtgtgtgtgtgtggataaactttcttgtagatcggaagaggatacacgaaaggaataagggattacctcttttcctttaaaatagtgagtggagaactagtctatggaaaaaatagacaatgaagattgagcataggtatttagagttttgtattcaaattaagaaacaaacaaataacataaaatctgtcaatccttcaccaagtacataatgtgggaattttactaaatgatttctctgacacctttcagtgctaacatgtgaaggtctgtaattgactatggcattttgctgcaagaaaattagacatatgagtaacgcagcacataaagcctttggcttcccttctaacatttgtttactctcatagtggtgaataagtttgaagagtatgtctttcatctttcagtcattcattaatctactcaaaaatagttaaagtacacaaacaaactccaagacaccattagccacccataaaagaattgagtaccatctagttaagagtgaaaccataaggaagtaatgattcattcacatgtgagctgtgaaatagcattgtgtaggatattctgtggtagcaaacagtacaaaagcctcaagggcttcagcacgaaagctttattccttggacataccacatagccattgcggatcagagtgtttggagagtacataggggagagtgtcctctgatttacatagtcattcaaaaatctagactctgagagctccagtgccccagtgtcttataagactgtcatctcaatgtaaagtttaaggattcattgcagtagggcaaagaacatcagaatttcttaccagcaattatctactctcaccctgtaaaagatacataaaatttctgctcacagtccattagccagacccagtcacgtggctcctaattacaaggatataggaagtataacacacccattcccaccccaggcttggaagaagaggatattggcaagtatttgaagagataagctgcatcaggaaaatgcaaagctttctgcaaacacatgagagtgaatgacagctgaaacagcaatggctttatataggaggtgatgcataagatactctgagtgactttggggttatgttaggtgttcagttcattcattaatgaaagcatctctttttaaaaatctaagtctccaacaatgatatgtgtttggttcagaaggccagcactcctggcaaatttggaagctgaacaaaatcattcccgtcttactaggattcctgacacgtagtgcaaccacctacatggcagatctatttagaagcctgaaagacatctcaaactcaccacattcaaactgaactcatcttcatcaacatatgtagtccttccctagtgtcttcaatcttggtgaatgattgcaccattcatctaattttgttatctagaaacctgggagttatacttgtttcatatgtctctcatttttaatctcaaattcagaatatatgtcttaataaaatttttaactcataaatatcttttgaatatgtttacttttctctgtctacattgcagcaccatagttcaaatcaacttgccttctcaaatctattatccttaacttgactttcaagtccatgcattatctggccctacgtattcaccagcctcatttatcatattgttcctttgttctgatactctggccatattggccttttttcaggtttttaatattccagatttttttctgcctcaggatcttaacacatgctggttatgatgttggagtgctttcttttctcttttatctggttaaattctatgcagccttcagatctcaatataggtatcaactattcagggaagatatttttgactcttcagaatcactcagaactttgcattgtacctcctcatagtgacctgtattttccctttacagaatttatcaatttatcattatatatgattatgtatttatttgggtggttatttgattagtaacttcttccccaaccagatttggagtttcaacaaaacaggcatgatttttcctcatccatgtggaccagagcctcacaaatagtaattagtcattacattgcattcctgcctcagatcctttgttcttccccttcccactggatggaatgcacttcctctgtattctcttttgattacttcttcaaaccttttgtgtgtttactcaatttttgtgtggtctttcctgaccagtcttgtagtacatttatatctcctcccacttccctaacatctttcttcttatcacttatcactctttgaatacagtttttaaataaataaatttatttatttattgcctccctttgatcattagactgtaaattccatgataacagagatttttatattttttacttcctgatctccgaatgcctaaaacaacacatatttgttgttccataaatatttgttgagtcaatgaataaatgaactgtgaattgtctctccattaattagaacagctctatgcatctcatccaatgaaaaaaatattaatttaccagtcttaacaatttgcatagagatgacaagcttatacctttaaagtgcatgtaggaaattttctttttttttgtagactaagttataatttacaataagaaggccaaaatgactaatttgtctattataccatacttggaaacttaaactttctagtgaaagggttatatttattataaaaataattttcagcttagctattttctgtcatcatccaatcaccttcatcctactgaattttcctcctaactattgctaatttgtttctctaatctcacactaattattgtaagaaaaaaaacaaacctttttccaactggcttttctaccttacagtcctgctttcttccaactcatcttcctcacagtcacctaagtcactgaacacaaatgtgatcagattattcttctgattgacatacacatgcagcttcctcaaaattagaaaacaaaaggaaatgcctctcattcctatatacccattataattgactttgcttggctcgtcacagtacttgtcacccccaaatacttccctcctgtccctctccatgaacaactgctacccttaactacatcaattttatatcgctcccttcacttctaatttattttttaggtctgtttctcaaagaaatttttcccaacccatctctgtagttcaaagcttatgtaatactctcagcatatttccagcattacatttgtcatgttgttttaggattattgttcatagagccacccccttttggttttgaactcgctgggtttaaagattgtgtcttattctttgtattcccatttactggaggaatgtctggcacataacagacattatcgaaccttgttgaataaaaagagaatgagtatatttagccttgatgggggaaaacttctaaaatatgcacagaaatcaggcattttctaactgtgtttgtaaagctaaacttgattatatcactagccatttatgctttggggagagtaagcttcatgcagtctagggaaaccaagtaaccttcgcttggtaattttcctttcaaaagaagaaaagaggagaggagatgaggagaggacagaggaagggaaaagatagaaaaaaaaagaggagataaaagaagaagagtaccagctctctttgagaagctgattctagggctcatctttgacaagagaaatgttaagatgatttttttggcttgctaaacttgactcatccctcaggcatctgcttaaatcagagaggatacttctgatctctcaatgacaattttgtctcccattatatttcccatagcaccctgtattttttttataacatttgcacaatttgcaattatatatttatttattatactattcattaaatgccaggagaagccactaagaacataaaccataagaggtcgggggccatgtatgctctatggaagcagccacaatgccagttacactcaacacctgacacatagtagatgttcaaaaaacgtttgctgaatgaatggggagatgataagatgcataggcgattgactgaactttaaatagatgctttctttatcccctaatctttaaagaagtatgaagttttctgtattggggaggaaacagaaaataatattgtagtctggtatatttgagggaggatgagcaggcttggttaaaatagaaagctgagctttccacagtgattggatccaatctgaatacaaatttaatcactctatgagtgtatctactatcattagacactaaaattgtaaattcagcaatgtaatatggctgactctttaaaaataaatttttattatttatatctgagagtaaatattcagttttttcatattatagtagtatgaataatttgctttccaaaattcctccagaactgccaagaattggcaaactctgcgtggtagagagatttgaacaaataattgcaacaaaatgaaaatatttcggtaaaccctaagtagacattaagtttgaaaatattgaaaacttaaacgattttaaagaagaaatatatttataaattcatatctcataggtgagggtactgatgagactaaatttagttgacagaaatctgaagtgaatgtagagaagtgctttaaatatatattgctaaaattttaaccttgagtttttatccaattgttttgataatctcttttctctgaatcatggcatcatagatttttttttcttgtttgcttcttttctttgtaatgggaacagtctgtgatcttacatcctctgggtgtgaaaactcattttcagaaactacctaaaaaagtgcagtgaaaaataaatcttctagctaaagataaagtagagattgttactgaaatacaaggtcatatgattttttaaaaaaatatcttattacttgattacccagttgagaataactatgtcaaaaaatctctgagattctatgtgtgtatttctgtaatttcttcgaacagtaatacactaaattataatgttataacagtgaacaattgatgtttattgacacaatgcaaaaaataagattgagttaagtcctctatgattgcaggaaccatttctatattgtttgcaattttttccccagtaccgacctagcaatacatggcacatactaagtagtacttaaaaatctttggtggatatcactgaagtatcatccttcttgattttttcattcgtttctcactcacttatatatttcttttgaataagtgtaatactttaatgtgtggttttggtaataagccttcatgaactgatattagatgtagtcaagtcttctcttccaaggtgaaatatgactttctttcttttctcagtctttgtttccctagattaaatcaccaggtagctcactgttaagtttcaaataaaatatggtaatttaaatgctcattttgtcatggacaattaagagtgaagagatgatgtataataatatattccaatttctctttaatgggaccaactaatgttttggattatttgagccaatgttacctatctctgaaacagataatcattcttgactttctcttttccctttcactttctctccaccttttcttctttctctatttttaaccacttcttcagttatattataaatctctatggcatccaaagtgcgaaggggttctgtcactgaaaaagttattccttctgtaaatatattcaatgtatacttaatactatacacatgaaagtgatatttttaagaaaattatgattcatttctagtaaagagaaatattttaaaggaaatattttagcttgttttttaaataaaaataattttctaaataaaaaattattccataaaattatttaaaatactcaatctaataatatataaatggaaaaattagtcttttttcagacactgttttctttcagtcagccactgttaccaatctcttatattctctaacagaaatatttaaagcccctaacagaaatattgcatttgcaaacatcacatttaaaatcaacattccatgatatacacaacggtctatacattttcagttagattattttatttatgttggattagatattactttatacaatctacagtgatttttaaatgtatagttatatattttatatattaggaatagctatatctactgcttttggttaatgcagcattaagtaattgtgtgaaacatgttaatttgaagtgattttttactctaagctaattcagtttgataatttagtttttttctagtaaaatttgtgatgacagtaacaatgaacataaggtgtactaaaggattttatagattgatcatgtctaaagatttttgtaaatgttccacttctttcatactgcaaagtatccttgtgttaacatattttataacatcttgtttgtttaatattttcattaataattgattctctttatcataatcttagaatattttaatgtttgcatttctatatacattcagacattataaataaaattttataattatatttaatatatctttggtttggggctgcaattgttgagtttaagaatattaaagcttttcaaaatgtaaacttgttaagaatgagcttgcacatgttagctacatgtaaaatctttttaaaacaaaaagaaaaaatatggaatctgtctgaagaaatatgaagttttaaaagtgtttataaaatttggcaaatttaataataatagtttatatgtatagagttttcattacataccaggtgctattttaactgtttttgtatattgcttatttaatacttacttcaaaacctctgtgaactattataatgcttattttggaaataagaaaattgaggcacagagaaatgatactatttgcttttaggtcatagctgttaaatgttcggggatttggatttcaatccactagtatctagatgatttattacttcattaattcaaaaatctctgagcattagttcaaaatgtttcagtattaataagttatttaccctcaaataacttacctttcagtgggggcagaaaaataagtggagaaaggaaggaaggcaggaagggaagagtgagaagaaagggggaaggagggaagggaaggaaggagggaaggaaggagagaagaaaggagagagggagggaagaaggaaggagggaaggaagaaaggaaggaaggaacgaaggaaggaaggaagggagggagggaggaagggaaggaagggagagagaaggaggacaggtgctattaataagctttattttcatgattgctatcaaaaaaataaaaataaaaaacaaggaaagagagtagagagtgccaagttgggaatatgaagacagaatacatttttaaataagattgtcactgaaaatcacatttcaccacagatctggaagaggtgaggaattaagctagggttaaagatcaggccatgcctggtgatttcaaagaaagcaaggcgtccacgtgggccaggtgctgcaggctgagggagcactgaaagctttttttctgagagggaacacagggccagatggtgtaaggccctggggtgactatggtttttatttggaatgagaggtgaaaccagtaaaggattttgagcatatgagtaacacatccaactttgatatttttaaggatcattgagaataaaatattcttgctagaatagactgaatagggccaagggtggaaacaagaagggaatttggactttgttggcctatgatggaagcaaaatacatatctattttatgtatttcctagattttgtgacctctaagtacattaagatagcagtggaaagctcagaaatacattcctatccattttttataagaaatggagtttaacttccctcatacttggtagggcttatcataacactaatttttttaacatgttatatgtacttcctcagccactttgccagctaatttattatcctggggcaagtaaataaaagttgggctaacttcaaggcatctaggaaaatagcagaaaaatatctttttatttttttctatgattgaaagactaatgcattcacaaacgtcagagaatgagaagcattaagggttcatgaatatagagtgagtgcaattggttctaaaagctatcctcctcaaaattcctggattggtattgcttttcaagtaagttattttgagacaaaatggttttgcttttcaatatttacatttaatttcattttaaacaaaaacagattgataccaacattcacagggatacctactgtgctgaaggctgattttgacagttgtaagataatacatgcaattctttgaaattaatcatcacctaaatgttgcttattatagacaaatacatagcaacaaatttagaattaaaagatgtttgtaaccatatgcctgtgatgatctatattttaatcagtacatactcctgatgtttttaatacacagtcagcaagtatttacctattgcctgctctgagatgagcattcagccacatttgaataatgttttgaaaggtttgggttgttttcagggagaatataaagtaaacagccaagaaagacccacaaaatgcttttggagaaaagtgtatgatagtgcgttatttattgctcaaataaagacaatggatatttaaataaaagccatgggaaataagctgatacaagctatatggggttaagtcattcaacacattttcatgatctatatttaggcatgagattaaactggaagccccaccagtcagtgtaggatagagtgccagtttatgtatgaagttttagaaggaatatttttctttgagattaaggaaataatggtatcccatgatacttgcactttctaccttttacagtagtcctccttacccacgatttcactttctgtggtttcagttacccatggccaaccatggtctgaaaatattaaatggaaaaattccagaaataaactatttgtatgttttaaaatgcatgttgttttgagtagcatgatgaaatctcacgccatcctactccatcctgcccaggacatgagtcatctctttgtccagtatctcgatgctgtgttatccacccgttagtcacttagtagtcctggcagttgtcacactgactatcggtattacagtgattgtgttcaagtaacccttattttacttaataatggcccaaatgcacatgagtgtggatgctggcaattcggatatgccaaagagaagccataaagtgcttcttctaagtgacaaggtgaaagttcttgacttagtaaggaaagaagaaagaatcatatgctgagatcattaacagcgatagtaagaataaatctattcatgaaactgtgaagaaggaaagagaaatccatgcatggtacacataattattggtactaggcatagtttcaggaatacagtaggggagctggaacatatcccctacggataagggaggatttctgtaacgtaattgcttttgtatattatcttccctattaggacaagagctcctcataagtaaagaggatatctcaatcatctttatatccaaaattatatatcataaagttactattcagtaaatatttattgattgaagtaggtgatgacatactaaaatataatttcaatatctagccctttctttagaagaaattgattattcatacttgttttaaaaacctgattgtatttctcaagtataatattgttaacttattgaagacaggtttacactgttaagatttaaataattaaaaccaactaactgaattttatttctaaagaggactgctcaaattttgtgcccaaaaaactatgatagacaatttaaagtaagagattttcaagttataattagtagtggaactcattacatgagaaaattaagatgtgtcattggtaatagtaataaggaatataattttgtagaatcacagatattataatatttttaaatcctttcttaagaaattgatagtttttttcaaaatctatgattttggaggatgaggtattgtaggtattggctttgtttgtagaagattacacatataattgtataaagttagtgtaaatggattgctcatatttcaattcttagacctcatcttcatttcctctcctggaaatccttgtgtacaattaccctggtaaatggatggacccatttcaatattttatatttaatttcattttaaataaaaatagattgacatcaacatccccaatgataccactctgctgaaggatgattttgaaagttgtaagacattttatgcaatcatttaaaattaatcatcacctaaatgttccttattatagtcaaatgcatagcaacatatttagaattaaaaagatgtttagcaccgtgctggacacttagaaatgtccaataaatatttctatgatagttattatcatcttttctaatcttgttggagttgttcacttttaggagtgcttcaaagatcacttcttctagtcaccttctgaactcctctttactttttatagttcagcataccactacctgctgattggttaatatctttggtagcttctgagtcatggttcatcaggaaaccaagggtgcgatttgcattcaagcaaatcctcctccttcctcctgctcactgtcacttctatttttactttggagcgcaaggttctttaaggcgtctggtattctgaggcttcctgcatttacagatttactacctgcttctctataagaaatgtgaattggtgacaaatctttaccagaaaaaggcaattgtaattagattaatacctaaggccaaagcttttctttgctccgaaacccgtattctttcccctttttagactactatcaatttttatctcagttccttcagagctcctggttaattttttttttaagaaaaaatcaagacttatttgagaaccttatagttaatgcattgacaaacatgtatagaattcctgctttgtctgggaatgtttgttaagaactagttcaggatttcttatcctggcatccatgtttcttcaagggtttcagagaattttctctgaaattttatacaaaatgtggtgtatacatttgcatatgcatttttctggggaatgagcttatagctccaatcacgttaccaaagggttgagactccaaaaaagttaagattcactcactacactggcagaaatacaaaaaacacatttccttggttgaggaacttgtaatataaatgaagctgacaccataaatgacagtataaaaataaaggtgaaatgctctacaataggtaaaaagagaaaaatcacttaataatcattttggagaggaataactgagactttgtctggatttagaaatgttatttatgaaagttttatgggacttctatcctgtgtgggaaagagtgtgagcaaagccttggaattagtattgattagagtgcatgggaacataacgaagagcccatgtcttgaataatattgatttataaagaaagaaaggttattgaacatgtgagatattaataattctcatggtttaaaatgttgactaatacaatgatacattgtagttgatattttagctaattacccttagatttaaacacttttggattttgaaaaccttaaatattcttcaaggatgttttgtaaaatgcctcagtcacaatgatcatcatgatatataattaataaagacactggtccatttcccaaaggggctaaacacagttttccaataacaaatcacattatagcagtttacactgacacagactgccccaaacttatgtatatttgagttttattaagtacattcagtacagtttgcatctgggcctctgttttatttgattaaaagaaaaaagttcaaattttatggctaaagagagcagacatatccatttgaatattccactgtcacctcaaaaataatatttttttcttttcaagcagtgcttttatttcttacaatctgtacaataaggtgacttgccttgaaagcatttcactttttctatccaaaaaagttataaaaatttgcaaagttaacttttataaattgatagtgttgtctctgactcacatcatcatattagagatgaatttccatagtgggagggaaagaaccttagatccaacatacccacaatagtattttagatcaagaaacaacagggtggggaacatcacacactggggcctgtcgtggggtgacgggagcggggaaggatagcattagtagatatacctaatgtaaatgacgagttaatgggtgcagcacaccaacaaggcacttgtatacatatgtaacaaacctgcacgttgtgcacatgtaccctagaacttgaagtataataaaataataataataataataatgtatcttaaactagactgttcaggatgctctcctcccttctacttttatcatcttcctcctcgctcctttttcttccaagcttcacagtttctgtccattgtaaccagtctttcattctccaactccctcatctttcccaaaatggactcattttccccagaaaattactttcttcatctccttacactgtctttcttattttcactcctcgctataactgcatttctgttacctccaatctacaatccggagtctatcttttcctttcaccattttaaatattgctctaaattcaaggcttggctgaagagtaaccatctgctagaaagtttctgaattacaactatgcaataattatgccatagaactatgctcctaacatgcacctctccagattttaggtacatagctcactattttatttagaattaattctactgattcctcatgtatatgtgtattacctatcttctcacccaaactataatattcttgggtcagatataagtctattttattattggtttattgtttgttttattttgttttgttttcatctatcagatcattaggcacaaaatgagctcttgatatgtagttattaagacactggcaagattttaggaggggaatgacacatagttgctagccgccaacatataatttatggtgtacaaagcacttttacatgctttttctcatttactaatcatagcaacactattatatattatcatccacattttgcagataagaaaacagtacatttagagaaagtcatcgatttggttaggaataggaaactagtaaattgctaaactgagcattaaactcaacatttttactccatacccaggtttccatgttaccatagctgtcttccaaggctgcattttgtacaagagagttaaaaatgaaattgtttctaatatctgtttgattaaaggaaaatatctggaacaaatttgtcaagatagttaacagaatttctaggtgttactgaattttaaagtctccacggtgaaatgatggttaactaacatttatttacatatggaagaaggtatttttggcagctttttaaggtgtaaaacttaagacacctcagaacatgtaggataaaaggaaactttgtcagggatgtcttgagaaacctgtggcaatttgaactgtgctcaggaggaaggacacaaatcatggctgtagtgagatctgtgaagtagtcttccctctacagcttctctttaaaagctaagtaatgggtggcaaaataaaccaaactgaaactgagatgcatgtcatctcattagtgtcttcttagatccacagtgctagcactgataagctcaagtgctgagaattgttcaaataaattctatgtgcaatcaatagaagacctaagaaaactgtgaataagttaatcactataattttatatattaacaatttttcattctctttctcctgatataaatatttttgtcttaattcttatgaattgagggtcaagttatgtctggttttccttccatatcatgtatggtctgcctgaactatagatctggcaagtccttgaactatgctaagtggtttaaatgggataatacttaacatactttgataaaaaccaggtggcttcactcattaacctcttggattcactaatatggaaaacatcatcttatcacgtttttaacatgaaaacaacctacctactacctaccactaatttttaaaataataatcttatcattcaaattatagtacattttaggttctgcacataatactactcagaaattagcttagtcacatacacccaggggatcagtcactgctattataaaaatcaaaaaagttataaaccattcttcagtaatataaaatagagaaaatattttagcaataggaaaaatgaccagtatagacctaaacaatcagttgtttccctttccccacctctctaaacacacattttaaaataggagccgccccgatcaaattttaaattttggcaaataaatagaagacttcaatcttccatagaaaataacattcattttattttactggaggtctgatttagaattcaaaaggaagtcaaaatttaaaaggaagtcaaaaggaagtcaagattaatttggaaataatgggacacaaatatatatggatatttaatttagcaatacattaatcacccaaaataatctcaagggaaaaagtttaatgacaaataacggtaaagaggagaattatttttttcagaattacacaatattgttgaaataactagatatgaatcctaatttgagtaaactcactttcacagagaacttaagagaaacataagtcatattcttgaattgaaaaattaggatgtataagtagcattataatattctcataatggtttggactcactcctaactaaattgcccaaataagttgatctactgctggcctttgccatcaaaaatatttaccaatctccactaggattgtgcagataaatgcaatggctgccatcattacaatcagtatgcatgtacttactgaggaggagtctacaaatgaaaaccaattcctgggaatttgtgggcaatttcaatattaagagcaaccatgactaacagtaaatgacaggctacatttttcaatttgctaataatgattcttgctttaatttttttaaaatttccactgctgatttatcaaaatatatggattagcactgactgtaaagttataatctagatggatcattattaattcttagtactaaaatacatatttttgaattaaacttgtcaaaaattcaattctgtctccaaaatttgaatcaatgttaagcataactttcaaagccaactcacctagcaacattcttctacatctgtattaaagaggaggaaagtcttagtgccaataatcactgaatactaaaaaaataaaatgctcacaaacttagatactcatgaagtctgaactataagagaatatcctggaaaagttgaggcaaagatgtcaagtcttctatttgaataaaatttgttatcctataatttctgcttacactaggccagtagatgacaatatgttatgaaaacaaacttctctgaagagaaactaagactttaactaaaaagataggtttaaggctagaatttatctcatgttttatagataagcaaaaaataaaaaccatggtgcagtgttaataaattagaagtgagtttaatgtttattttatacggatgattctgccataaccaaggcaattataaaaaataataataataataaagttgccctctgcatttctcctgaagacctcaactttcagtctctcatgcgcaaagatgcttccaggggcttggaatgaggaggctagcaatggatatgttttatttttggaaaatctgcaaaaataagctgttttaaccaatattggtgagagcactgtgttctttctacctaactttgtattcatattgcttttataatttttctttttttttccaaaaagattctgataattgtacaagtgtcaagaaacttaacacctggaaccactcctacattctttttctctgcttcaatatctctccccatcagtcctgctcactgaaatccttcctagcagtcaaggactaccctaaatacctcctctctaggcagttgttacagtatgtttatagtacttcgattgtatccattttcagttttaattttactcggtcttaatttatgattgtgttttttaatctgtttttttttttttttttttttttttttttttttttgtgatcaccataatgtagtagcaaatgtctacagcctaaaataaggctggcagagacttgtacccaagccttatgactttctagctgtgtaacatacacaaaaaaaagtcacttattcttttactctgattgagcctcagttcccttacattttgatacgcatcaaaataataggattctcttcataaactcctcacgattaaatgaaacaatgcatattaagtgcttatcagagatcttggacaaggatgacaactcattatgagctagttcttacaattacggctatttaaagccaggcacagaaagccaaatatctgacgatctcaccaatatgtggaatctaaaaaagtcaaactcatagaaacagagagtcaaatgctggttaccagagactgggaggtggggatggggagctgttggttaacggacacaaaatttcagttagacaagaagagtaagtttaagagacctattgtacatcatgatgactgtggttaatagcagtatattgtatacttgaaaattgctaaaaagtagattttaagtgttctcaccacaaaaaaataattcagtgaggtaatgcatatgtttattagcttgatttagccattccacaatatatacatatatcaaaacatattatacaatataaacatacacaatttttatttgttaattaaaaattagataagctaaaattaaaaactaaaaaaaattgtgaccaagccactatttttgatgtattctccgttgaggttttccataccatcctgcaaaatacttagaaaataaatatttattgaaatgagtaactcatgagaatattacttttttgagatataaaattattttgaatacaaaatgagcaaagataaaaaagtgttttttcataaaactaatttgtgacatttaggattataggattaagtaatcagcatattaaataaaacaaccaaaaattcttcaactataatgtttattctgtcaaatgcataatgtaaaataatatttgttttggcaattactgaagactaagcatttgtttgcctcccacataataagcagactaaagaaaaacacatttggtagcttgaaaaatggcatcttcatatgaaaaattaaatatttctatagacacattttcatttatttgtgataaagatttaattttaagtatttttaaaagtattccataacacaattccatttgttgttgttgatctatatacttacccatatgtaaaatattttaaataataacatatttgaagccaccgggcacaaaaatgaatgattgtgaaatgtgcaaagtatttgaatagtgagagctaattctatactattaaggacaataaaaagtgcaaaagtaattgtaactgctaaaatattatttcaagttttagtccatattttgatctatggtctaaattgaagtttattgattctgtaactcattggagtttcaacctagagaaaccagtcactgtattatgctgggggccttataaaaagtataattgtgtagaagaaagaaaaatgggtaagagaaacgtaaggacaggagacaagtcagctatttagttaccatgcaatgcagttatttgggagctttttctcaaatgtaaactgagaataattatacctaatttaaagctgggtggtgcatagagcacttggatcaatttctggcatatagtctgtgacagagctatgtaaataaattaatgaatttatatctagaaatccaactctgtataccaccaaatccctttattattttcttttctctaagcatttaatgtaaagtttgaactgtattattctttcctactaatttaaattgctgcttgccctatttgaataaaaaattgcctatttctatggttttgctaaatagtgaataactagtgcccttacaggaatcacaagaaaaacacactgaaaaatgtacttggaagaaagaatatatggaaatatatgataaagaaataactgggaagatgccttaggataaattatgaaagaaaatattttagctacccttttctgttgaacaaatgagaaaatgtggtcaaaaaacaaggataaatctattgggaaaaaaaatttatctcctattacccaaaattttacctgaaacatgtttttaaggaaagagagaacaaacatattctgaaacatagaagaggtgagtttaacttgaaattaagagcaaccaccctccccaaggggaaaaatatctccaaacctctctcctcatgtaaacagagactttagagtattagcagtcaacaatattttcattaattatttataatgtagaaagccatgcccatttaattccattttcatttaaaacactacaaaatatgatatatcttcattttaaaaattatgtgaaaagaaaatatctgaattatcttcatttctttttgatgaatacaaaaagagaaaaaggaagtagtttttactttacgatttctatatctttaggaagataataaggaatcttaaaatccaacatataaaatatcactttctacagcaaaattactttcaataaatggaaacctataattaaataatttaccttccttaagtctgagaacctcacaatcatgctcttcagttcttttgacttaacaaaatatctatataagtgtatgacaatgtcaatagtcaactgaaggcaatatattcgaggtaaattttattttaaacttttcttctatttcatacatatagactacaaaatagcaaacctggcatttaaatatataattccttcaaattaattaaactaaaacatgtcataagtagcttttatacatgttttattaaaaataacacttagaaaatattcagcctaatttatctttaaaaatgtcaaataccaggatacttttaatgatttttgagcataaaagaaaagcaacttttctttctctgtggttcaaagatacagacatgggaatattacccagtaaactatccttgtaggattaaattttcagtgaccagaagctagattgttttgttttgttttgttttgtttaacaaattaggctcaaatactgtccaaacctaaaagtggatcttcatcattacataaattctgcaagcctaaacaatgacagcccgagactgttgtacagagacatatgtgagactttatcctgatcctttaaaatgaatagtcagatgatggtttcacactgatacaaattagatttcatatgctgatatgctcaataatgctaacaaggatctatatataacttattaagtgctacaggcagagcctatgctagggctttacatctaccatttcaaatgctcatcaaaatcacaattaacctattgataagtttgtactggtaatttaaaatttggaggcattctttttccagtggttttgaaatattatgttcattagagaatatagtgccaagcctctgatgcctttgttggtttttatttcatgaagttagtgtacacagcacctctgcctgagcagagctgaaactcccaagttaggacatgaaccaaatataagggccacccagagcttgggtttaggcagccttcctcacctttagctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttgaagatggttgttttgtaatcttgactcatattgaatttaaggttgacgagaattgggccttggacagaactaaagcctacgttgttggatagcctaaaacacaaaatttgttaactcttaagaattaatgttttatatggaacaaagtctttcaggaattctaaaagtcatacatcaataaagagatttttatgtctttggtaaggcttttaagtactgtcatattaaatcctccctaaaataatttagctcagaaatgtacaagcaatattaacacaggtttttttgcttaaatagttcattagcctctgtaacttcttgaatataaaaaataatgccaggatttttttaaggtgtctttaaatctgctagcaagttaaagaaaaggttaaactttttcagacgctatgctttaatgaaaacaacagaagacacatgttttattgtaaataagtagataacttttctattaagatttggagcaaggctatgcaccatacatgctctgagtgggcttgattcctccagggaagaggccaggaaagcattgatgtgaaaacagcctttcccttgccattctctccattccaggcaggttatctgccaagaagctcatccctatctgtaaaactgccagcatcagttcatgcagcattcatgtgtaatttgctttttctggagagccataccagggcagagttgactgattgagggaattaaaagctacagactctgggacaggagggctgccctgtgggtatatgagctggttacattttggccccttttcaaaccagggatatgcaactcttgatatgtatgggaaaggcagaactgccaatactgacagcgctcctgagcagcgcaaatgctccacatggcaaatgcatcattcacagaggactcatcagagcagcacccagaaaaaaaccaaacagagcaatacacagagagaccaactggggccagattttgtatataaaacattcctcgtagagtgacttataatgggtagaaaaaggatacgtcctgaatggcaaactattatagtactgattatagtacatccatacaaagaaatatcatgcatttatgtatgatgatggtaaagaaaaacctttaagatcttcaggagaaatgtttatgacatactaaattaaatattaaatttcagtgcagtatgtatattgttacctcatttttaaattcttaactaatttatttggaaagaaaaatggtaattaagatcaagatgtggagacaggacaaatgaaagattataacgaaaattttaaaagaggccaggaaagcattgatgtgaaaacaacctttgagatgacagagttattgatgacttttcatgattattaattcctgtctttgtgctcctatgtgttatgcaaatattccacagacaataaagttactccttttgtaatgaaagtctgtgtaattaaattttttttaaaaaaagttgtgacaggtataaaagtttctggtttatgaacaataaaaactacctctggggaccttgagcaaaataatgatgggttagaaggctattaaagaactcctagaatctgctgggtggctagatccaagcttctgaaggatgtcaagggaagctccataccaggtgagaccagggagctgaacacaaagctggatcaggcagaccaagagaatagtctggctacaactcttccacttgacaatcgatctgtgccacagcctttgacccctgggctgtcctgccatgaataatcgttagttccccttacatttttgctttgctttgccaagaaacaaaaacttaaggtggtgtagtatatatgcagtatatattaccaccccatttcccatggcatatgccgatgtctgagcttccagggacttgcatgtatatttactgcttcctttggcttctagtgaaggcatttctcatattttgagatttctgtaactccctgcctccaatagaaaggtgttggatgctaagtagtggcaaatgtcctgcacatgaaatgttggaatagaagataaagtattgtgttagtacgtctctggatatttttaaaatccttaaaataaatttttacctgtccaagaaagtctaattgtgtgtgccacaattcctaagactctagaacatttccataatttgtattatatatgtcaagcataatacaaatacattgtcctagtgatcaatgtgtgatctgatttatgtatgcattgccagcctcagacaccatatattagtagcaatatattgtagagtatcattgggctatttttttttcaaagagctatggaatttagtctttttgaaatactaaggcagaaaaatgtgaagctaactaccgaaatttaaataaaataaattttcagttatgagtgatatatagtaatgtgtctttattaatggacttgaatgaaatgtgcaaactaaattaaaatcttggaaatctataattaggttaataatgtagtgatgacttcttaccagagaaataataacatttgataggatatgcttttttctttcataagatgttttacaagataagaaataaagttatagatataatacctgtgactgggttgtcttatgagctaatagatcgcattcaacaaatgaaaatgaaaagacaaaatatgcatcatagacaaacagatgatgccatcatctatgaatgcacagtatgggttattggaatggctttaacacattgaagttggtctagtaaaaattcaagaagcaatttagtttttaattcacatgttttaatttcttcttttacccacttaggtgcatgcatttttataaacttttataaccaagttctctaaataagcattttttattaaaatgcttacataaccacattgagaatagaaatagctctttaaatattgctattaccttggggtatataaagtaagtctcaaccggcaattcaaaaccttctatgatctattcagttgaaattaatcccctttctttcccttcatgtttccactaaactttgctttaacctttattatctgattcaagtttgtattatatgatgctgctaataatgatgataatgatgaacttttagtgatttgcaaatcaaagattagacagattagcaggtttgttcaaggccatgcagctgacaaataaggtattaatactaagatccagtcctcagcagtcagacttgagtccatagttttcatttctacacgattgatagattatctattttcttctctgcatcatcagttttttgaaggtgaggcattgatttttatttagtattacaactttgaagatacttaggaccaccatgaccaccaaataactaaaattaaaagaaaatacaccaaaaattttagtacagttgtatagtgtgattataagttctctatctcatgtttttaccactttaatttttttaatattctataatgaacagaagttagcataggggaatactttagagtagaaattttggtcaaatacaacggattttaaattacttcttcctcactttacgactataacaggttatctattgcttcatctaatccatgaattgggagctgttggtgaaaccgatactcaagtttgttgtaacaactatatatacacttagagtctctggcagaaagcagtcagtagatgctagttattatttttaaatcaaacaaaatatttaaggagagactttaatattcttaaacataacccttcaaatccttaaaccagattttttttctgtacaagaaagtctggttgtatatgctacaattcctaaaactggaacatttcaataatgttattacacagctcaggtcttgattctaatgctcagggtggatagaacaggcaaaaagtgctaggtaatgaagacatgccccaccaggcttcttcccattggtatgctgccttgacacagtcatatttaacagtgaactctgtttggaagcaatttatatgcatatatagatatgttcacatggcgctgctgagataattacaatgttatttactagttttgtctggtatttctgctatgtctttaatgacaaaatgctgcagagacacgggtgagagagacaaaagatgatgaggatgaggtgattttgtaaataagcaaaaagaggaatatttttgcatacttttgtgctggatgaaaccagtagaagagcaaatttaggtctaagagaaggtaataaattatatgcttaaatcaaatacctttaaagaataaaaaaaaaaacttttgatcatcacaggaaaaatttcaaaatattttatcttgcatcaaaaagttacatctaaatattacttcataaaaattatcctagggtttacttgacttttctccatgcaattccaaataaaataaggttttatgaactctgagattctttgaacagtttgaagaacttgaactggaatatctcttacactaagcacaggagactgttctccatatttaacactattttcacagtgtatactaccatatccagtacatactatgtgctcaataaatatacaatgaatgtgtaactaatagagtcaagaggcataaaggacttggagttgcaagacctcgcttcaaccctaggctttgccagttgttgattattcaactttgggctaataatttatcatataaaatgttgtttattatattaaattttaaatatataatttcttaagaaaacatattataaagtaaatttatttatttggaaaattaaaaaaattctcagactgtattaaggaaatatatgtaaatgatccttgcaaattataaatgctaattgttttaaagtcacttccagggcagaatggcaatgctcttaatattatgaaatcatagagcctctgttgaaagagaccttaaaaggcatcaagttcaaccacatctctggtttttaattatctttctacatagggaccagatggacacatgctgtatatttaactttatctttaaggaaattgttaactgtatccctggtatgcctcagaatgttctctttgaattataaaggagtgttcttttcagtactttatttcattcatttagttctcacacaaccccatgaagtactattactgttcccattaaacagatgagaaacctaaataaaaaatgtggttacttgcccagcaactcaaaactagtaagttgtatagtcaggacgagaacccaggtaatctccagagcccattcccataaccagtacagagtaccctttccatgtgaagtggaatgtgaaaatctcctctgcttcttgcacacgattgtggttgaatgtaaggagcaccccttttaattgcattacagtatatcatccaaaccagcagagtccaatttctatacaaatttcagatgtgaaagaaatattctatatttatgctgtccaatatggtggttagtagccacatttgccttttgagcacttggtatgtggctagtgtgactgaggatccaactttattattttgataattttaatttaaataagcacacatggctgttgcacatgccagcacttattgggcaatgcagtttaagttctatatcaaagctcttcagtgttttctttattggcatgtgttacagctcctatttatatgtgagacactctcccatagctgtaggctgacaagacagagaaagtagtgactaaaagtttagatgctgaagagacaagtttacatcttggctgtggagcttagtatgttactctgagtttagagctgacttacccttaaattgggatgattattgaactacattatagaactatttaaaaaaaatttattttgacataatttcagatttcagacgttcagaatagagacaagaattgtacaaagaataactgcatgaacttcactgagaatctccaaaggtttctgaactctctctccaccccccctttctttctctctctctctctctctgtgtgtgtgtatatgtgtgtgtgtacactttattgttttcatgaacaatgtgagagagtaagttgctggcttactccttttcttttaggtgcatattttctaaaaataaaggcatgatctctcatcaggaaattaacattcactagtcttaatactattatctaatctacagacttaattcagatttcataggtttcccaataatgtcttttatagctaaagaaaatatcatcttatgccttgcattccattttcatgtctttaaacttctttattctgaaacaattcctcaatcttaatttgcgtttcatgacatagacattttctaaataatataagccagttattttgtaaatagtctctcaatttaagtttgtcaaatgtttcctcatgatgaaatttattctatgcacttttggtggcaataccacagaagtgatgatgtgtcttttgcaatgcatcatatcagaaggcccatggtattcactgccccattatggtgatgttaacttcaatcactttattatcgggttaaggtgctgtctatcagaatggtgtttgctagtataggcaatgtctgccaataatttcaatgtagttattactttttccctctgtaatgaaaaatatattggggaaagttacattgagaataactaaatatcctgttgctgcctcgaatttttacacacttctttttgcacttattcatgattcttatgtgaattcttatgatgattgctaaatagagattttctagttccatattttctttacatttattagtcgagtttccacctgaaaaacagcttttttccacctaattatttatttatatcctggtagacatatattattcaatgggttgtcatcctttatgtcattacatataatacatgtgaatatacatatatatgtatatatattctttatatatataaatatatatatttgtatatatttctttatatctttgatgctcaaattgtcctggatttgagttaagggagctccttcaagctagcttctacgtccttttgatgtgtctccataattctttgaatacatccctaatttctggcacaagatgaggtttcataatgattttctactttccctcactagccctggaatcagtaattttcctaaaattcctttattcctttgagtgaaaagtatttagaagcctagatcatgggctaggtcttcttcttgttgctactgggtgtcattgcttctaggccttctcagcagatagcctggaagtaggacttgaaatattcatgaatgtataattatctatatgaataaatacatataaaggcatatatatttatacatgtttatgagtatatgtgtcactacatatctatttctatttttatgcctatctatgtatctagctatccatcttaaaactcttaaattcaaactgacgcctccaaaatcaacaccttggagttcattctatcttctcccttttccatatttgtaattcccttctctaatttagcaaaacttagttaccattggccacaatttattttatttctttgctcaccttagaatatatagaaactagtttccaaactgttaatctaggaatctgagcaaaagctactcactagaattgaatatttgttcagagttgtcttcagactcagagtacatagttctaatagtcaaggttcatatagttcaaaagttaactgaggttccccctaagctgtgtggccatgttattcatttgaaatatgactctgttcatgtttttgttttaggtttttagttctaggagttttttcctcccatgcttgttagttttctattctttttaaagtatgtatgtgaaacattaaaaattcccaaaagtcagaaccataaaatattatactcaagaaggtgtaagtccatcctccctttcttcatagagcagttttgaagagtaaataatattataaatgtttagattttgcattacctggcacatatttaggtctcaaaaaatctaatatagctattcatctaataatcgcgctttttctatgttcaattacacactcactaagtacttcatacctttttctcaatgtatgaaaccaaataagaatgcacatatgtgaacaaaactcttctaaaattttggtattttaactcttactagcaaaatattatttgcaatctttctcacaattaatcacgaaacaaactattgtgtttgatttcctagctaagaaataatggcttatttcattccttaaaaagtagaacatgaatgctgcatgtggcataagcacagtgttattgcaggagtaatatagaaaacatatcagggtcagaactcatttagtggtgccttaaatgtgaagaaaatagctgtaattctgcataaatgttataattgttagattgcagagaaacaaagagtcctgaggcatgtctgaagaaatgagcagattacatgcttaactaattctggaagataaggtttctagattaagtcatgctctgcaagggaaacaaataaagcaagcactacatcattagaatctattttattttaatgtatttctttaaagagaaagctttgattctggaaatgtctgacattgctgcatttttctcatgaagtcttctgtgcatacttaactagtgattctaatacgtatattttactagtgatattcagtaaatatgtcagagaacagatttcttctcttggctaaatgtttgcaataaaatttctggataaaatttgaattattttcctattttgtgaatcatatatccttactaaagcatctttttacttcttttttgatcatgtataaaagttattgagtatcataagaaattttaaaacattttatttttatcacataacaggaatggaataaaccaaaaaaaaagtatacttagaaaactcttaaatgacaatacaactatgaatcttaaacatttttgggaagcaaatagagatgacatatcaagatcaaattgtaaaatccatgtaagtatcaccagcatgacaatctttctaagagatgtttacttttagatatactccctatattctttatagtatatagaaactttctttgtccatatcttaatagcagggtgaacttagaggtaagttacaagttgcatacatttaaatgttaattttaatgcacctttggtacactttatattttgaattgaagggaaattttaattctgtaacataagtatcttaatagatacttaatcatatatccagagatattaatagatatccagttttacccagaattttcttaaagtaatacacagatgcttactgattggttagtacccttctttcacatttctgaggtctcatcttccaaatgaggtagattcaacaacgtttccaagttgtagctcctcaggacccaagtcctctccatgctgtggctagggcttccaaagtccctcatttccccacatcaccactcctctttaagatctccttctttcctgatttctcatacaacttttttatgcccatctctgtccttgatgctggagggggaagtgaaactgccaaacatcatcaccaggatgtgcatgaaatccaaccacacattgaaccccagatttccttgggctcttttgaacacccaatctttgggtaagattatttctatgaaaattttgtttcaactttctaaacaattgaactgtaaattttactgtaagattagtgtgcgtcatttaaaaaattttgtgtcttccgtgcgttatgagatatgtcccattctgtaatctctgaccatggaatcaagcttaaatttcatgaccctttctgaaattacataagtgtcttgagtttgtttttaactgatattcacccgccccgcttgttggtctaaatgaagaggaaattatcctaatgactttattttccttctttagatgaaattgttagcatggcaaggaaaaaatatattagcttttccatgtttattgcaataagatttccagtagatatcaggataatttaaggcttccgttgctacagttgcttgcctttctctcttctggttttgaaattatcattaggaataaagaactcattgctttctcctagctaaccgtctatagcataatactaaataccctttcaaaatgatgcttctatttgcatttatgttacttcattctactaattttccctatgctttcactcaaaaagctatggatacctccacactgtgtttttcggtatttctccccgtgttcttctgctgggatttgaaagtatacacttgaacttgaaataaataatagtaattcatgcaatgtaagaaatatgctgctattataggatagggagagagataacttagaaagacataatttgtaacaataaaagttttgagtatttttccttcttggctgacttcgttagtaactatcatagaagcatttgacacttcattttaaagtacagtagtcccccattattctccagggatatattagaagaccccctagtgatgcctggaactgcagatagtactgaacccaattgctgtcaatcttcctgttcatcttccacctacaaatttaatacttattccaccttaactaagcccttatcatacactctagccataacttttatagtgaagtatgacagcaaagcttgcataatttgttttccttcttcccgatttcatgaatagaagactcattcttaccatagacattagcaacctcaacctcagcatactttttttttctttccttaagtggagaactttcactttttcccttaaaggaagcacttcccagcttctgtttggcatatccaaattctcaccaacattactattgtgctttggggttattctgaagtcaattaagggttccttgaacacatgcactgtgatatcacagacagtcaatccatcacagagacggatactaagtgactcatgagcaaatagcgtggacagcttggatacactggacaaagaaataattcacatcctgggcctgtaggagcaggatggcatgagatttcatcagctactcagaatgatgtgcaactgaaaacttatgagctgtttatttccaaaattttttatttaatattttcaaactgcacggtaactaaagccatgaaaaccaaaccttgaacaagaggggaatgctgtatatatgtctgaatcatattccattgggaataatttacataagatatacagcatagctatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagtctagccaacgtggtgaaactccgcctctactagaaatacaaaaattagctggacgtggcagcacatgcctgtagtcccagctactcatgaggctgaggcaggagaattgcttgaacccgggaggcagaggtttcaatgagtggagattgcgccagtgtactccagctcatcagcctgggtgacagagagagactccgtcccaaaaaaaaaaaaaaaaaaaaaaaaaaaaaaaaaaaaaggttattagcagcaattagttttataaaggtaggaagaatctttactcaataattttactttctaacttcacaatttatgtagtgtttgaatgatttacagttagcagttattacctgtctgagtaggaaaagatagagattttcaaaagacaaattttattttaaaaagccaaatgatgtaatggaaagttgtggagtttacagtcagaaaatgtagcagccatctaatcatatgacttactagacttaatttattccttctgagcctcagtattcttacctgtaaaatatgataataattaccaacctaaaagattgttctgcaagcaacatgtgagaaatgtaagctgcaaatagcaagatacgtcttctggttttgtatgtatgattttatactgacttacagatacttataattgagaaagaatgtggtggggggaagggtggtagtgagtaggaccatttgtaaaatgatgagaacaaaattcaataaagaaagctcatgtttctgtgaagtgggcttttttagattacactaataagtgagatctaagaggacagaggggaggaagagttatggagaaagaggagctgttgatccagggataaaatttcagttaaactggaggaataagttttagtaatctattgcactgcatagtgactacagataataataatgtactatatatttcaaaattgcttataatagattttaatgtcttcaccacaaaaaatcagttgctgaggtgatgaatacattaattagactggttaaaactttctgcaatgtatagatggatgaaaacatcacattgtaccctataaatacacacaattattaattgtcatttaaaaataaaccaatagaaaaagaaagctcatgttgaaaattgaaggcagaaagggaaggaaaatacaatgcaaatatactgtaatacattttcaatcaaagtaaaatagctattcagtgctgaaagtaaggagaaagggaattgaagaaaaagtaacaaagaaaacaaaaagtcaaaagttgggaaaaaaaaatagatggagttaatgactcagagatttttagaaatagcaccaagctgtgaagcccaagaatggtcattcaatttggaaaggatgatcgaagcctcaatcacttttgtagattgataatgacaggattaaaatatttttaaagattttcaccacttcccaacctcctccattgggaggttgggaagtggtgaaaacttaaacataaccaagtgttgcaagcaaaatttgatctactgaatgtaatgcagctcttcatggcttcaggttacgtgagcaacaggtataagctaagctttagagtaatatacagatttgtaatcttgtgccaattgcttttcttccttaagtctcattttcctcatctgttaaatgaggttaaaaataatagctattccataaggctgtcaggaggaaataatgtgttgctatacctaagactgaataaatggtaaatattgttgtagttgttggaaaattctccaggcattgtgcatcgatgatttaagaagttagatattcaagtcaggcgctgtggctcacgcgtgaaatcccagctacttgggaggctgaggcaggagaatcacttgaacccaggaggcggaggatgcagtgagctgagatcgcaccactgcactccagtctgggcagcaagagtgaaagtctgtggaaagaaagaaagaaagaaaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggagagggagggagggagggagggagggagggaaggaaggaaggaaggaaggaaggaaggaaggaaggaaggaaggaaggaaggaaggaagggaggagagaggaaggaaggaaggaaggaaggaaggaaaagaaagaaatagagagagagaaagaaagaaaaagaaagaaagaaagaaagagaaagagttaggtaaatattcagagagcttccatctgcccatagaatgcaggacttcaattcgcatcttgagaactgaaattggttacttagaactgagtgaacaagtgtgtaggcatgatgtagatttatttatttttctctcaggagttattttaacaattttgttttgagacttctaacagactttctggagctctcctaccagctgctattgttctgtgtcccttgctggcaagtactgtctttcaatagagatgagccaatttatttgatgctgcctctggagaagagagaagccctttgggtacaaagtgtgcctgtcatgcagatggcttctctaatctaatgaggtagagagctgagcagtcaggagaggaaggagtgttggtaaaagcagagtctgttctctgcacccacttctcccatctatatatgaatagttagtacaagagccactttctacaagaatctttaaactttgacatgactatcctaaagatgagcacatctgagtctgtgcatggctggtgtatcagtgcagtctgtttggacagccactttcctctgccacaaggtgtgtttcctttttattcttcgtgacagtttggcttataaagtcttcccttattgatgcaattgtgagagaataaatttcattcttcccctgaatctgtaacatctttagaatataatctgaatatcaaaatttaggtttttggtttggttttgtttaattaattcatttaaccataaatacttctgtaatgagaaaccaattgtagcttatagaataacctgatagtggtgatgagggagacataagcctgctgccttaatgctttctgtgcctcagtttcctcatgcatataagtgggaaatatgtcactatcttttactggtttcataggattatattcagtgccagttatatttgttctaaaacacttggatagttatttgtgccttcaaaattatctaatgtcatatgaaaatacaaattttgaaaggatactattgcaatgagctgtcagttttaaatattttgatttgaattttattgaaaaaccaaattccaccttaggttttctatctgaaatgtttaaaatttgtgtaaatattaacatcacatggaaatcatattctatttaaattttttgccatcatttattttttatctgactctccttgtaattttattttcaattgccttcagggaacaatatgcaaactcttcgagaactcatttaactcttgtcaatttgtaccaataaaaatcaaagcttatatagtattatgcaaatattttattcacttggataagagggagtccattctactaagtcagttcttgtattaaaataattattcattttgtttcatcatttcaattataggcgcataaattcttatatcttgtctcaaacacaaaatctcagaacgtcttactttcatgcaaaaaaactaagttctaaaaaagcaaatttatatcaccttaagacgtccaaaagtataaaggttattggacatcactcctggtatccttggaaatatttgtttgattttgaagaaagcctctaagcagtcaagttgagtaatatttttaacttactcttctcgactttgaaagagtgcacctgtgaagaaatatctagggcatagatatttcctcatctctctttatcatcttgctttctaccatgttggtctgcatatggttagatgaatctgtgtgactaataccagggcaatcttgacctcagtgtatcaacttctgtgagcctgtcttgtctaaaatgaatttggctgagttatagagcctctaagaaactcttaccagaggaaggaagacaaaagtttgcggtgggaaagtgaagaggtcaaaaaaggagctagaacttactaaataaacattttagcatatattatcaatataagagtaacccaggaaaatcattgttatggcttctatattcttgaatttagtagtaaaaataatttgattttggcttaaatgtaatgttctatttcttaaggtcctgtttctcaaggtcccatttcttttcactctacttgtcaagttcaagaccatttaaaaaattagtattttgctagtacagtttattaataaccatctcatttaaaagatagagatatatgtcaggtgcactcaactttatgtttcagatcaccttggatactgttttagcattagtttaataatttttgataattcatcataaacttccatcacagatattagcataaattctacaggccaatttttttaataaatccttgttttacctcatcaagagagaaataaagagtgagagaaaagtgaaagagagattgagatggggtagaatccgataacattaaaatttaagggaacatgcctgctttgtgtgtttgtctgtttggttatttccagaaacataggaatctcagtaggagaaattgagtataatgttctgtatttaagggatgcagtttatatgtctttttggtcaatacagttattccctttattcagggggatatgttccaagacccccaatggatgcctgaaccacagatagtagtaaaccctatatacactgtttttacatatatatatgtgtgtatatacatatgtgtgtgtatatatgtgtgtgtgtgtatgtgcgtgtgtacacacacacacatacacacacacacacacaccatacctgttgatatggtctggctgtgtccccatccaaatctcaccttgaataaccgtcatgtgtcaaggacagggccaggtggagataattgaatcacagggtgaatcacttgagtcaaggagttcaagaccagcctgggcaacagggcaaaaacctatctctacaaaaacaaacaaacaaacaaaacaaaacaattagccaggtgtggtggtgcacatctgtagtctcagctacccaggaagctgagatgggaggatcacctgagcctgtggggttgaggctgcagtgagccatgattgtgccattgcactttagcctggataatagagcaagactctgtctcaaaaaacaaacaaataaaacgaaataacaacaacagaaaaaacacttgtcttacatcatgtccggaattgaaaacacctgtcacgcagtcaaaaactagattaattttctatgtggaatatagaaaaagaaagaagttgaagtggaaaatctggagcaaaatatttatattgaaataaaatctgaacatttttttgaaaagatacactgaaatttactacacaaataagtcaaggctctctctaaagaatgtggcatataatttttgtctttagaaagtattagaagcatggtgatggctgcacggcctccacattctctgcgggtagatgaaatcttgaatttaggaattcaagcagatcgtgctttctgcccttagagaaaaggtattacatgttggtaactgaggtataaaataaccaaagcccagatctcgtctcgtgctccacggaaatcatgcctcgcccgagtctataattggctgaattcatttccaatgaatgaaatgcaaaaacatggaaaagactaaaattgaaattttataatttaaaagatttaaactgtgaggatggtacatccttgacctagagaattttgaatctgtctttggacaggtgggcaaccataggaagcaagtaggtgtctggagatggctgcagagacatcccgtcccctcggtagcactgattgcattttccatgaaggttgctcttaacttcaaagcagacactctgctgtgaaggttctgagaggttagttctgggtctcgttgtttcaattaatcatttattcaattaataaattttgagctcctgctgtgaatcaggcagtatgctaggccctgtggctacaatataggcatggttcatgttttcagcaaacgacattttactgctttggtaaaaataacaattcatcagaagaaaggctatatactaagttatagaacagaacagaagtaagaccctccaaaaaggaatgtgaatatacaagaatggatatgaataattttccaaattataggttcagcttgggtaaagaaaactgtgggattagttacccttgctttatgctgagaactaagaaaaaataaaataaataaaataaaataaaaccgttcatgttaatcctttctaagacaaacatgcttttatattctgattttaattttccatttgccaatgaaaggctcttagatagcagttaaaagaagtatataaaaattaaaacaaaaaagaaattattcctaggttactaagtatttaagagctacaaacatatataaaaactaaaaaatttgttgtaaagtcatttgaaaaggagtatacttatctgtagccacctaagctatatcttagggcagagtaagcacagcttgatcatataatctggaaaccagaattatgttagcctcataaagtatttccaagtacaaagagttcattttctttgataaaacaaaggagagatacagtaatcttatagccaaggcaagcctttggatataagatttttaaaagcttggagaaaattattttattataataaaatcaattattgagatccactgtatttatgtcacttcttttagagttacatagaaattttaatctttgtctacaaagaattacactttaaaggaacaatttcagtgtaggaaaggttaaccgatgaaaatatcatatatttgggaatgtttgcttagataaggacatagtattcattgtttcctcatttgtaacatatggtggtttaatcagtattatctctaagtttcctggtaacttgaacactaggattctttaaaccctaaggaattagaattcaaattatgacttgtgtgcttcctactatataattgaaaagttaaaccttgcttatttactgtttcttaaatcattacatatgtgttacgtcttttaagcggcttttagtataattcttgtagattggccttgtaggtatgcctgtttattttctttattctttaaattgggtatttatagataattaggaggtaagattaattacaatttttcctttaaaaacctacttttatgttcactaattaaaaaatgcatattctttatttcttagtatatgtagactatatttttctgactttaaccgagtttggcaattttgcatgaacaagcaagggacactttattcaagactattgcagtaggaaaggaaggccagaattcagtctgagctcaactccactgaaataaaaggcagaaatgttcttaaaagcagtggtgggggaatgttaagccataggtgtttgttaattgtctttaccaaatggaaaggaaaactttctcatatcttccaggcaagggatggctttgcaacttggagcaaggtacccctgaaacttaggcttctaccctccaaaagacaggggaataggagctctatcttccttaatgatgacatttcaaaaggatggctcccaggtccttgagaaagacatttctggttataaaactgacaagaagcttttttaaagatttacatttcaaaggaggaaatattttgcaattacaagttttctaaagcaaatgctctaagaaaaaagagatcaagggcctagaatcaggaagcagcctgtctaaaatttagtcaagctgaggggaatgtttagtccaccttggccaatatattagcctgtaatttaacttttttttcgaggtcctgtgattgtgggccttctgggtatgactcatttggactcttggagataggaggaacagtagggatgatgctttgggtactctcctttactctgctatccactatttatttcttgagaagactttgtggcctttaaattctataagttgagtagaaattaaatatttattctggtaacaaacaatgaaaatgtatcttaaatcagtgagattgcatagaagaggattatcattgaaacacaattattaataatatttttagtactttttttagaccgtaaacatgatggggaataaaaaagagaggttgttatattacaaagataaataaattcaaatgtaagtcaagataagcaactacttaaatagaatagccatattcttctattagctgcttcttaccttccaactgaagttaaaagagaaacggtgtttatgtgtcattttagtaagaagactgtaataattacaaattacttttttccttcagaatcttctcaacaaaaagccacaatttctggaaaattctatagtgtgctataatgctgaaaataattcagaataaatttgctcataaaaatgtcagtaagaaaagctaactggataatttttatttctctgaaagccagagctctctaatatctgcttttgggatgctgcttagggtaattaggtatgattttccagttacttggggacgagcagatgtgactggtattgctgagatcctaattttatactgctaatgcaatgcttaccatacaaaggcatgtgaaggtgagacagttaaaagtcgatgtaaagactggaaactgggagtctttgtactatatttaaaataattacaactagggctaaaaataattttatctttgcatttctcttttttctttgttttcatccaccattcccatagcacctgaattctcagggtccctcctctccctttccacccttttccttctatttctttctcttttaacacagcttttctccaggaaaataggacacagaaagaacatctacctgcaaacagccatcagcgagtaagtccagatcatgccagtattcagtaagccatgtctgacaactcaccctttcctctgagtttaataggataaagctagtagtggaatagaaattgagaaatgtggctctactgataaggaaaccttgtcataaagtatgaattagcagcggttgagcagatttacttcaggagtgtttcactgctattatattgcctgttttatcctttggcttctatggacatatcatctgagataatgaccctccatctatttgcacaggtgcaagtaaaaaggtcctaaaatggacacacaaactcacacacatgcacaagtaagcatgccaagcatactaaattacagaaacgaataactcatcaataaagcaaatgttataaagtcctgtgactcatcattcatgatttactcataacacaaattaaaaaataattttgaaataagttgacagattggaccagaggataaatgtaggctatccaggaagtataactctgtacagtaacactaaaggaacagctgccgtctttgtgtagctcacacacagtctgcttttatagaccctaatgaggacaaaaccgattagcagattagaaattgacagaaatcagagacactctgcttaagaatcactaaagttggatagtatttcaactaatgctattctttgttcatctaaagatttatggaatgagtgtcttatgtataaacatctgcctcttcagggaagcatctgtcatgcagccaccaaataacatgacagaggggtactgtgtgcatctgaagagccttaagatctgtggtattgcccaagttcctactgcagattaaaacttttaatcaggtagtttttaaaaaaaataaaataaacctagctcataaaatgaactgttgaatagtttaatgtaaaagaaagcatttcaaaggatatttcatttaaatgcaaatgtggactatgagttattaaagagaatcgagttttcatattcttgtttttctagactcctgggatcaaagtcaccttttgaacttgcaaagtaagcttcaaaacttctgtcttactgttaggatttaagtttattgttttcgctattaaaagacaaatgctatctgaagctttatctgcagcattaattgtcccttaaagacaagggaactgaattaacaggagaaagggtaggactctagaacatttaggtcatggctttggaatcagagctctcagcagtttcatgctttgtggataattaaaatcaatacaaaataattacagaactagaaggatctccagatacctaatccagtcccttgtctccaggagaaactagatctagtttaaactaacttccacacagatacttgagttgtatgagagaaactgggactctagattcactttctgcacttaccaagaatattgcaaatgtggcttggtaaccagtgttcaaaaagagattatggtttttataagcatgacattggcatcatgaaactatcttctacagtctcagatcagcaatggaaggcaatgatggccaaaataatattcatctttcacactacatttatagagaaattagggtttctgacaatgccctatctgctagcttgtcttctcatttttagtgtatcctgtcttatcttaaaagtttagattgggtgctacatcctccatgaagcttaccaatctcaattcttattggttattttctttttgattcctttatttaataagactttaggatatatacataactctatagtaaaaatatagatgaccatataaagcagcatttgccatctctctacttaaatgaaatgtgcttaaatgctagtccctggagcctaacagaatactctttacttagtcactactcaaaaaatgctggttgatgattttttttttctaaatctggttgaaattaattctctttattattctgttctcatggaagatgaggacaagaatgagatgtattgagtctcctgatttcaattccctattccaacattatatttctctttataccattcttaatgctcctttttgttatgagctcaaacatcagaacagagtgaaacaaatatatccaagctccattaactcatttctttaagtaattttaaagagacagtgacttgcctattgcccagtctacagtgcagtggcccaatcatggcttgctgcagcctcaaactcctgagctcaagtgatcctcctgcctcagcctcctgagtagctgggacaacaggagactgccaccatgcacagctgattttttttttaattttttgtagagatggggctatgttgctcaggctggtcttgaactcttggcctcaagcatcctcctgcctcagcctcccaaagtgctggggttaccagcatgaaacactgcacctagtcactttaagtaaaatttaatgtgacaaaattactttgcaacataaatttctggatgactccttggagtttagttttatttttagatacattttcttcctaaagaaaaggggcatggttatcaaagcattttgtaaatcagtagaattcaacatgcctaaggtaaggtgtcgagttagattagtggactagtacaacaatactttctgtttcagaaaggtcaacattgaaaacgtatgtgtgtctgcattactgaattgaattggcgaagttgaatatttaattgtgtgctctgtgagaataactgcagtgagatacatgtcctttagagcatttctttttttctttttcttttctttactttttttttctttttttttcttttttttttttttttttgagatggagtctcgctctgtcgcccaggtggagtgcagtggcacagtggcgccatctcctctcactgcaagctctgcctccccagttcacgccattcttctgcctcagcctccccagtagctgggattacaggcgcctgccaccacgcctggctaagtttttatatttttagtagagatggggtttcactgtgttagccaggatggtctcgatctcctgacctcgtgatccgcctgcctcagcctcccaaagtgctgggattacaggcgtgagtcaccgcacccagcctagaacatttcttaatagaatctacacacacacacacacacacacacacacacacacacacacattatgtaatactttagaagaaaaagatggatcattttcattgttagagaaagtcttaggaaaattttatattttacatctactgcatgctttgcaaaaatagaagagagcttttaatcaatagtaacattaggcagctatatggaattgcatcctatttcactgaatcttgtcattcttgactactggtcaaaatgaaagactgctattacactattacaggaaatgtttcccattgattgttatttctacaaccaacagtctccaccatacttttctatattctctgatccacatcttacatttctttataaatgcttcttcttcctccttgagctaatagacacctggtcagttcacctgccaaaaacacaaggcatcccaagtgaggctattcatttcattacaccagttgggggtgaaaagagagggaagggctgaaaatagggatgacattctcctcagtttccattgccattcaaggaccatcactttcctcttatgtaaaacctttcctctgcacacacatcccagcactgtcttctaatcattgaggacactggcatctggcttactattttccttttggcctcttttgtacaacttcattgtctttgtggagaacccttcaatatgccaacctcctctactgacattccattcagcaaacatcgtcaaacctgaggtccaaagaaaagaattaaccttcatttgattccttattaaaatctctctctccattcaagctttatgtcctttaactctttatgtcctttaaaattattcattgaatcctccaaaacaacacattactgcagacaatgactgcttcccatgatcacatgttcaatcttcttatccaggcattcaatgaccttcaagattggttcttaacctttgtctctagacattttttaattacttgcacataattataactaatccaacgattctccaaatatgcctaacttttcagactccaaatctttctcatggcctctctccatctttccaattctcttcctccccaacaaccccaaataatcatcccctttaaagcccaaatttccaggcattccatgacctttccatgtcaaagcgtccatgtccttctctgaacttctgcagaattgtgtcccactgtctgaaagcatttactttcttgctctgtggttacctatatatttatctaagtctccttaactacttggaaggtagtaccagcttactgtattagtaaaatagggtattagttcagtctctggttctaattagttcttctgacttatctcgccatccgtatgaacaacagttgtaaaatatattgcctggaaccagcttccacttttcctgtacttccaggctgagccgagggtcgacagaaaggaaagccattcagctctggggtcccgacaagttggttgaccctgcagccatgagcggaactctcaaagtcatgtcacccaagtgagaccatgcaaagataactggttacagtgctttgagttctgtatgtgttctatgaaatcatcagtaaaactgaccagggctttcctatgtttatattttccacatcactctctgtatagtagtctaataatagtaaatattcaatgagtattcattgactaagaagaagatatttactacattcttttgtatagagcacaataatttataaggggtttctaatccattcaagtggctagttcttcggtcatctattacttcttttatcccatctgtggttggaatttctcatggagtctcattgtgttaggctgttcttgcattgctataaagaagaacctgatagtgggtaatttataaagaaaagaatttaataggttcatgggcccgcaggctttataagaagcatggtcttggcatctgcacagcttctggggaggcctcaggaagcttacaatcatggcagattacaaaaggggagcaggcacctcacatggtcagagcaggagcaagaggtgaggggcaagggaggtgccacaagcttctaaacaaatagatttcttatgaactcattcactagcttgaggacaataccaaggacatggtgctaaaccattcataagaaatctgcccccatgatctagtcatctcccaccaggccccctctttaacactggggattataattcaacatgagatttggcagggacatatattcaaactatatcacccatctcacaggccacagctttagcctatgtcgaatactaaaactagtagaaaaagcatggcatgtcagatttggcaaaacagatttttaagtaatagtgacaagtcataccatgttacaatgccatgattgctttgaaaatactttgcaaaacttctcaactacaattcatcatatggttcttgtaccttgacaatatttccctgataaaatgacataaaattggcattgttactcaccattgacaagactgcatcacatgatccatctggcttgaacctcatactaagtcagaagttacaacttcttcctgttgaattagttgcatattatcactaattttgcataattatatgtgtttctttgaatgatgatatctcataaacattgcaatttatatctttcagaaacttataccttttggttgtatatattgataaataatatttaaaattagtttattcttataaagatttcagaattttaaaaatctctgggaaggaatatacgctaaaagatgcttaatgttcagtgtagctgaaacatatacttagaggaaggtttttctttttaaacagttaaataatggtaaattggcaagtaccatgccaatcccccttcttgccatgtgtagtacagcagtggtgataatgttagcgattagagatattaattttatttatcttttttcctggagataaaggcttagtaaaagatgaaaatatttcttataagtaagttactacaaacaacttagtttctatttaaaaagtggaaaaagcttctaactcagcctcaggacattaattttatttgtgtaccatctaatatttgtaagtggacttcattttatcttgggagttcagaatgcaaatacaaaaaaaaactcctggggggaaatgcagttattaaaaactcccttagagaattattcaaaagacaggttactttatttacttcaataaataaagtaaaagaatattgtgatcacaacatgaaagaatgaaattaatctgtatttgttacagaacagaaataaaattaagttgtaattaattcaaaacagaaatatgccttatttgtaattaccttatttgtgacagcatttaattattcctttaaatacaattttggagaaactaaaatttttgactaaattttgattttaatcaacacacacacacacagtgtagtcttatgtcataataactgagattaatatccagtatgcaaaatacttgagattaatgtagaataattttgaagcaaaaatgtttttccctcagatgtgggacatgattcagcatttgatacttaaatttcctttgaaatgttgcagagacaaactgtactcaaactcaaataagagcaatttccattattacataccaatcctggaaatgtgtgtgagaatgacaacttcaatcaccaccacatcagtttgccttccttgtcgatttcttagtaaaaccagtttaaaagaatgtgtagccacaggtgtgtatagacaaaactgaacttataaataacacagcaattcagctgtttttttgtttcagaataaataagtaattatttcatttttacaaattatttctaaactttaaaaatataaatgcaccttaacttgattttttttcttacctgagcatctgtgaatgattaattggatttttagcctaagatattctttcatgtatgattttctttgtaggaacttataaagctatgcacacatatatataatattacacatatgatatgcatatgttatacatatgcatatatgtacataatatattcatacatattttacatttatattatgtgtgtctatatatatatatatatatacacatttctttctttctttctttataaaattacacaattttaggttaaccaatgatgtgattaggcaaatgttttcaagccaaacctccctcctctgttcagaaaatgagattagcagtgcttatatgacacactccttgaatcatcagtctttggtgctaatttagtcaaattagggttatgcttctttactaatgtagattttgacaatgtaatccaaagacatgaatctcgtaatattaatgggaagtcacttccatttgtagagagagtaaagaatggacaattgtgcccggtccacccttattcagtccctgatcctcaaccccatagccaacatgcctcacacatatcctacctataatcgaaggcagcccttcttggttttaccactttttctaagattctttagccttgtagaagaaggtttaagggggaaataaaagaagtctagttcaaaatatccagtttcctcttcaatggcaccactcaacctaatactgttcaaagaaaaattcaggaccttttctttcaagcagtaacatccatgagaaaattttaggctataacacagtgataatattgcagctgattaataacacacaaatagttatatattagagaattcttaaataaaactcctttgtttttatttcaataaaatgtctttttaaaaacatttaaaatctgaagtaaacatttccaaaagatcatctcttccaatgagggaacaggtttattcaggcctcaagaatttgaggggcatctggtgaatgccaggtgtcttctaactgaagatacagcaggaaacaagaaagacaaatgtcttgtctttgagaagcttatgttctagtcatacgtaatggataaaagcttgtatttatggctgggcacagtggctcacacctctaatcccagcactttgggatgcctaggcgggtggatcacttgaggtcaggagttcaagaccagcctggccaacaaggcaaaactgcatctttactaaaaatacagaaattagccaggtgtggtggcacacacctgcaatcccagctactcaggaggctgaggcaggataatcatttgaacccgggaggcagaggcaggagaatcgcttgaacctgggaggcagaggttgctgtgaaccaagatcgtgccactgcacttcagcctaacagcctaagtgacagagtaagactctgtcaaaaaaaagaaaaaaaaagaaaaagaaaagaaaaagcatgtatttataaaacctggagcaattcttaaacccactaaactcagtaaatctatagtgcctataacattatactaaataagtaataaatacttttctgatgatacacgtactcaccaaatgtaatgaccagagaagatatgtttttagctaaaatatcctagctttgggatgaacagtaggagcactggattggatcagaatgcagtatacacatatttatttcttatgagtctgcctcttagtaaaaagtgtattttatacctctctgttttcaaaaacacaccaaaacccaagttttgtttcctcaaatgtttaatgacatttatttattgtatctgaatgatttattatgatattgtgatacagcatcacttaaggttgtttggatttttaaaagctattcccaaaagatttgcaactactttcccctgctatcttggttgcttcctgttctcacagaaatgtgaatgatgtccctcatgtattgcttatttcttgagcttttaggtacaacttggcaaatataccaaatgatagagaggaaaaatgaaggtatttttacattgaaaatttttcactggcaaagctcttttcctgaaggaaacatcactcatgtttaggctagattatgtgcgcatcgtgacctagaattggaaacccagtggctactgaactgggggctcctctaaagccaaaccaaaccatttgagcaagaactatggactattcatacagtttatcaaatttagccagatgacagagacagtgtctgacaaaaggttgaatctagtaaaaaaaaaaaaaaaattcacttaggataaaatgtctaatggagattaaaactttaaaatatgtactaaattggtgttccccaggctgttcatattctcagtgcctacagaatacagaaaagctagaaatagctaatgtagctttggaggataacagaaattttgtttggttttgttcctatgttttcttcaaaatgttgttattctttatataactatttaggttattttaattggtttaaaaaagctcgagtctattccaggagggattgtttaaaaaaaaaagatagaatttaaaaaggttgagtctctacatggatgagaaaaaaaaagccaatataagtcttttatataaaccaatctcttaaaacattttaataaatattttattttaatctattaaaatcccttcatagcccactaacattctaaaataccagctatagatttcaagttcattttttagaactttgaaagaaaaatagatatattgcataagaaaggtgatgaacttaataatagttatggaaaaagatacaaatataacaatgaaaggtcctgcagattaatttaaccatttaattaagaaaaagagagcactattacttaggtaattttttaaagtcaatattactataactcagtatattaaaggctttcaaaatgaaggaattagtcatggaatagtgttttgtataattaatgacatatttaactttttcatttagtcatattgctatctttactcctaatcaaaatgcaatttacagaatgtattatttcatcgagaaattaacagctggcttgtaagaaacatttaagttaggttaattactgccttttaaatttgtataatatactgtgacagaaaattaatgatgctcacactatttagcatagttcataacccatattttaatgaaaatatactattattagtgatatacatgatacagatataatacactctaattgctggtcattttatgtctgttctatataattctataaaatgaagccatattcattctgcttattaatttagacttcacagataaaaatttgcatttaatatattcatgtgtatattggattatgtgaattttattaacctaaggcatgacaagtggggtttgactgacagtttctcaagattctaatctggtcaagaattcattttcctttcatcttatcacagacatatgaaaatcttaaactgaacacgttagcattttaagtagtatccattttcttcctgtgcactgtgccaaaagtgagataactacttgcatagtgtccatggagaggtgtttccataacatgccctgataataaatttgtgacaactccagttctgctgtctcaaatgtaagtttcttacagaagcctaagttaaaatctctttctttttctgtagcaaaaatcaaggcctattatattatattatattatattatattatattatattatattacattatcaactaccaaatttaggtttcttgaattgggtcactgctttctttagtcatactaagttcagtgatcgtctttatgccagttgctagtgattggctataggacttctccaaacaaggactacaattataggaaagaaatggtatacctctgagctaatatgagaacacatattttttgaaccataggcaaaaaatactagaaaaagtgccattgtagttgtaccatagaacataattttagaaatataggactcccgtgaaatacttgaagaaaatttgataaatatattgcatgaatagtcaagatggctatattaaaatgggtgtgaaataaagttttattacttttttaaagtaataccaactaacttctgtgcaggtcaatgataacgagtaaaatatgtctactggtttcaagatatttccaagaaagtttagaagatgtgagttctcacaagacaatatagctcattaaaaaaaaaaaaaccttaaataatatccagtttaagagatttcaaataccattgcatttataattcactttgaagtatctatattccagaaaatcactgacaatggcaaatgtttctgagtcattgctatagaaaatatccaagatgggttattgcagacataaaacttcccctaaaagaagagaattcaaaggaggcaagtaacaaaatttatttttgagtgagaaaatatgacagattttcaaatctctcattttggcttattcagcatattgagaaagaagcatatcagagaaacagagaagccacagaggatagtagggcagttccatcccattagggtgaaaggacaaacaggaaaaatgtgaaactgggcaacctaaattctattggattatctgaactatgaaaacctttaagatatgcatttctaactgaacaggaagagtaaataaataatataataaatgtttgtacatagcagcagaataactttttttcacaagttacaaatattttagcatttttctgttaacccacaattctccaattattttttcaaaaacacaaagaaagtaaaagcctccctggaattattactatatactctaaaagtaactgcaataatcagtttggtgtaaatcccttcagacttttggtagtgcatgaatatgtatttttgcattaatgacattttcctataacattttgctatagactagattttcattcagtcatgaggcataagcattttatatcattacatatgaacctaccttataattttgtcactacagtgtttaattaaataactgcatcataattcaattgaataatcctttttgaagtatctttttaatacagtaatataagccatcatgcaacatatgtaaatgaacaatcatgcaacacacacacttctagtggaatttacatttttacacagtttctaataagcctctgtgatatgaggggaccagtttctgtggaatatataggaactgccagggactttttcatatataatttcataaaatcaaaacatttgtttgtagaaattgtgagcattgttttacagtagaagacaatatgtttcaaagaagttgaaaagtttgttgaaagacacatacataatatacggcaaaacaaatcttcaaaatcagttgtgtttggatgattccttggtcattccaggtcaacaaactgcaggaaaggcactttaaatgtatgtatatttatttgattagatcatgcttttttaatcagatggtttgagtctcaaactgttttccttaaccacaaatctctgatttgcttttctaaacagcacaaaaattgtgctgttctgattttcacctaacatccttaacaggaaacctggctgttcagacaaaaatggagttgccatagtgctctagccaaaagtatcagctcaaaaattgtctcagcaggaatgatgggtttctatatttctacattttaaatacaaattgacatcacccatggacatcaaaaataaaattttcccatctggtgcatattatagtatattggaactaattggtttggttggaaaatgaggcaatcctctacataaatgaacgtatgtattctctccagagtgatagtcaagtccaaactctcagtatatggactaaatcttttttcctaattcagtaatcccattgctttcataataaatccttacttgtaactttttaaacaactattttcttttcttttgagtaaaaagcgttctttacctcctaatacgtcagtctattatgggatcaggaagtcatctatttatttattaaacaaaacttatgaaacaattattatttcctagatttatgctagactctagggatataaaaacaaattacacatagaatcaatatcttcacgtagtagttaccaatatagtaggtaggaaagttatatgggcaaggaattgttataatgtcgactataaggtgaaaatatagtccaaagttcattttgagttataatacagaagacatatgaacaccagtgtaattttggtttccaggacaacattaatatggtatctaataacataaaaatgttaaagtaattggaatactccaaggtgggagaaatgtaccatttaatatgtgatgtcaatgtgtaattatgcaaagaaatacaatgcctggttaacagtaatttaaaactctcctagtctgtattttgagtcagtacagtgaacaagttagtcaacctaccagtgagcatgttaaaagccagatgaatgaccagatttttttgttcacctgagtgggtattttgccattgtctaatcgcaacctccgtgcagctcccagtgatttggctacgtgagtgctttctggagcttatgtgtcattcagggcatctctggcgtctgcacttctgtctgttctaatgaccacactcagcaagctccagctttcgaaggagactccactaattagcttagtcggcatagcatctggtaactggttggtgggataaacagaaaagactcccgaagtgaaggatggaaaaatgaattctccaggccatgaagagcaaaatgaaattatgagcatacaacccaaaaccatgaagaagcttgatcatttacattagccgcatctgtaacattgcctggcacgaaatcctgggccaaaatggagataattggaattatgcaatactcagcgcttcagtttggcatcagtttcataatataataaaacttatcatttgtaagcctgtctgctttttcaaaaaaagacctagaacaatttgatctgtcctgctacagcagacactgatgcaggtggtttaaaaacaaagcatttaatcaggcagggttttacttaaactacttgatgattcatcatccagcctctgctcattgtcaattgtgcctctctgagctattatttatagaatatttaaagagcctggactgcatgtgcctctgtcttgggttctattgtactataaattataggtccagtttgtttcaaattcggcatggactgtcaggataccatgactcatcctctgttcagatgaatactgtatatggctaaagcaaaaagtactgttgttactattaatttataggtaattctggaatattcctagactacagttttgtcatgttttaggtccacagaatcactctattcctacattcccctatgttcttctttccacagggtaaaaataaatgagtggctttatgaccactatgtaaattctggtcttctaaatggccactgctaaaggaggttgttcgggatgacacaaccctttctccatcatgaaaacagaccaacttttcctaagtagagactgcatagatttattgaaatcacattctatatgctgagggatttttgttttgttttgtttttcttaagctgactattaaaaacaaagtaagccagaattagattaaagaaaggaaaaattgacctttaatgagaaaaccaagagggcaaaattttttgtgtctcattttttagcactcaataattgcaattaaatattcagtttacttcatccccataggctccttggaagcagaactgtctattttcttcatcactgtattctagcctttaacacatagtaagggcacaataaaaagagcggtggtaggaatcaatgcatgagtgaatgagtaaaagacaagttgtgtggctagactattgtgagtctggagaaagtggatttttttaacattaaaggatgagaataggaatgaatgatatagggaagagatgaaatggatatgtttgtatctggtctgagagtccacttcaaaatgaacattccctcttcagagcacccatgcattgctcatgtgctgctattgcacccatcacattgatttgttatagctcctaggggttacttagatggattagttcacctttttatttccagcatagagtgtggcacattagaagtatccgaagtgcatttatgtatacactgactcatactggatgaacagtatcatcatcgcccaatcctaaagtcttgccccgtttaaggagctttgaggtattattgtcttgaaaactcatggaaatggaaataatgcacaagaagcaatgtctgaaagagtcaggcattcagcaaacacaattttttgtaaaatttgaaaacccaaaccacagtatgacattaagaaaacacaaatattacttagccaaaagaaaaaccattttgaaatttttcataaaatatttagaaagaaagaacttggagcctggagcagtagagtgagaaataaggaaggaatatgtgggagagaagagaaagggaaaagaaagtgcatcagattttttattgttattagcactaaactggtttgctttgggcccttagccagggttgctttttaaaactatccaaatattttttttaaaaatcctcaatgatatttatatgtctactaacatttcagttgtttttatagggtcagtgatattaaggcaaattattcagattcacatggtgaacaaaggcacttcatagaattcttggactacttagagaatcagagagatactttctctagctgctacttcatttgtggccttagagaaataatgcattaatctccaattagatcatgtcatctttcaggatgtttagctaaggtgaaatgtgtaattaaacattttaaattgcatgtcacctccacccacagggttgacacatgttttctttttggtatagttttgtgtaaggattcactcagtatatccagaagtcaccttgaccatgaaaataaatctgctgcaaattacagcctcacaattaactcaaacattatcatctattatttgtgttctctgacttgaggagcaggtatttgatttttttccactttttacttattaacataacttttatatttgaatatatagtaattttttaaattaccaaaatgatagcaggtattaagtgacagtcttcagaatgatcctatgtggtaccctgtgtagcttttcttataataaaaatatacatggaacatcagagagagagagagaaagagagaaagaaaaatatatgtaaatatctttttaatattgagctaatttaagcttcatcagtttgttgtgcatatgatatttaccctacagatttgttttcaataatggtatactatgatgaataactttaaatagaagtatttttcatttagaactttgttgaatattagcacatgagggaaaaataaaatatgtaactcatctatctgtgtaaaataataaatgctagatctaaaggagccatttgctaaaatgtacttaaacaaatgcatattgcctgcattatatttctctactcttttattgcactattagtcagaaatttaaattctatttttgagcttgtgattatcctgaatactaagtgaaagggaagtgatgatggaatttttattttaatgataacaacagttttcaagggagataatcaaaatctttttctgaagtttgaagatgagaaaactgtgtaaatccatctgctgagttcatgtgccttttgagatttgcttttctgtcttttaatttcacatttctggtttttaaattatttctcctataaaagaattttttgatgtcattaatgccgtttcattttgaaatgacggttaaacagagtttctaataattcaacagttctgtttggttttgtacaacatgttatattcaggtgatatctgaatgatcaactggatcaaaattcagaagacaagaaaagcgttgcttgatcgattttcaaacacacattcaggttttgtccatagatcttgaatgccataacaccagttgtgcctcagggaaaagcatatgcttacttgtcacatagatttttagttggtatgttagaccatttgggtcattataacaaaataccttagaccgggtaatttataaataacagaaatgtattacttacagttctggaagctggaaactcctggatcaaggccctggcagattctgtctggtgagagcccattccttatggtggtaacttctatatgtcttcccaccacagaaggggtaagcaagcttcttggcctcttttataaaggcactaattccattcatgagggcagagcccccccaaaggcccacctcttaatgccatttttggagacacaacattcaaaccacagcaattggttttagtgtcattgaactacaagctttataaggaccagaaagaaacttttttttttgcccttaacctaacagttttctgggtccatgcgttttattttctgccaagatatttgtgtgtgtgtgtgtgtgtgtgtgtgtgtgtgtgtgtgcatgtagagagagagagagagagaagcactcaaatgcaatgtctgcactatcaattgcattttcccctatcttttgaaatttcaagttcaaactcgtagtttaatatttttctttggctgaaaataaatgagttgatctgtgtggaatggggtgataaaagaggtcaaggtgtgtgggtaaggatggaaacttctataatatgaaaaaatactgcaatgaaggtgcagtatgagggtgctttacttctctattgaacacagatactttttgaatggaaatgtggtatgtagtaatttgggagagagtatcttagtaataatggagtaccaacattgacagaatgactggtatgggggggcagaatgtgcatttaataaatatttcacaaaagtgcaataacagtctgagaaatacctggaacattttaacataagatattaatataaaacacagacaaataatctggagacacacttattgagtttgaatcctagctcttctcctttttttttccatgatgggcaatttgtttaacttccctgagcctcagtttcctcatgggtaaaattggggaaacagtagcatctatttcattaaattgtcttgatggttaactgagttaatatctctctccctacccctgctagaaagaaaacttgaggaggttttaacgtgtttcaggaatgtggcccaaacacctgaaacaatgatgaaaatcattttaaacttaaaataggcatcaaaaatgaaaaaaaaaaagtgtttattgtcaaaaataatgacatttgtgcagaggttctgtattttagtagccaattactctgtaatatttattgagatttgactccgtatatataagggagtttcaaaaagcttatggaaaatgtagttaaaagataaaattaaaaatataaactttatttcttgacataagttctatcaagttcaagaaacttttgtacatgaagaactaaagttcctgggaatttaaatgtactctagagcagttaaatggagtctatttttcaaaacccatctaggccataaagcctttcctgacttgaaaaagaaagatcaaataggacaggagccccacatcagtgatttcaaggagaatgcacagcagagtgaatatggactatatcctttgtccattttatcagaggactaaggagataaggtcagaatcagaaaaagatttgctgttgaaagtcacatttgttgattccactggctgtccactgtttgagggagactgatgggcaaacatctgcttagtttttctatcaattgtcaatttaccggaaaatatacccatgtgccttgattattaagaagaacacctaaaaccggtcacagtggctcatgcctgaaatcccagccctttgggaggcccaggcaggaggacagcttgagtccagttgttcaaactatcctgggcaacatggtgagagcctgtctctattttaaataaagaagaagaatacctaagaagtagttactttttttccctactttcattttctccttaaataaaagtgctttctaagtattttaaagaaaactcttctttctcatcctgcctcttgctgaagcacttacgacgttcaaacattaagcataatacttacattatttcaactaatacaaaaactctttgggatgaattttattgactttattttgaagctttaaaatgaactcagaaagattaagtaatttgtctgtgatcacacagctagtaggagagtagagccaaggttggatcctgtttctttttaaaggaaaagcttatattctttgcatttctttgggagtcaaatagcgtgctgaactgaatcactacatggtttttgttattgttactgttgttgttgttattttgggttgttaaggtcctgtgcacatttttttttaaacctggagatcttaatcttgtaaggtgttttcaaataatactcacaaaataagtaaataaagaaatcctacaaaatgtagaaaatcagtaacattataccaaattgtttggttcagaaattgcttaagactttaaaatcagttgacccaatctgtaattttatttgctttccagccttcagataattttcaaacaaaagaaataactaaaaaactttaatttctcttttcctttaaattcttgcatagtttcatgtgagatcatagcctgttataattctgttcaaactaatttttatggaaaaaaaccatttttgagtgtacttttcatctttctttgtgaagaaagttataagataaagatttatctcccttctccaagtgtcctttaataaatggattatgcttctgaagcccaggtagtttcaagcaacagcacaaacactgcacacaagagctgtcacttagaaatgaagtaatcaataaacacttcaaatttctttttaaaatttatttcacaaatccaaacaaaacaagtttgtctataagttccttgccatgtttttttttctttttttcccctgtttatataattcttatttagtccctatcagttatgttcaggaacaggccaaaatcaatcaaaacacaaacaaggccgggagccatggcttacaccagaaatcccagcactttgggaggctgaggtaggtggatcacctgaggtcaagagttggagaccagcctggccaacatggtgaaaccccttctctactaaaaatacaaaaatatgctgggtgtggtggcacacacctgaaatcccagctactcgggaggctaaagcatgagaatcacttgaacctgggaggcagaggttgcagtgagtcaagatcacaccaccacactccagcctgggtgacaaaagcaaaactctttctgaagagaaaaaaaaaaaactatgcattattgtttatggtgattgagttttattacttgcagctgtaatttgaaataaaggaaaccacactatgcttaacctcattttggatcatttacgcaaacgtggaaaactttcaagatctgtatagtatctgagaaaaatatttagagggcttacaagtctactttttttttgatatgtgaaaagatttcctacataaatattcttataatatgctaactcaaacttcattctttcatttttcagcaaattattcagtcaatccatttagttactttgcaaactgatagaaagctgtcaatatctacaaactgataaaaagctataaaactgcagcataagggaagcccatttgcattcagctgagtttaacttgaatacctagataacttctggaaatttgagaagctacctaagctggaatgcgcaaatgtagctacctgcttacctcacagttattgttatgaaataaaagactaaaaccttaaaaaaatacagcatgtatatacgtaatttatatatgcatgctgtattgagggaaactcgggagatgttccaaagtgttgaatcagctagaagaaagatttttttaactaaatatgtatgttcataaatatatttagaataaaattataggtaactgcaaatataatagcttaagatgtttgtttagagttactgagataatcttattttaaaatttgtaatttaaaagctaccttacataaaaatactgattttattttgcttcaaatttgttctttaatttttttgtacacatctgatatcacaaaaacattgtttatgaattggcactgctaccttaaaatgtaaatgagggggaacttcgccatagatatccattattctgttggacaattctagcaagagacacctaaaaaggaagaataagtcaaacatagaggttctagcctcttattacaaacaacagctgtcagggcttcttaagaatatgtgcccatcagagaaggctgctgagttcttctgtgtctgaaattaataaaaacgcagttgcaatgccagctatgtaagccagggaggaactcggtggaaaagtgagataacaggggaaatgtttttatgtctttggagctgtaagtgcatttcaatgttatgccatgatcagaagggccatatgaagcaattttgtttctgaagaattgtggttatagagtttgaactgcaggtatcagtaaacaaataaacactactggtgattttgaaattgatacaaagccaaagttaggaaaaactgcattccagaactgttttaaaatgtaatataaattcaaagttccaaaatttatatatttttaaattcttggttttttaaaattttaccgtctaatagtcaatacattagtgaagaaatttaataaaaatggcaactttaccactcatatgtttttctgggagttatgctggcttttgttttaaccccatttgaacccattcttttaggtagatttctttctaaacattggccttttcagattttctctaaatatgcatttcaagtaataacttgaatttcaggaattttttggtcatatttttctgccacaatttaaatatatacagcaatctggcaatatagtgacctgcaaaatcagtgctcatttcttgagtgaataagtaaatatgtttataatttggaaaatagaaacacttttctgactcaatctttatccctaagtttcccttatcttaaagaaatgccaaacaacaacaacagcaacaccaacaacaaaactgagttcctttagcatgaatgaaaccatttggtgagctaaatgtaacaaacaaatgttctcgcgtgcttcctgctctgggacatcccaggctcttgaagaggaccaagttcagagcggcaccatcagtgtcatgttatgaagggggctgcaggatccgcaggtacccaggaaggattctcacttacatcaatagggttagagatggcttctgggagatgtcacctggaatatggaacacttttgaaaattttcaagtgaaaaaaacttaacctagctaaaagttttaaagaaggacctaccatgtttttttcctgtagaactaaaaatattagtttatacttgaattgcaagaatgtctattagcccagtggtctgtgttcacatgttagcactttggagcatacggtagaggtggaaagcaatataaaactatcagaattgttttatatagcccaatatggctctgtcatccattaattttctaaagttttcttcaaaaacacgtatatattcattctacctttctgaagtagtttatttctgtactcaaaatgcccattgagtatttttttgttgctgtttccttaagtttgctacttcaagctttattttttttaagaaattttttttttagaaaaagtttctcactttgtcatgcagcctggagtgcagtagtgtgatcacagttcactgcagcctccaactcctgggatcacttcctacctcagcctccagagtagctggtactacaggtatgccccacctacccactggctaattttttgaatttgtattttgtggcgacataatcttattgtgttgcccaagctggtcttgaactcctggccccaagtgatcctcccacctcagcctcctaaactgctgggactacaggtaccagccactgctcccagcacattccacactttaaatagttcttaccctcttaaattctaatgatgcaagatttctgtgaccacgttcctattgaaccaattggctgctttcatgtcttcatgaaaattgatcatacctttttgtctttgtagaaggagaagattttatctttgtaactatgtctcctatagtaggttgatatttccctgggtcgcaagcagtatggcatataaacatgagaaggtagttatagaatacattgcttaacaatgagcaattcttaggcattactaatgacaacttgaaactatttaggcagaagggctcttagtacagataaaatgaccatccttccagaagatataagctgtataattgaactggaataattgttgaacatggtatccttttcttttctgcttgatatgtcatattttggcaaatggacataatcatttactaagtagctgatattatactttagcaacttcacagtgacaactttttgactcataagttactaagaaccaatcaaagataaaaggtaatattataatattcttacaattttttaatgtcacataattctatgtaactaaattgtattgagacgaatgtatcggattatgttgtttgttgttttataggtttcttctcgtttttgttttcttttgttgttgttttgctttgtttggcttggtttggtttgagtttaggtttgcttacttcagtgttttggactgtgctgacatagagagtctacacacaagtttgggtcactcagctaacttaaggaattatctcaatgaggctgggtatataatggagcaaacatacatatgaactatctaatatgattgttacaaacgttaaataacttaatacgaggtaaagtattttgaccactgcttggtacgcagtaatcattcaatagcattctttctttttttttttttttttttgagtcttataattaataatagcatcacttcgtgggtcacgtacctttgcttttctcttgtgcaaacttatcctttatagcctaatgatcaataaatattggacatcagtactagaaaactatctcaatgtttatgacctaattacatcaaccaagtgggtaaatttgtaaagagattggaccaattgaataagtatatatatgtgaggtgtgtgcatttccatcttgtgtggtgggggagagagagaggttggcctgtgtgtattctcattcgtaatctctataggatattctaaatctgagctgtcatttaaattatgttttaataatgtggctcataggtacaaggaatttgattaatcagaattggaaagaaaaaattgtgtagcttaacttgtacatctttgtttccctgaaatctactcaccatgccacagccaaaaatgatgtttcaaaaattcaggtctgatcaagtagaattgcccacccggcttaacaatttttaatgacttcctttttcattttattgtggtaagaagagttaacacaatatctctagaattaattcatcttcataaactgaaacttcataccaattgaacaactccccagttccccttgcccctagtctcgggcaaccaccattccattttttgattctatgagtttgactattttacctgtctcataaattagaaccatgaagtatttgaccttctgtgactgtcttatttcacttagtgtaatatcctcaagtgtcattcatgtcgctgtatattataggaattccttctccttgaatactgaataatattcaatcgcatatatatatatatgacattttcttatccatttatctgtattcttaaaatatgtttatcatagggaaaaacatcatgacattggtttttgcaatgatttcgtgagtctgaaaataaaattacgggcaacaaaagcaaaaatagcaaatgtgactacatttagctaaaaagtttctgcacagtaaaggaaacgatggcgtgaaaagactacctacagaatgggagaaaatgtttgcaaaccatagataatgatgggtaaatttttaatgtaggaactcctacaaatcaatagcaaaaaaaacacactgacaacccaatttaaaaatggcctaaataccagaacagacatttctttaaagaagacatacagttagctagcaaatatatgaaaagatgctcagcctcacaaatcattaggaaaatgcaaatcaacaccagagatatcacctcacacctgttaggatggccacaaacaaaacaaaaacaaaacaaacaaaaaaacagatgctggcaaggttgtggagaaattgaaacccttatatgctcttggtgaaaatggaaaaagggttcagctgctaaaaaagcaagaggaggcttctcagaaaattaaaagtagtgctattatatgattcagtaatatcactcctgggatttggtcaaaagaattaaatcaggataccaaagagacattagcactcccatattcatagcagcagtattcacaatagcaagatgtggaaataacctaaatgtccattgacagatgaatacattttttaaatgtagtatatacatacaatggactactgttccactctcactttgctttctgtgcttcagctgtccccggcacatgctcactcattttggaggaatctttggcattctgaatcatcctcctataacactttcccatccaggccccacccaactaatttttaatcataatttagatctcaacacaaaggctggcacaaaggtaagtcccaaaaatatatgtaggatgaatgaaaaaaagatgaatgaataattaattgaatgtgtattttctcagaggctctggaataaagtataatttgaaaagttttcattagtagtttttcctctatttgagttagttttatattagaattatgtcaaaacccaacttaaagcttccctttcttatatttcataatcatgtatctgaatgtttaagattcttagcagggtaacagagaaaagaaatcctttatgtgctactattttcttttaaaatttagggttactgcattaagcaggggaggataatacatactctctttagaattttggacgatttgagataaggcccaaaacttagctcactgaaaatggaattactgcacatatcaaaactacactgaatggtcacaattgaaatagtgaatatgctgcatatggcataaactattttactatttgtgctctaaagtgttataaaactgtagtcatacaaagatactaaagtttaaaaatcttaaagtaaaagaattcctgtaagtgttatgaccttaatcccctgcaactgtctcagtctcctctcacagcagtcttggttgtttagagtgagtaattgagacaaaaataattcttttgaaagaaaaaacatttgagcctcaaatgctgataacttttcttctcctcttagaagagcaaaaagaaagaaagatacaacctctgcactttacttttatatataacaaggttgttgtggtcaaataaatgtgaacagtttagaattctataaaattataaaatactgatgtaaataataatattttattattaactattattaatgcaaatatattctgatatgccactgaggaaagtgatacattttatgcacactaaataaaaataggcccaatctgacaatgagaaattattcctaatcttatttctaagctttgtaaaatttgtaaatttaaatgattcaaaaattttatattcactttaatcttcctctatttgttagttcctcaccatattggaaatcaatatttgttgtctgatatatttcttaaataatacgaattaaatattgtgagatgttttaggcctttaagagatatcatttttccttttcagtttatgaaaatgctagttgccattttatatgtacagattaggcagctactatgagcatagaacaataatactaagcaagtgatgcacaacctctgctctcctggagcatatagtctataatcctctgtttccagcttcctactgaatatttgtgcttgattttcctattggcatttcaaatatatgatatttaagttcaaatcaaatacatgtgttcccctcaaatctacatctagtgctaatacttacaatctttacaattataacctagtaaatcaaatatcactttaactagtctttgagggaaaccactttttgagagttttcacaggtgagaaacaggaggcttaatggggctcagccacttgccaacaatcacatagttaataagtcccagagctgacacttgagccaagatcggtctccaggccccattaccatcatgtgatactctctcatcaaagatctcatgttgcgtggagcctagtaaatcatcaaaaatattctggaataggcttggtgcagtggctcacacctgtaatcccagcactttgggaggctgaggtgggtggatcacgaggtcaggagttcaagaccagcctgaccaagatgttgaaaccccgtctctactaaaaatacaaaaattagccgggcacggtggcaggcgcctgtaatctcagctactcgggaggctgaggcaggagaatcgcttgaacccgggcggcaaagattgcagtgagatgagaccacgccactgcattctagcttgggtgatagaatgagactctgtctcaaaaaaaaaaaaaaaaaattattgaataaacgaatataattgacttttattaattcatagttcacatttttttactatatctattttctgttttgttgacaaggtagtgggaagggaccaacatttgctgaacattaaacatttacatttatttgtaatcatttatttgtttatttgtttattttttgtattatttatttattgtatttatttgttattatttgaatcgtttatttgtcatatatcatcccatcttatcctcttaactctaagattggtacccttatcatcattttaaagaagtgaaaacccaagaaattgaacaattttctctaggccagtgtgtgttaaagtcacacactgactttagacagacaattccaagtctgcctaattctaatgacttaaatctactacaccatcttgctgatccattttgcctagcaaactatagagagtagtttccttcttcacatttttagcgtttcaaaagatgtatggcaaacatttcttccatattacttatatcaggtaagtcagaataaaaaagttgatgaggtgtcacctatttacttacagtgcctcagcctgaacccaggagcatgattcaaaaattcaggcatgtgtgttaatttcccactacatccttttgatatgatgttggagaaagcacttattccttctgtatcctacagatacatataaagcataccaaaaagttaatattcataaaagcattttcttgccaaaaatagataaatttaagagaaatcattgttgatttctgagttacatgtaaagtcaatatatgctgctaaactctctttaacttttccagtatgttacagtttttaacaatctgttgttcaaaaactaaataccagaggtatataaaatattagataatatttgagcataaactgttgaaggcaacagcataattttatttccttatgccataatagagcatcacatctcagtcagcctaccccaatgatgacatattttctgaattgtttttacccacacatcttatgctcaatttaacaaatatttattaagtgcatagttggcaaggtgacactatggaggagatgaaaaagactaaggtatcatttgtgcccttgaggaattaataatctgacggcaaaagctgacatgtatacaatcaactgtagtatttgaaaggataaagtaagtcctttaatagcaatataaactgctcggctagtattgagagagcaaggctagagggcagagcaatgtgaagcttggattgaagtggcaggatattaaaggcaagacatcagttatgaagctaaagcatatataggcaataacatgataacagcctgaattagtcagtggactgatagaatagaaggaaaaggaataccaggggcatttcactggaagaatcaatagtatgtgacaattagatgtgagagtggaaattaggaggagtcaaagataaattcaagttttcttatcagatactgggctaggaaacacaaaataagaaaactgtgggagaagcatatgacatttcatttgaggtttgtgggtttaatataccagcaagccatctatgagcagatagccatcagtgggaaatttgagtctacagtacagtaaagagaccagcagcaaagatatacagcatagcagtaattggagtacatagaagattatagaaataggaaagtgccgaggataaaaacttgggggaaattaaacacagatatgataaaggaagagtaagcagaaaaatacactgaagtagaacacaaaactagaaaaaacaaaatgtgtgtgcattgacacggaaccaaaattttgaaacaaagagtgaaaagaagctcaacaatattaacaatgtagaggagttcggaattgagaacgaggtatgggatttgacaaccaggacttttgtgatgactttagtaggatggaatggggaacctagattactaaagattacatatctatatatggaagtaaatgcataaaaatttactatgaaaatttaattgtaaataggagaaagaggagtatatggttaaataggatgcaatgtggaattaatattttgactcagtatggagaaaattgaacatacttgtgaaccagtagggaacagaaatagagaaaaatgtagcaagaattcttaacccaaaatcacggattaggagtctattaggttgtttttgatctcctgcaagcctaggcaatatattgaatgtacatgtagttttattggaagagtcatcacattctcataaagattcatacacccctctagcccccaccaccctcaaaaggaaactttggaatctctgaaatatgtagacagagtattttatgagcaatgcccaagggaacaagatgaaatgcatttgagaggatgtatattctacactatttcattgaaagttcatctgtgaatttcaagtgttccctgtaaatttaaaacacatttaaaaggagtaactcatatctcttaatttactctgaatcttgagaagaaaatagatctaaaaggatctccactgtattcattagttcaacaaatgattgttgaacacttcccaatctggggcatgcatagtgcagagtgtacttcaacaattaagcaggatacctaattaacccagactttagagggaccatgccaaagtagggttcagtaatattttagcagacataatatctaagctcaggcatgaaaaatccattcactcaacaaatatttatatggtgctcatataggccagatactatccaagatgctggtatcatgtgtgtgaataagacaaagtgcctgccctcatgcattgtatgaaagagagaaaataaacaaatgaacaagtaaacaaattctataatcatgtagtgataagtgttataaagaaaatatatatgcagtgacccttctgtatccacaggttcaacatccttggattcaaccaatcatagatcaaaaatatattttttagaatttgaacatgtagagactttttcatgttctatttcctgaacaatagactataacaactatttacatggcatttacattgtattaggtattataagtaatctagagataaagtatactggaagatgtacgtaggttatattcaaatactacaacattttatatcagggtcttgaatagccaaagattttagtatttacaggaggtcctgggaccaatccccaatagatactgaggaatgactgaataagataaaggtacaatggcaatggaagacttccctacaaaggtgacattcggaaaaagaccgcaataaataaaagaataagccaggttaacatccagaggaggtggagggaagagcaaatgcaaagccctgggtaaaaacatatcttggttgggcttcaggaatgaccaatgtggcaagagcagtttgaggaggacagagaatggtagataaggccagcagagccattatgggccatggcaggggatcaggataggaataagtcaacttgggattggaaggagtagcttggattggaaggagtagcatgacttattccagaagtttgatttgactgtgatataatgaggggagtgtggtgagatgaagtaggagaagtcagcaggacccaggaaataaagggcattataaacgtaagttatcatcagagcaaaggtgagccactgaagattttaaatggggaggtgacgtgctttatcagtcttgcattttgagtattgcattttcactggatatattatagaaaatgccttggcagatgatcaagattgtcttcaaggataaaatttacaagtaaaggcccaggattcgatgtctattgctctttctactagtactttctttcctaataatgggaatgattatgtactcaagtatattaggaaaattaatctgaaactggtgtttcagatgaaggggaagtagaagattattccagagtttgttacagtatctaagtataaagtggtaaagatctcagtcagtccactcaatgtattaatgatggaaattgagagaaaaaggtgagttgctgctagagtcatagaagaaagaattgatagacttgtgcctgattacagaaagaaaggaaaaaagcaaagatgacctcatgtggtattaatgactaaagacattgttatttgtatttgtgggcctagcccattgcaaacctccaataaaccctacttaaagtgaataaatgaacacaggaccaagtgagaaataaagaaagcaaggttatgggaactggttttagttttaggcatcttatatttgaatagaatgggtaaagacagttgcctaaattttaaaaggttatcagtatattagtttcattttacatcctggactaactcagtagtattataaacatgagtcagtttagctaggtgcacctatgtttcagcaatacacagaaaaaaaataagacagagacatgtttaagagcaaggtcttgaagcgtgatagccagggttcaaatctcagctcaacttcctgttagtgtgaccttgagaaaagtatgtaattgttatattcctattatcttcttcagaggatagcaaagatgtgataaataatctgctaccactagcctttagcacatacactataaatcaggtttgcagatcaaagacatcactgagtaacttaattacccaagattctcaaccgagaaataaacccaatatggcttattatgagctacacattttaattggattaattacccaatcctcataacagcaatgttggagatttactattatacccattgtttttgtttgttttctagatgatgaaatcaagaattatagctaagtaggtggatcacctgaggtcaagagctcaagaccagcctggccaacatggtgaaactccatctctaataaaataaaatttaaaaaaatacaaaaagttagcagggtgtgatgatgcatgcctgtgatcctagctactcaggaggctgaggcaggagaattgcttgaacccaggtggtggaggttgcagtgagttgagattgcaccactgcactccagcctgggcaacagagtgagactatgtcactgttcaatagatcatgtgagttaaaaattttctctcatcataattactttcagcaaatctctagactagattcctttcttaaccaaatttatcttataaagatgtccaaacttcttttgaataatttaaaaataaaatttgaaaaataaatttacaaaagataaaagaaatacattcatctgtcctcactaacaaaggactagagaaagtgaaggcaattcagttgaacaaaaacaggttgttaaaattcacagcatagtctgtgttgagattttagaaataataaaaaaaagagtagatgcattgttccatggattaaatcagacaagagagctaagcttttcaattcacttttctgaacaattcacaaagaaaaattatataaagtttcttgtgtctttcatttcacattgaataatatggtaaacaatttttcctaacatttttgataagaaaacaaacaaattttatttttaataatgaagctaaaacgtgtatttctacgtattttatactattttaactttgtgattctagaggcaaataaagtcttatgatggcttgacttggactatatattatagcagaggcaatgtataatgaaaagggcacttttcactgactagactgagaatcaatagatatgaatgatacttcaactatactactaatacgctgtgagactttgggcaagtaaattcaatttctgaacactgttttcaaggaagggaatcattgaccccttttaagggtctggtgaaaatgcataaacatgtataattttacaaaatatttcaggaggtttgcagacttctaggaattaaagttcctattaataggtaattaaatgaagaaatacataatcctaatgtctgttttacattctgtttctaatacaatttgtaatcatttaattgtaaatgatttcttaaactaagaacaaacaattgaacggtgtaggtgaaagtctcgctcttctattttctcccccatttgctgcctttgaccttttaaactaagattcttcttatgtaaatatcatgtaagatatcttgccacaaagaatatttcagtgtaattattccttaaatattcatgtctcaggtaattagctgatatatcatctgtgatttgcttatacgtaaggtcaaaaacctaaggtaatgcatcataaactaatcatttatattttctttgccaaggttcactgaatcttttaacctacattgactacgataaagttaattttccatattaaagtaatattcaaattagacttttaaaaattatgctatgggaaaaaacgaacacacagaagttaaaattaagggtgccataagcaaataacttggcagcttttctcagcaaaaaaaaaatatatatatatatatttatgaggcacatttctctaaattatttaagttggtgtattaaaccaatttatatctaatccagtgaaatttatgtcacatatgttcattaggagaaaataattgataaattaagaaacacttcactgtgaaaaatctattaatattcctaactcattcgatttttttttcacctttgagtttttatgaacttatttctatgccataacaatataatatagataagtataaaatacatacgtttggcttaagttatatccccaccagtctccctatcaaataaagggtgccagacagtctgctatctgcatttatctctaaactgagaataactaaaggattcagaattttatgtaaacatcaagacaatgggcttaaaataattgaatcttactctacaataatcgaacttaaagtctcagagaaatatgttagttaggacaaacgtattttgctttcccattagcctctttaccttctatttttcatcaatttgttttgcccaatcgggttttatttacacctttttaataaactacaacaactctaacaactgtttcttttaaatttattttttaattcacaggaaaaatgatatgtatttacatgcacaacatgatgttttgaagtctatgtacattgtgaaatgactaacactagctaattaacatatgcattacctcaaataattactgtttttgtggtaagaacactttacatccactcttagtatttttatgactacctcatattattaactatactcaccatgttgtacagtagatctcctgaacttattccttctaactgaaattttgtttcttttggtcaacatctccccagcccaacatctaaacaccccaggccctgataaccgccattctatggaggcttctcaagaaattagaaataaaactaccatatcatccagcaagcccattactgggtatatatccaaaggaaatgaaaccagaatgtcaaaggggtatcgccattccactacatattgcagtattaatcacagtagccaatgtatggaatcaacctaaagaatgtttttaatgacaaacaaccaggaacacattttgttaatctaatgtgctccaacttactacacaggttgaccttgcataaaagtaactttacaagaatattagcactaaataattcctaacatcttggagacaattttcaaaataatgcgtttgtttactcattcaagatgtatttactgagctaccactgttatatgccaagtgatgttctaggtcctagacatgtagcaaaaaccaaactgaaaaaaaaattaactcttgtagattttcaaagcaactatagcagcaagaggaagagacgaacaccaaaaaaaaaaaaaaaaaaaaaaatatatatatatatatatatatatatatatatatatatatatatatatatgcagtcatgtcttagtgacaaggatatgttgtgagaaatgcatcattaggcattttgtcattgggtgaacatcatagagtgtacttacacaaacctagatgatataagctaactatatacataggctagatggtatagcctattgctcctaagctcaaaaccagtacaacatgttacttcaatgaacactgtagacaattgtaacacaatggtaagtatttgtgtattgaaacatagtacagtaaaaatatggtattataagcttatgagaccatcatcttaaatgcaattcatcattaactgaaattttattatttggtgcataactatattggataatgataagtgctatgaagaaaaatatagcattacttataaattaagaaaacagatcaatctactaaacatcaggtcttccgaaaattattattattattttatttttatttatttatctatttattttgtgatggagtcttgctctgtcgcccaggctggagtgcagtggtacgatctcagctcactgcaagctctgcctcccgggttcacgccgttctcctgcctcagcctcccaagtagctgggactacagccacccgccaccatgcccggctaattttttgcatttttagtagagacggggtttcaccatgttagccaggatggtctcgatctcctgacctcgtgatccgcccgcctcagcctcccaaagtgctcgcattacaggcgtgagccaccgcccccggccctgaaaattattttttaaaccaatataatagttattcctgagaataggtacaagaatttttttaatcatgataaatttcatatcctacccctcttcattcctgcctccacctcaatccattcttcaaagagcaactaaagaaattagatcgtccagaggcttctcgtgatcctccttgcatagacccttcagcacaaactcacccatgcccgcctccagcttcatcatcctccgtgtttctctaaactcactatattcaagccatagtaactttttatttttttaagtctgtcaaacgtttaatgctccttcctgccttgggtcttcacacatatattgttcccacgttgcgcccacccccacctccctgatcccaccccacccccaaacccgactaactcctggtcactttttaataccgaagtgtgatttctgcatggaagccagttctccatgaggttcctctgttttcactcttcaagggtctttacctatcctttgggaacttactactatttaaattatgtaaacacttatgttatactctgtatatttatcaaatacccctcctcagattgcaagttctgcaggacgagttcagagaaggggtggaggcagttgtttctctccttggccagtgtactttcactgctttgcaccctgcctggcatagactaggcatttagaaaattgttcctgagagaattaaagaataaatttcataaaaaatgtcttcagtttacaacatgtagttttatgcaacacttggcaaagtgggttctggtgggagctggtaatatcctttaaatcatgggactgagcaaatgattctagttgaatctgtgttatttaatctgtgtttttaaatctgtgaggctcttgccccagactctacttgaagtctgctgtgcttgcctgtaagctcataatcccaatgacagatggtttttaatctttgctatttggcttctagaatgggtatgtattactaactcatgtattttctctaacatgtagaatctgattctggtggccattccctctgaggaataagatactttctgggacttgtagccatgggagaaaggtttaaaacactttcagagagttgaggggaagccactttatgcttggaatcattgttgaaaaaaattcaattatgaaaaatcacaaatgggtaaaaccattaaataatcccagatagcagtagctcagggcattattgtttaatcatctcatgctcaatattctaaaggacacacacatacacagcaaacaaacagtgttggtgatgttttctgtgttttttagagtgagaaattagaattatttttgaggactggaagaatctttcctcactaactagcatatcccaaatttacaccatgacacttaccaatttataaaaatattttattttatttccatatatgtcgccctaacttctttagaggcatgaacctatcttttctcttttttatccccaaggactggccaaaaagaagaaaaaaaagtttaaaataggcaattaatattcattaaataaatcacagatagtaaagaagtattaaaagcagcctgagctggagtcaactatttcttgtctgtatcagccaggcaaaatgttgctcagaagccattcagggaataaaactctcttgtgaagaatctgttcctttaaactaaggacttacgttttcccaaaccctgtaaattcccatgtttttctatatggatttatgccagaatcattccaatccactggttggcgaagagaatggtttaataactgcaggggaaatgtaaaattctattcagaatataatgaaagctgtatggtattatgtattcatttaccttgtagtaggaaaactcaaatcttcaaataacagagtgttgccatgtcagcttcctctggagagttgaaaactaaactgtaaagacagtagaacgatgtgatttgtattggagtcactggaatcgacaaaacctaaattttttttataatttatttatttcaattaacaaatgacaaattttataaactagtggtatacaatatgattttaatgtatgctctactatgcaaagcctcaattcttaattggtctacaggattcagctgataacgtgaattctgtctacctgcgtttttatatttgtgaaagaattatgctactttataactcagttttttagagtttctatattctaaaattattactttcaaccatcaaatataagatagtagaaatatggggcaaaattttttgcagttttatatcaaaaaagtagatgaatgcaatagggagtgcattaaagagaacagaaaaaaattttaaaagaaagaatggggaaaaaagaagagaaaaaaatgtaaaagaaaggcgaaggaagggaacccgaaagggcaaagaaagtgaggaaggaagggaatattgaagtatttgatagagcttccctaccacccagatgctttagtatgtgcagtatttcaaagttcttcctaggtaaatagcaatgtctttcctttttattagcactgctgcagctgctgttgctcacaaagagattcacaaatcaaaatagactcagttagcttttcaataattctgaaaaggtaggagaacattgccagaaaaggatagcactccagtatcctaacatagagtcttgttagcaaaacaaagtgtgaattgcttagataattccctgctgttggtaattccactgggtgtcttctgtggcagcacaggctacttctcctctatagaccaatgccattgaacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaaggtatttggaaaaaacaaatttttgacacattttgttgatgatcaacctcctttatccatccatatctttttatatgtggcggcggggccggcggagggaagggtagtatttgtgctgaagattgaagaactgtatctctttaaaaattcttgtgatattaaggggaaattagtgtttgtcacatattctgaaattattactattattaatgtttttgaaatgctgttttcgttggtggggcactggctccttgtataacatgtttgctttctcccactgtcattttgtactctatcaaatccaaagttgtcatggttcattatctgtagatgatcttgagcagtcttgcattctaaaagaatatgccatggcatctgcctctgtgcttttgtggcctgctgcacagatgatattttagcacgagtattgggtgaggggttagaggggagagcagaatttgtctcagactgatgtttccttgtaccatgctgtgtctcattctttcatatatggctaattcaacagtgaagtacatatatcacactgtgactattacatatgttagagtacataatttgggttgtaaagtatctgtttgtcttaactaatgaattccatcaaattcaattaccattcttcattaaccaatcaaattactcctttggtctaagtcatttctaacacacttttattaggcatacacacaattctatgaagtaaacgtgaggtgattagattatctcatgatctttatttggagtcccatgctacagaagtttggatttctaaagaatagcctttcacattacttccactgtatacaggagaaatagtgttacagtgtgaagctctgtctttaagactctgttttactacttctatcttagactttcttttccctgaggaagtttgctacagtggatcgccaatacaaaaatacatagaaatacaccaactatatattcctataaaattaacctatttattaagtaaatgtacctatacgcttatgcgatactggatcataatatttttcaccttttaggaataaattatttcagtactagaactttctcctatctcttgcagtaagataccacagtgtaggatcacagttgttattgttgaaacacttttttcaaattatcattatttctttacatggatttctttttaaacaaagtggttctggaaatgcatatacccagtattgatagtacttcagttttctaggaaataattgccacagtactaatttacattggatattttaatcattttacaatgaagggcaggtgcctaatgtccttgcagtatgattcttaccatacagatcttaaaatatttccattttgttctcttctacattaatgtcttttaggaacattttcatcttctttcctacaactattttgagaaacatctcaaaatgtggtctaaagccaacctacaaaaatacatgttctgagttccatgccagacttaagtcagaatctttgggagtaggccctaggaccagcatttaaaatatacatattaggtgattataatgtaatccaaagtgaaataaccactgctctacaaaatgagagcaaggaaacaactgacagaaaagcattgtaaaactagatgtataactgatatgaaaaataaaaacaccacaatcaagttaaatttgaattttaatttttttctacatgttttcattacttggctgcaaaaagcattctaggttgtttatttcacctttaatatgagttttaaatatcttaaattaaaattttaatatttagtgttaattaaggatatggatgtctgttatttaaaagctttttccaagttgccaaacaatgaatgatagttataatggtaaaaggtattaaatttataatttgtatcattcattagtattttcatatttgaatctttagttttacaaagctttgtaaataacaagtctatctttaatattttatatatctaataaacaacactttttaaagaatttcaaccgatctttttgttaaggtttccatttaaatgaattacgtgagtgtcttactttcagaagatactttattaatacaactaaattgaattctttgggctgagatttttccattttttcataaatgaatatttccatattatctaatcttaataagaatattttctcagtgcggcaagtaagacatgtttgccaatttaatataccaaactctaaagtaagtatacactcaaatgagagttaggggacaaagaactgtcttctgaaccatgaaaagacggaatgtcgtgattacctcaggcactgaaagacagcaaaaatctacattagttctagtagaaagactacagagaatgtttgacccataaaattaatttttgcttcctacatagccgactccatggagacaaggtctaaaaagggaaaatggtcgaaatcttaggtttgtaggttaacttactttgtaaactagatatgtcctgaaaagactggaataatttaaattgtttctgcgttcataagaatcattttatgtatcaaaaattcttttgttttcagctagttttgaagattgtatttagattatggacagactactttaattgggttgtgtttcaaaagtttcattatgaagttaaatatttgggactcaaaacttattttcaaatataaagaatgctataaatgctgtttcatgcccagattcaattttatgaaatccacaacattatagtaaaattacataagttataaaactagaaattgaagggaagaatcattgaaaacaatactatatgatcgtcaaaattaagccaattagacaaaaaatattacattatatatttactttgaatataaatgctaaaggaaagtaaatttgcttataaataaatgagaaattaaaagagggggtagaatatttttctaaaacacagagagagtggggttatagcatgaacagtattctcctgagccaggggggagagggagatggaggggagagatgctgggtagatttagagaatgaaaggcaaaaggatctcaagtatgagtggccaacagcattgaactagctattaaaaagaaaatttgctcataaatggtaggcttataatccagaagaacaggtgtattcaatggtttgtttgtttttgtgttttttgttgttgttttgtttgtttctttgtttttttttttttttttttgagacggagttttgctcatgttgcgcaggctggagtgcaatggcatgatcctggctcactgcaacctccaactcccaggttcaaatgattctcctgcctcagcctcctgagtagctgggattacaggcgtgagccaccacacccagctaattttgtacttttagtagagatggggtttctccatgttggccaggctggtcaaaaactcctgacctcaggtgatccaccaccttggcctcccaaagttctgagattacaggtgagagccaccatgagcagccttaattcttttaaaatgaataggtaactatgttgttacatatccatttagaaagcagctgtgtagaggaaatggtaaggagagatagtgggcgagcatgcatgctaactcagtgagtgccaactaatggagtgaagggagaactaatgaatctttggccttctactaatggctttatctctgagtggattaactccttactctttattgagttccactttctaaggaattctaccctttgtttctttctgaaaattcagcatcaagtgaaccaaatttaccaatttgctgcctttgtgtgcacagttgttcatttaatttatgaaatagttattgaatacctactatgtagtcagcactatgcaaattttgttacttttagcccagacattaggacacaaagaatattttgttgtatttgaattttagtattttgtattttaccatttctcatttattttctgtttcttaaatttggatagttgaagggaacaggtggcatccatgcctagggatggagggctaggagtgtggataacccagagaagaaggtgcaaaaaaaggaggtatctgtcttgttcctctattctgctgattttaaggaggtcttagcagccctaagcagagcccccatcacttccatttaaccttaaaaacaatttttagagatggaaaaaatagaactatttgctcatgataaaaattctacattcaaagtgaagaaaaactactacattcaaattgaagacctgcagtatatagctctttttgagctgatatatctcattactaggctaatctatggtataagaagcaagaagttagaaaggcatcctggaaaaatggcccataattcttcatcaactgtaattttcagtgaaataaaagtctaaatctccattactagttagtttgaagtacagaaggtcatcatgtaagtttctaaaatcccttttaactctagaaattctactggagagacaggtgaataagattgggaaaaaataattgttcatctttcattgaagaaagttatttagaggaatttttcaatatcaagcacccctcctttccgttccattttcaagaaacaagagcaaaggatgagttttggcaacattccaagaagtgtcttagggcagaaatggtcaatgcctgtgttgagttacctgaatctctatttggcagcttctgaaagctactataaaaacctgggcttaagaagaggatgatggtatggtctcgcagccttgtgtgaattttctaaacggttttgttaccccaaagcatagaagtgatacctcaaaatttataactgatgctatatcatagttatactcacatataaacttgcttgataatatttcctacagttgagtttccaatcaatctatttttatctcctacacttccctgatccaacaaatcttatccatcatgcagcctgagttcatacctttgtttcttcaatgtttttattaaacatctacaatgtcagttattcttcaaaccttcttgtacaggcccctgtcctcatggagactaccttctagtagagaggtagactattaacaaggaacaaatatataaataataagacccaccaaaatcttgtttattcactaactttaatcgtatttttgtctaaattttcttcttccaagtttttttttttcagtcagtaatcctactcttcattttagcctacttgattcttactgttttcaacattgccctcaaattaatataatccactattttaactcttttaagattttccatcatcttaagtggaaggaacaaataaattcataaatttacatattagataagatgaattgccggagaaatttgatccgtatagccagatgtaagtaataccagagtggctccaatgtggccattatggaatcaaatacctcacagcccaggcctcaaaggcatcttttcttatcatgagatttttcttaattacattttccagtgattaagtgtcccatttctacacattggaatgcattttctatattaagttgtcaatgatcataaactatctgtcaagaacttattccaattatcctaacaacctcctctaggatccctagcttaaccattctacatttactatatgtacttggcacaaagatggtataaaggtttagccctaaattgtttataaatttttcacactattccaggatattagaacaggatagtcatttacttgtgtacacatataaatgtctgaatacacatcttgaaaatgcaataggttacatctgatgatggttcaagaagaactaaaaggataatcttaagggaacataaaaatttcgtgtttgaagttactgctaagaagaatagcaatgtaagagttcagataactgcaaaagtaaagaatcaaggcagtgtaaagtttctataacttagggaacttaactagctgttaaaagggcacctctctgacagcattaacatttcaaaaatttgatacataaagatgtgccagtacaaagtttggtccttagcaataatcaattaatgatactgtccttttcattcagtgaatccaagaataatagttttcagacctaaatatttacaaccacagtttcatcaaaatacagagaatatatattgtatcaagtgtgcctttatctagggcaaatcttaatagcgtctagattcagaccaaccaccaagacaaattgccaagagaattattaagaaatttgtataaatccctttattacatcttagattttaaaacttctcaaaacaattacagcccttacatacctgtgatggtttttaattccctggacaatttatcaagaaattaaaaattcagagcaccctagcaacacagtggtatatttaccattgcagtatgccagttttgtttattttttatggcacaaataccacaatgtattttatttattaatctattggctgaagtataatatgccaacagaaaagtgaataaaacatgcattttatatagcattatgagattttttctcttgctttttggtcattgatcttgtaaattgttattttttagttattatgatgaggatttaatatccagaatatattaagaaatcctacaactcaacaacaaaaacctaatgtgtctatttacaaataaaaattacaaattagtttagataattacaaattagaaaacaatgaagaatagaatttaattgaatggaaaataaatgtttatattcatggaagaaacacacataaagatgaattataatttgctatcaaatatacagaaaattagatggagtttttggttcacaatagctgacaagttgacaatatgcttatgttaaaaataaacattattctaaggtatttaaatagaaacataacaaaaataatcctgggtacggtcacttcgttagagacttgggctcaaatttaggtcccacaatagaaaaagaattaacaggaaggtggaaagagcaacaaaaccgcagttatttgtagtttgcgacataatcttgtaagaaaataagttcaagatgctaaagagagaaaaaagaaagatgcatcaagtgtggatttaaagtaaatatataccattacaagacacattgtataccgagaaccaaaaagaaacttactgaaattgtaggaaagaacaacgaatgacataatgcaatattctgagaagagaatgttgaaatttattcttgattttttttaaaagacagctatttatcttttgtgaaaaatcataatacagttctgtttaacaatgaagaactattccactgtattacctcccaattctcacatatttatacataagtattaaaactatacgtagtataataaacctaaatttctgaaatatgaacactatcacaattttctaggtgataagttattatacgattttgttatttaactgtaagcaagggagaatctaagaaagaagaatatattctttctaaaataactccccttcaagatggcagctgaatacatagaataatcagactaatcatttggggttagtggttgtttttatgttacatagaaggagaaatgaccactatctgatggcatccaagaaagtgcctctctggggacagaattgtcaccctgatcaccattgctcatgaacccccttcatgttaatgggcacattccaagtagaagacgtgataacaaattctttatgttcttttaggactgttaattctaaaaattttgggacttattatatagtgctggttaattctgagtataaatgtaaggaaattctgtttcataatttagtgtctagaataggactttataaattggtttatgatcagtgtgcttcaagtttattttgggtaccaaatgttccctttatttaatctatttaaatcaacaaaagaagcaatttcaaacggtattcatccaataaactgtagttaggaaaatgttcattaatctatttttatttaccaacaactttgtcattttctttcgaaaagcactttgaaggagggaaaaataaaaacagaaggaaagagaaattatataccactataaaaattatatgcagttttgcctgctttttatgtaacctagtattcaaaacttaactggttttatcagattccattatgttatgaacacacaggccagtatttccccaccagtttcttctaactaggaagtacattcaaacggaaaatctaagtttgtgtttttctactgaaagaaatgtcgctggtgaatagcgaagatgatttatgtgcataaagctgaccttataaaaataatctctgtgttcatcataattttattgctatgtaacatttgttccattttctttttgtatatctctgataaaccattagtttgtagatctctgatgccttagaacatatgacagtttaaaaatatctattgtgtttttccccaaattattttattagtcagtagttttttttgatgaaacagtgacatcaatttctttcatggttacaatttttgcagtgttttagctaacatattttactaactgaaaattatccttgccttttatttacacttcagaagttaaaaataaatatatttattaattaacaattatatctccaaaacaaagtaacgattatttggtttctaatgctagcagttcttgtttatatttaatgaaaatcgcatttctcctgacaggggaaaaatatttttccacattaagaaaggcttttcattcatgtcctgaaactacatatttttgttctggaatataaatcatctatttatttgatatgtatgttgaaatttagtttgtgaaacagaatatatatctatttgtatgtctctctataatagaattatggactgtgatgagttgttctccatatacatgaaggattagatacatatctttcttctttccaaaaatgccatcagcattgtcagtctcagaaaacaggtggaaaattgcctcagtgtttctgatatctcttattaaagatagttacgatgcagaactgaaaaatactaaagttttatgaagcatcaccatgaaataataaaactttcctttaataaagggctcatatccaataaagggcttatatctgaatgaatattgtcgttcactatggtcaccttaaatttcagatgcttccatcgttcaaaatattctgctgtttgtttgcaacttttagagccagtttatgcaccaggaagcagtctttgacaaacaccactgtgaaggcattatatcattatgatcagtacaaatgaggaggcaccctttctaagcatgaggaacatttcttttaatgagtctgtgccctctccaaaggaaatatgcattcatcaagtacactttaattcaaaatggtgtgtgttttctagacaaaaagatacatctctcataaaggagaagtactctgaggctgatgggctcatgaggtcacatgttggctaaaagacctcgcaggctatgcccagaacattagttagaccttttcaagatgtgggggaaaaaaagacacataaagtttcaggctgaatcaaaaagactatttttttactcagctcttgttatattttatagttacatccttatcccagacaggatataaggtcctttcaagaacccatgaggctacacatgaccttcccctgctacctctctttactggaatatgaaaccttacttgagcctacagtactctgcatacatagttaccatttgctatttactttacattagggatatataaaaaaaccctaaaaagccagcctataccaagctcagatgggcttactagtgaattttactcaacatttaaagaagagatattactagttccctacaatctcttccggaagatagaagcagagggaatacatcctaactcattctgtgaggacagaattacatgaatatcaaaactagacaaaggtaatacaagaaaagaatactatagaccagtatctctcatgaatatagaggcaaaactcctcaacaaaagccagcccataaaccatcctgtcaggtgaaaaggtaatggaactgtggagggatgttctgctttccattacaaaccatttattcattcaaccaatatttacttctgtgaggttgattctacgtggtcaagaaatcaaacctgtcatctctctcattcagtcagtcacttattaattcactcactgaacaaattttttttttcaaaatgtacaatgcgttaggcattatacctggtgctgggggatacaatagtgagcaaaataggccaaatccttgccatcatggtttttacattatattggagaaacagacaataaatgagatattaaacaaataaacaataaacaacataaatatatctatgttatatactatgttatctttatatcaataaatcaagatacatagatatcttgtttattatctatttctccaatataatgtaagatatatagtaagatttatattatatataataaatattatatatatatataaaatgtaaagtatgctaaagatatatgccaagaagaaaacaagaacttaacatgtacatacggtgaaatttacatagattgttcagagatggcctcattgagaaaatgactttgtgtaaaatcccaaaggcaatgaagaaaagcatcttgataatgtttcctggaagagcattgcagacataaagaacaagacacaacaacagaggctggtgtagagtgagtgaggaaatatacttggagatgtgaagtcagagatttagatggaaatcaaatcatgcagagccttgtgagaaatgacatggagttgtgatttttggccaaatgtaatgaacagccattggagggttttcaataggaaaatgctgtaaaatgattgactattatacaaaatttattccagtttctgtatagaagacaatatttagatatcaagagtgcaggcagatagaacaatagaagttattgcagtattccaggtgaggcagctaccagagttggtaattttgattaggcttatggctgtacactactgagaaattaatagacttgagatatgtttttaaagtagaacctatatgacttgttgatgaattgaatatggaaaataagagagaaggaatcatcaaaataattaccctagagatttccttgaacactttggtgaagccatttattctgatggggaagactccaacagaaacgggtaggggaggagaaaacaaattttgtttttatatgttaggtttgaggtcatctttggacttctaagagaagccagttaggcagttaaaatataggaggctggacctcagggaaaaagactggaatgaagatatcaaattaggatttgtatgaagtaagatactctcaatagcaaattaaagaataccttactaaaatttacttaaatattattaatatttgttatgtcactttattatatctgtttattaaatccaactctagagagtaccaaggtttattcagtagattattgatatgaaaaccctgggtcagcctctctgggagtctcagggcctagcccccccgttcccagactttgtgcagcatctcaagcatcatatcctcccatggcaacagagaaggcagagtcactgtaaggagaacatgcaggagaaagggattctttttaaagttagctctcttatctgattggggagaagagagaaaatatcttccagaaaactaccaatggatttccctaatgtcttcctccagagctacagcaaatgcccatccctataccatcctttgcaaaagggaagtgtattgtctaaaattgagaggacaagtatgagttattacttgtgactcaggttccatcatcaaagaaaaaactaggacatgttgggaaggtaaccttccatgtctgctacaggagacattctcttacagattttatttaaaatcaggaccagatgatgtccccaaaaatacacccactgtgcactcaagatatcttcatcctctctgtataaaactctatgtggctactggaagaaacagattatatcagcctgataaggggatagacagacctgttgaatcataaatagaacaagcagaaataatagaagagcttagaacattcacaggaaagtagaagaaactggattttggaaaataagtttctgggtttttgtaccacaattgagggattgtgggtggtatttgaacatgagctagtgcacctgaatgtcttagatgcctgtgaatgctgccattcaccagcagcctctgtgagagggcttaatgggtattaattgttcatttgtttctgagactctccgatataccaaccaggtgctgtgcctggagcaaataaaaagcaggcctctatcctcaaaaagttcataatttctgatggtgatctaggtaaattagtaatatattaaatatttttgccataactctcctattattgtaactttttctgactttaaaaactataacccaagcaatctattgacatttaaaccatgactatctggtttacactgtctttccagacatttactttgttctatttgttctattatagaaaagacaatgcgagttgatatctacatgtgtttttaagtacaaattcttatctgtgtctgccatatcacacggtattgtgagaagtccaaaatttaggttctttcttaaatttaattatctggtactttcctacaacactgtgtctcctattgacatttcaaatttcattttgttcacatatcttatgtttgtgtctccttgatatggataacaatagctggtgtaagagcttatctccttttgattctgaaaatgtaataaagaaggaaaatgcagagtaacagccacatgtgccggttattcaagcaaccatccaacttctgtatgaagttaatttggggaaaatatggtatgcacgctgcagctcaagctcacttgtgtcaaagagaaatacgaaaggcaagggatggtgctactttgacaagtacatgaaggaataaagtattgaaataaaacaagtgaatgtggccttatgagaatctttgttttacttataaggcacagcagtttcaagaatatgaccttgcttaatatattactgtttttacttcaaaacaacagcatttgtattcttatctaacaatttatgaatacaaatgacatgaaaatcatgagatacttttactctttatattaatttttattccatttactccacttggatatatatcctaagtaatcatcaaaattaaatgaatatttgagggaatatataacattaaaagaacccctgagaagttatgtagttcttgcctgactctaggcaaatttataatatgtaaagatcttctaaagaagaaattcatataacctattatagaaactcttccttatttctaactcaaatctttatattttatattaagcttgttgaagttttttcttagaaaatttgtaataaaacatcatatcatgtctctttggcctatagcgaatgaaaaaacctcacagttaattaatacagagattttaaaattgtagacctctagaaaactcattttgttttctttggattttatacataaaagtaaacattgatttgtaattaagagaagagaagaattcatgatttggaatcattttctgtaaaagaagaatagaattaaagatgtggcactatttaaaattagaaattagactttttatccatgaaaactctagagaaataattttgattttcaaatatgattagaaaaactcaaacattcagccttgccctttctttgaactctttcttaggctaacaagttcttctaatcttatagttttaggtgctgtttataaaattgatagttgtacatttatagattttacagaaatgtactctttttgtggataagtatctttatgccaagtttatttggctttgtgtgaattactgtttgaaaaaagactgatcattttgtaatgagtatcattacatgaagagctattatttcctggaaactttattctgcagcctcagaatgtagatcaggggccctagcaagttaaggtccaggctcctcatcaaggtcattttccttttcataccactgccctttccccaactcaaagtcagcctaatggtcagaaaggttcacttacagggaaagaaaaggaacagtgccttctttacctatgccctgcatagcaggtaacaattacctaaaattcattgtggaggattggaatatccaagagttttagaaacagttatgctcagacacctctgtgtgaccctaggcaaagtgactaagctctccaacgtattgtcctttatacacaataattaaaaagagtcctcaaaacattatctctaagataagatatgaaggtagttatggtttttcccaaactattttgacttgttctttgtcagtagcatgaggctatattaagatacaactttaaatagtgcttcataaacagtggatggccatggaatcgaattagtggcttgtgattggcatttgaataaaatagaatagaaaaaaataaaggatgtaagttacatcaaatgcagcaaggattagtattgctttgtgaaactttgtatatttgtactgtgtatatgaaattgtgctgtaaaatgtatttcttaccgtgtgtaaaagttttccaaaaatgtttaaaagatgtcagcctacagaattggaccatctagtacaacatgaaaaccccctaaaaaataccactcaaagatagagagcacagactggcattcagcaccactagaaagaagcagtgcagtgatgatcttcagggtctgtgattgctttgggcagtcttcttgctgtcatgttgcagtaagtaaggtatctgagctgcagtcatcatgtgggtgtaataagtaaaaactcacacatgcccattcagttgggcacttgtgggaaaaaagcaaatagaatagtgtatccttatttagtatatgtaagagctgtgtttaggtatctttcctcagaattcatggtactatgatgactgcagagaaaattctctatatgtttcctctacaaacttttacacttgctctttggcatttttttgtcagcaacaagatggcaactgtatgctaataaaatccctgtgcatctacctgcaactcatcccttctgatggctttatatctaattacttaaagcctgtattatgtttatctgttttataaaacagaatatgaaactgtcaggcctaaattatcctgaaccccaatctgtgaaaggacacataatgatggggaaaatatattccttatcagaacaaccaggtgttctcaaatattgactgagctgcataatcatttgggcaaagtatatcttgcaagaaaaggcagtaatgttcaaattcttgcatttttattttccatgagtttggtgttttcctttcagaataatcattgttcatgttcttgataaaatcaagttgatgcatcaaggcagctatccttgaagatataaagcctatgacattaggtcctgtgatgttgttttacatgttgcttactggcatggatgcccattcagaaattctgctattctactgggactccatttctgtttttctagaagcaactgcacatccatagaatctttcttctggaaagaaaacctttcaaataaaacacactctgcatttatttattttaagccacattaaaattttaaaaggcaaacaaaatttttaaaagtatttacatgaaccatatgaaattgctgatactttggttttttggcctataaaaatgatgatttcatatagcccaatctaatattacttttcaaaaagtaatgtaatattctaaacccaatatgcaattgcttttaagtatccaaattctttgagttcagctggtattagaagcagtctgatgctcttcctcattctcatacttaacaaatattgtcctaagtttctgctatgttcagagtgccaggcatgtggtaaagaaagaataaagctgacacaacttaataattatgaaacattttttctgatgatagtatgttgttggcagaacaaaaaagttgtgtttccattgcctacaaagtgacccaaaactttacaactccttcacatgtgtggtttttcttaagcatttcctcaacttcgtactgctttttatcgaattccctgtatttatttcctcctgagtagattcaccctgaatcaacctgtcagtgtagtttagtctttcccagatattgttccccaatttttaatgtaagaattagcctagtctttctgtgtcttgaaacattaacaaagcacttaagtgagcctttatcatttcaattgcaccaaccacgataaataaaacattagttgttctcatatattattgttccttcagttttgaggagagaatcacaagtggatgtctatgtagtttgtccctttgtaagacattcactgaatagtctgcctattgttctgcctagctctttcacatttacttgagaagtgtcatcataatttttctttttctttgttttctttttcttctccttttttttttttttcttttcgcttggtgagcatcctttgttctgaggattttttttttttttttttttgagatggagtctcactctgtcgtcaggctggagtgcagtggcgtgacctcagctcactgcaacctccaccctctgagttcaagcgattctcctgcctcagcctcctgaggagctgggattacagacacctgccactgtgcccagctaattttttgtatttttagtagatacggggtttcaccttcttggccaggctggtcttgaactcctgacctcgtgatccacccgcctcggcctcccaaagtgctgggattacaggcgtgagccactgtgcccggccaatatttttgaaacgaatgtttcccaccatcaatatacccaatgctgcagagtttctgttttttgttttttttcagagctctcactttgtttctccaaaattggtcatcccacctgtgattgctgcactgacgctccccagtctatatgctgagtaacagtagggaaattcatggaagccagcgattctccaccttcacttcaccctggatcacctggggagttttaaaaatactgacacctgggtttcactcccaagattctgattaaataggcctgaaccaaaggctgggcattaggatttttttaaatctcccagggggagctaaatgcacagtgaagcctgagaaccactaattgaagttttaacaagaatccccaggcatagccttgtgtctttgacctcattgaaaccaggcccaaactttggaataggctaaaagcaagtgtctatatccacttttagaaacccattgtggtgattcattggctaccatttattaagttttttctatctgcccaaaattcatcagagtagagctcagatctcaataggggtgagaaacaataaccataatggtcttgaagtcactttttggtatccactgccagattatgctactcacctaacaatttgggcagctttctccagagagtaattaacatctttgtaaagatgtaatcacctgaagcagctatataagcaacagcagtctcaagagctttcatttctagcagcaaagaaattgtattacagtagcatttcgccagcatatcttagaacatcagtgtaatcagtattagaatgatgcattgtaagactgaataacagaaagagattaatttctattaaatatctacatctgttggttccccaaggtagattatgctgggaaaatctaatggaggattttttttaacccagcctcctttcactccgtgcccaattcctgcagttgttgctgaggtttaccagatggattaaaagaaaaaataagaagtggctccaaacatgtaagcaatcctcaattcattgctgtttgaatgaactgtggtgttatttgcattcagtcttaatttacacggaaaatgacatccttttgcttagaaacaaagatagttttctttttctacgtaacattactcactgtaggatcaaaaacttgcctgaagtttctgaaccaaacttattgttgtccataatgtcactaataacccaggtctatctccatccaggattgttacaataaggtctggaggtgtaattataggtataatttgacctcttttttactaccttcatacaatttacttggttgaaagatctctgtcagcttttgctgaactttatgcttcgctacctcagtgcattaagtaaaccataaaaagaggtattaatagtaattttcaatgaatataatatccagctgctctcaagagaatcccttgatcacatctattgccatgattttgccttagaaaaatgttactaagcaccgacttctcccttaaggaagggttggtttcaggattttataggggaatcttgcaaagacacttttgcccattgaccagtatattgagacaaagttagagaaaagaatgagatgggaactctgctaggtgtctgttctgttttgtcagaactttgttaaagccgtggggaagagctttaaacttcccttgattgttattttagacgctaatagtcaagggtattctttaaggttcttaaagttcagaaaggccacattgacactgttacctatcaataattaggtttctaaacatcacatcaaacagcatatgcagaatgagcccaagaacagtacgatttgaggatgccgtggagttccatgccacaccctacaaatccatatatctgcttttcctgctcaactctagtttaccaaaatacagaaaacgggtcaaataaatcacagatataaagaacacaagtaaactaacaaaagcagcctgggaaatgcagtgctttaaaggaaactcagaaacagagtttggattattcacagaataaatataggcctggtcactgtatgaagaatctttgaatggtaagtcatagaaaccatgtgagctaatctcagtgatttttatcaaaaaagacactgggctatctacagaacccaaggaagcattaggctttagcatctcaaagagagagggatcaaaagcaaatacagggaggtcagcagcaggagtatggtctccaggtttctggaagtctcttagaggcccaacagcatatgcctctatatctctcagttccaattccaaactggcaggaaagttatttgatttttctatttggataagaggctcatcctatatgaactagtgaattagcaataaccaggaaagctgttcttagaacaaaaacatggcccgtgggaatcattgctatagacagtgtcagcagttctcacttagaaggacctagatagataactccataagattctgttatggctattttcacagagtccttaaaataaagaaaggtcaccaaaatatagggaaacttatgtatcatgttattcccaatgccttgggcttttctattttggctaaattgccttatattcttgacagctagatattaaataattatgccttgagagtaggtggtaatactttgcttttaaaaatagggttaaactagtctgtaagcaaccttgagtttcttttctcttgagtttataagtgatacttgaggaggagcatgcactgagggtatcttctgccctcccagaagccatctattacccaaattatgtatctttcccctttctttccttctttctctttccttttttttttttctttttttgagaaatgaggaagaaaacagtggagtttggatgagatgacgggtaggaaaggccgtgaggaagaagagacacatggggaaggaaagacagtgtctagcagagaacactgctgttaaacgaggtatcccctcacccagcagcctcatggaaagagaaccactgcttcaaggaataattctggagaagtgagactgactccacagtcaccccatctttctcttagtgatcctggtgcctgaaatgactttacaaaagctctgaccctcagtccacatttaaaaaggaaagactggattcatttaaattcaaaacaagtgacaaattggctcctatcagatctttgccccagatcaggttttggtagatctgagaacaaatgaaacaaaagaattacaataatctgaaaaggaaagaaagaaagagcaggatctgagaacccccaaaatgactcttgctttcttcatagtttgcctagtgctgtccttgattagaagtaattttatttcatttgcctatgaaaaagaaaaatattgaaattatgaccaagcatggagatattttacagataccaacctttaatttagctgaaggaacagttagggcaagagcacaacagtcaggatttgacatgaaacaaatttcattcatactcattggaagataaccctaaatatgtgaactcagtgcaacctatgtgtgaagtctctttgccaaggagcaatgctgcttgctttgttcagggatctggattatgagcactctgagaacagaagtcatgtctactgtgccatgacataacacccagcacctagcatagggcctgcacatggaggcgctggactgagtaagatttgctgaaaggatattaaatcataaagcagtatctaaacaacgatatgatgtttgagaaatcttgggaagaagtgtagaattagtagtgtttaagagtggggactctcaagttagattaaattgattcaaatcatgactgtattctctagctttgtgatctccgatttgtttactctctctaaatctggttactttctctgcaaacttggagtaataatatgagcttcctcatgggatcattcttaaaaatgaatcagcttttggacataaagcacttagcacatcttctttcacacaatgagtactcagaaatattaagtacaacaagttgctgtacagctatatgcaaagtccagtggaaatttggtcaatatcttgagtttccgtattgacagaaattttcattctatcacactgattactgatcaagggatgggtgaaataaagcgtggtgataaaaaggtctcgtttgtagatagtaatattgatgttctagaacatcaatactttggaccatgtcacagaacatggcttattttagtgctctgccctatcaactaaccaataaataaattataaaattcaaataggaagctctgactcagcaagtaatttttggaaattcatatctcgtgtttttcatctacattagcatcattcaaggagcagtagcatgctcttggctgtggtcctaagtgtttttgaaacttcatttgcaacattctctctagaaaggcagcaaacaatttagaggcaacatgatggtgttatttgtcaagaagattcttatgtatatctatagtttcactttctgagggttatttttaaagagtctggatctttgacgtatttttctattttttgtctaaaagtgggagactaatagtgctgaccaaaaccaggataaccatgatgtaaacggtttctgacagcccttctaatgacaagttcaattttgatttatatcacctttccttttcttttctaatccctccagcctggaagaaatagtctactttggatggaatgtatatctatcagaatacatgtgattaatagcaactggaattaaaataatcacactctcaatatttgaatttgtgtgttttagagaggataggtacatgtaatgcagggttcagtgtagcactttggcccactgaattgaggtaattcaggaatcagtcactgtcagtagttaatatattcaatattagtgagaatgggagaggggaccatcacaaggtgtagaagcttgctaatatccctacaaagaattcattaacttcaatatgatgtgatttgagagaaaacgttctaatcactacacattttaaataagcacttgcacttaataggtgccagggtgccgattatacaactggatattatttcatactaagaaatgctaactattggaaatgtatcagtgaagttcatggaaatatacaaaatgtttgaagtgtgaaataaatgcaaacattaccaatattagatcagattatattaaattggattggggcgtgttagaatataggacagacaacatctctaaagtaattcaaaattaattcaccattactaagctgtgattcagctgcaaacaaaatggaaagcagagtgcaatttttttttcagctaagcagtggaaggattaaaaattgtaaacttcttggaaacaaaatacctcccttgctgtttaacataagtggtatttaaaaatgactttttagaattgccttaactgcttcttttttttttttttttttttttgtgacagagtttcgctctagttgcccagcgtggagtgcaatggcacaatctcagctcaatgcaacctccgccgcctgggttcaagcgattctcctgcctcagcctcccaagtagctgagatttcagttacaggcatgtgccaccacacccagataattttgtacttttagtagagacggggtttcactgtgttggtcaggcttgtctcaaactcctgacctcaggtgatccacccacctcagccttccaaagtgctgggattacaggtgtgagccactgtgcatggccaccttaacttcttcttaatttgaatacataaagctctttatccttaaagggaaattataatttgtctgtatagttgaagctgccaagactgaggttggatttcctaatggtgccttagtcattcatacacattattctggggccaaagggttccaatcagtattttgtttggggaagaaacttttttttcatcacgatttaatgaattaaatattgtggctagaccaagtggtttaccttttaacatcaatatctgttgatcaaatacctgtatattcagtttctccaagaaatgccaatttaaattcccccaaatatcgctacttagaaaaactaaacaaaagcaatcttagccacactgtcaacagaaagtttcaaatacattggataattgaacagtgcctttccaagaattctgaaagtttacgtttctaatgtgattgcccatggaatcccttatttgtccataccttaattcatatactattctagtgtaaaaattacagcaaggataaggggctccaggagatttctagtttaaactttcagtagctaaaaattgccattatttaaccagtttacctattttacatgctacatttaatggactaaaatgatgatattttgcaaattctttacacattatgaagttcatttcttttaaaaaaaaaaaagcccctatccttctaatgaagccactgtcagtagtacagtagaacattctgaagtttcatcattcagagataatttagagaacattaactttagttcctattattaattggattcaaatatcaatacttagtagttttctcttcctttagggcaaattttaactcttgtataaagaacacagttcaaacaacgcatttaaggagaatctatgactagggtttagaagactaaagatgttacactgctctctctacgatccattctaatggttggtaagatcaggtgctattagtgactatataaaggctcaaggagtcagcacaccaccattatctgactaattgctttgtgaagtgcttttagaaaaattggaactgaaaggcactccatactaccaatttattttctgttcttagtgtcagtgatgcatgagagaacagcatattgtaaagtgtgtttttctggtgataatatttttgtcaaagtgatgcagattttaaaatactctcttgctgaaaggtacagacttatcatctgtttttcctgatgtgaagtttatcttctggatattgatttcttcaactttcttcactcagataaactagtgtttttttttggcacttgcctggaatttaaaagaagctaaaaagagtacatggattaatttcagtggttgaattaactgagaagttttgcttttggtgatttcagggttttataatcctattttaagagcattctctactttaatcatctgcatgataaaataactaaaatatttaaggaaaaaacactgctacagttgcatagaaatgtttataggtcccttttataaaaaagtataaaaatataatgtttgtttctcatttctttcaaacaattaaatcaattttattatagacttactacaatcctttgctgtttaaaaaaatttgcagaaataacatggaaaaagtaagcttaagcaagaacaaagtgcatcaatgcaacatgctccctccccagtcgaaagactatgaaataaaagcaatcatggcatatgcttgctgctcctttattataattttcatttatgaacaacttacttgctcttagctgaaatttcctcagtaggaggaataacagcgcacttgtgatttcaacatgaaatattccttgtttggctttttgctcattgccagtatttttttttttatgaaggaaaattttgcttaaaataatgtctcatcatttcacatttttaaaagtttttcctaatgaatgaagtttggcttttgacctcaatttcggtatccaggtagggagctacaccaaaaatgttctcatgctgtttttatttaaattccctgaactcttgccctgagcttatttcatttatattccaagtctcctctaattgtgaatctagtttagcatcactaatgactatgtattccttgacgctcaaattcactgagtcactccattgggatccttctattgttgttaaggagatgaggaggtaaaataaggcagaatgagaaacataggagccccctactttgtttggaaatgattttatgagatttaaagttttaaaaatatgtgttatattaagatcagtatgtcgtttccttttaaaatgagtacaaggatcttttatttatgcagcacctttcttccctaaggagtgttacaaactatacaaactatacagagtgcagaaatcacttgacccaccactggagtagaacaaagcagctgtttaacagatcacaacaatactgcaaaatcatttaagaaaagaattcaatgagaaagtacagcatcccaaagaatctatagggagagtcagaaaaagcagactacagtctctcaacttagaatttagctaggatattcaagccaaacacttcattccatttttttccccttaaaaattgtagtgcctttgatccagtgattggtatctagaaatttaagtgtttctatcacatgacatctcctagacctagtcccttggaaattacttgtctagaactgatcccccccaccacacacatacacacaaattccacttaatgacttgcaatcttcactcttctagtgtacctgccttcctaccttcatgtatcctttccaaacacagtcctagtcaacattagcaatattgcaacacatatgttatttaaaacccacagtggcggagttgtagcttatcaaaagcctcataaatatgaacaggcacacacttaagacatcactgcaagattagaaaaaatttagagatattcaatgaagttaagtaaataatgtagtagtaaaataaacctagtatgcatcattgattggttgttgcttctttgtttctgattacaaaagggtatactttaattcatattatactgcagatctttctgaactccagaatatgatctattcatacttgacacgttgatgatgtagtctgttttctcaatttgtaagtgttgaacagtcccatttcattttacataattctatagaaactacttctacaaagaaaaaatgtaggctttgaagtcagattacagttatttttttttccatctggcaggtttgaatcatcactgtctctaaaaggattaatttcttttgttccaatttaaagcaacaattgccagcatcttgaaaagtatcaattatgtgggaaaacagccatgagcagaaccataagaaaacagttaaccttcgtctttagagtaactgtgatgccactaataattccattttctatgttcccaaatatctaatgaccctcctttttaaaaatctaatactctatccaagaaaaggtaatcacatttagtttatatgtataagaaatgataatgaaaaaacattcatattcactgaaattttattcgatttacagttattagtgaagctaccagttgtctaaaattcttaaaggtaatgtacttgggcattttaaagcatgctatattattattaaaaacaaattataaatatgaaagtgatgacaattgcaatttctgttaaagtaattatagcatgtaactaattcatctaattctcactgacttctcttatgtacctgatcaattccaagatttggatatgaagcactgaggacagtcttgggaattactgagctctacacaaattttgccatttttattatactatcgttttctttagttgcataagtaattgtataaattactttagttagcataagtaatttgaatgaaatttcaataaaatgtcaataaaatagctattttgttttgttggcttagggctaaagataagaaagatttgatgttgcaattgcttttggatattttattagtacagtagcaattgttcataaatacagagtgaaaataataatgcaattttgatacagatgtgagaagactctagaccaatattttgtatctaatatgtctcagcttcctttaagtactttaccacatttcatttcacaacaacattatcaagaaaatattatttccatatttagataaaggaaatggagcagaaagtgattcagtaacttgcccaggtcacatggttataagtgatagatcaatatagctaactctaagatcctttctattaaacaataatattggtttggtgaataatatgctcatataatttcaaactttcaaagcagagtttacacaaaaacttgaagcttaactttagttgtatgaaaccccagggtttcatagaaggtaacttgaaaaccataatagatagcatcttataaaaagatgcttattgtgtgggcacagtaaaactttcctttagcactttcagtcctagcaaataaggcttctctgtgactatgctaattttattttccttagctatatgtgaagtcagcggagaaccttatttcaagggtgcatccaacatgtgttataggccagccatagactttagaaagagagtattaatgagctcataatatatctgaacctatttattagtaatgtttttcatgataatattttattcatatcatgaaattcaattatataaatatttattaatagaaagtataccccccatggatattaagaacatggaatttaaggtcccacaaacctggattgcaatctcagttttccttttgctggctctagatctaggacaagtaattttaattcactcatctacagtttccttataggaaaactcaggccaataataatgtctatctcagggctgttgtacattaatcatgtattaaattagatagtatatgtaaaacacttaatgggatatctgagtataggaagcccttcagaagtgattttattatttttgcatatataatagcattattagtgatagatactagacatggtccttaatattaaatagacacggcccctacatagacatgtaggttatggactgaaaagagaggcagttaaacaagcattggccatgcagtttactaattaccaagccagaaaagaattaaaattgtcagagttccaaaagctttcactgagttcaaaagtaatttcaagttgagaactggtcccattgaaggtatatatgtcatgagggccccagtctaaactcacattttcaaattgtccttcccaccatggaaacacttcaacactcatgggttagaatcagatacccaaaggagtattgccatttggataggcgctctgtttgcctacatttcttttccctaattgttttgcattgaaagtgtttggtgcaccttttaagatgccaaaagaccacaggcctcatctcctaacaaccagatgtgactgtgaataaaaagtttagagaggcttctcattcaaggttttcttctagggaggaccaaaatcttgaaattgactaaaaatacaatttctattttagcttagagaggacatgatggcattcattactttcaggatttcctgtctctggcaggccaacttgtgaccatgtatgaagatcacttatatcaggtttgggaattaaagtattagattcggtcatcaaaggaatgcttggttaagactagccaatggatcaagtgactcctgtatggctgaaattgccaaggccaaagagtggctagtatgtaagaagtggttcccataatatgttgtcattggaatgctctatgaggggaaaaagcagaagcagcagtgactgtaaatgaggtctagacaacaggtgcttttcttgagaaactggtcatgttactaagaatgatgatgatgatatatatttggcttttcttatcttttggcagtcagtagggataagtatttggtgccatcttctgagagcccctgaaatgacatctgtcccatctgttttatttatttgtgtgtgtgaattttttcttttgttttgggttttgttatctgaaatatactatgtaggatcgttagatatttgtgagaagatattctcggaaagcttcagagctttgcgtagtaagtctgattgcaatgggggaaaaggggaggatcctgcaacacagttcctgctttctccactatcagccatgctgatgcttttggcaaaatgcattatgatcacacttaattcctttgaaacacagtttgttaatgggtaattaagatgtcttgcattgattattgactttggttgatatatagctcctgatatttcttgctttgtaaattttttccagccactagcagagttctaaagaaagaagtaggtctgtatccttacaaatatacccctaagctctctgcccattaacatttcagtttataagtgttttcaatgtgaaactattcacagttaccttgttggccatttttcagcaaaagggccactcctgctgctgacaggcatgacagccagccaggagaaactgggcatagaggagaagcaaatctcccctcaaaattatgtgaggggaaattatatgactaaatatagcaactgtttaaattcatccataattcaagattttatcaagtccctcctcctctgtgatgcttcgttaagtactccaagccatgttgaccaccttgtcctctggactttcatggctcttagtttattcgggtatttaaaatgaaaagtaagacacattagtcattgagcacatggaaactattttcctagagggtgaaaacatgcatgttttatgtgattattgtatttttttgtagtcagcttcattaccattattaggagattattgcctggatcagtcctgaccaaagctgtttaaccatcatgtggtaataacagtactgcaggaacttgatgcccttaaggacctctatgtcaaatatctagaatttactttttcttaatttaatagatcatttgaactcagaagttagtgaacggttaatttgggaatggaggacaaaagctagatcatacttatacccttttttgttcccatacgtcaaccttcatttcctgggaggtgtcaagaaaaggctttgggagcagaaggtgaatagtagatttgagagctcaattctcattagagaggtaatgaaataatttcagtgcaaaagttcatcaaaggcagaagagtatgtgggaagtagattctgagataggaaatgcatgtggataaaaagtatgagtaatggcccccttcagtcattcggcattcaactacaaatgctttctaagtgtctggcactggttttaggaagcacttggagatatagtaataaatatgttagccaggatcactgccctcaaggaacttatactctagtgaaataaaaaaaagaaaataaccaatatgcctataaatagtgattactgtggtgaggggaaacatgaagataaaaagggaataatgagtagtgacttgggagtagaaggtccatttgtatagcatggtcagagaaaggctgtctgaaatggtcacctcttagttgaaacctaaagaataacaaccatcctggaatatctgaaggaagagggctccaagcagaggattcagcatgtgcaaaagtcctaaggcaagagtgactctggtttgttctaggagcagatagaagtgtatggctggaatttagtaaaaagaagaagagaggattggatgaaataggcatgaccacagcatgtagaatcgtataagccatgacaagtggtcggacttaattctaattacaataataagccactgagatgttttcagcagataaatactatgatcccagatatattcaagaaatttactctggctattgggtagcatattgactatagggagaaaagataagagttaagagagtgaagagaataatggaagtgatttagactataatagtggctgtgagaacgatatgaagtagttagatttggaccactttttggagacagaatagataggttatgataatgtagagagtgagggaaagaacagaatcacagatgatttccaggatcctggaatcagcagtatgttggatacgtaaggtgctccaaatgccttctcagccacctccctttgcttattcctgctttttgctagccttgttttcctgcctaatgtccttctggacaagtgcccccatgtcttttctccacaccgtgtctagcatagcttgaagtacacagcaggggatcaattaaaactccatgaactgattttctctactacctagaaaagaaaatatgattcaagaacaattttcttctataggaaaaacattttggtaaaatttatagaaactttagctttgctctaaccatgtttatggttccaagattacttggaacatgattgttccatttagtggccttccatcaaatttaaaatatgagttgttcactttcattacatgtttaacttgcacgaagatacctctttttgttattatgtgacaacttctgttgtggctgttatgaaatacaaaacaatattttaagagctctataaatggttagtactttctatgagaaaaaagtctctatgattactgtgtatcgtattttcctacactaatactttaaatcttagtgacttcaccatttagataaagagccctctggtttttgtttgtttgttttgttttgtttttgaattccaattatttatgtaaggccatacactctgtggattgtcaaaagcagtaggcaaacctactttcagtcttccctgacctcagaataatctttggttgtctgcatacttccttatggatgagcattggcaaatgcaaatcatagctattaatattaaattataggtattaagttcttacttgctccctggtaccatgataaacacgtgtatgttttatttcacttaatcaatggaaataccctatgaagtaagtaacataattatccccgttttactgataaagactgaggcttagaaaggttaaacattgtgccaatatcatctagctgttcaactagaactgaaatgaataaaagtctacaactcacattcttaactgtttagattttcagcattttgaaatttgatgtgctttcacttgcatctcttctttgtttccccatcaatatcaattccatttgtttcattatcatcctatgtttcctttcttttatttttgtttctgaatctagatttggtgcttttctccacaggtactttgagcttagcacagacggcatcctctatgtttcatggcactttcccctcattgctgtcactgttctctctcccagattcacaatactgagctctgataatatttccaacatttcttacttgcctttcagtgtctgtgaatggaatactgctatgtgagtctgaggtttgtactggaggttttatgggtttcttgttattgctagatgaatactgtaggttattactattactgtaggttaatgtttctttatcctgttctttcaatatcttcctagtatgatggagagagaggttgaaaaatcaatagaattagaattgaaaagagaccatgacaagatgaaaattggatagaaacaaattgaatgattttttttccaagttgaagttcaagattagagtaaagaggtgtctccagcttctctcagaaaataaaaggtggggaatgtctcacatgtatctatcacatgcccttttctcactttggttgcctactatggaatcctccacttcattctgaacaaattctcctctcaaaatgtttccttatgtgttcacagcagggaccaagctgtttgtagtagtatttcctactgcctcccttgatgaagaccgcacctctttatatgaaagtggggagaggaggtatctatattttatcccctcacttattaaataaagcccactacactattccctactatattttttaaattaaacctggattcctgatttaaaatttcaattcctcctataatgcctccaaaacacccagatcttctgatcttttgattctcactgattatgcctttgttccttcactacagactcataaagtcctgtcctgctatcagttttcaagtcatccctatggaagttcaaaattttttctagaggtcatcctaatcatttcacctttctatctgtattttcattattcattttatgaagacaattttcttctaaagctagatcctctaattgtacccttcattttatatttacctaattcctgagcaatcttgctcccataagaatgttgtcgttttccaaacctattttatttcccctcaaagggaaggaaggacagaggtgtcttggtctagaattgtacctgcagagatggtgagaaatagccagatttaggtcattatgccaatcattgttgagaagttcttacagaatttgcgttctatttcttaaaagaaataatggctaaaaggttgcattagaatataatatgaaactttactcgaaataatataatgtcattagtgaagaggaagttaaggaagagaccacagtcttcaagtaatggaaacatttatttaacatttactgcatattttttcatgcaataagtatttattaattgctaggtactctgctagatattaaagattctcttgagcatacaataaacaatatctccttaagtttacataccagcttagaagaaggataattaatcagtttattacaaggaagtgtgatgagtgaccagattgggaaattacagagaaatatgcaaatttatagtagggcattccatctagtcaagaaggaaataacatttcatcagagaccctaagaataaataagagttaatcctatcataatattaaggagagaaagttgaaaaaaactgtccctgacctctaagaacttacaacacaggaatctatatgctttctgaaagatcttgctagaaatagttcaaataaactagggaagaatttttaaaacaatagctgccaattttgctcttaacattttccagagatttgtaaaaaaaaaaaaaaaaaaaacacctgtgaccaatcaccattttaaacctcctgaattaaaatttctgggagtagatcctgggaatctgcattttataagctccctgggtgtttcatatatatatgaataattaggaaactttgcctaaaatataaacataggttttcttaagaaccatctgtgggtgttttaggcctggcatggtggctcacgcctgtaatcccagcactttgcggggctgaggcgggtgaatcaccttaggtcaggagttcaagaccagcctggccaacatggtgaaaccccaactatactaaaaatacaaaaattggatgggcatggtggtgtgcacctgtagtcccagctactcgggaggctgaggcaggagaattgcttgaatccaggaggcgggagcagtagtgagccgagatcagcccactgcactccagcctgggtgacagaatgagattctgtctcaaaaaaaaaaaaaaaaaagggagagaatcatctgtggtgtattatatctgcatactctcaggctgtacctgagaacctggaatttgtagcggtaagaggtccagactctatttttgggaatcagcacagtcagtgctggttgaggagtagacagaccacacatggtaactgagaactctgaagtttcaccaccatattatctattacagaagacaactgtggactagacactgatttaagttttagaggcagattggatccaatcacctggatgatatcttactttttgaccatacatagcacaaaccatctcttactcaagcataattgagcaggtactattctggtatacaaaaggcaaacacttctttgttcacaaaaatgtaagtatatgtagagatttcaataagtaaggagagaatcacttttccaattctattatttgttattgtggtgcttctgggatctatgtggtcacgtcaccattatatagctcttcctttcaaaaagagctgaagggaaaatttattataatatttcctggttccttgtgaagtgtgtaggcaaaaacagccagctgtctacaaacaagtgttcaatgcttctgaaaacaggagagtgcaccctgtcgctgctccctgtgcctctttccggactgccactgctttgtagtcagaatggcattttccttctgtggtttctcattatgctttatgatgaggtaatgtccttaatgtggcttgctgtgctttctgggacgtaccccagcccacctccagatgcatccaccctctttctttgcttcattaactgtgccatgctcctttctactacaaggcccctcctcccatgcagtcccttctacctggaggtctgtgccacctctgcttgcttccacaccagcctagctaacactcgtctttcacatgtgagctcaggagtcacttaccaaagaagcctaccttgattccccatcaaggtcagttattaaacactatttctatcttgtagagtgcacttctctgtttgtttttgtattctctttcatgagtttatttgcttaatatcaccttaactagactgaatgcagggattgtgtgttggtgtgtgtgtgtgtgtttaccatattgcctaagcatagtaggtatttcataagtatttgttgaagaagtgaatgagggtttaaaacactttgagagcatcaggtctatgatttcagttcactgagtgggttcatcaaataattgttcaatatttgctatgtactgagtccagtaatgggcaccaggaactccaagagggattaactgtttataaactgtaactacaacttgcacactgaattttagccaactctcttacaagtagatgctgttggagcacccatttgtataagcggtagccctttctcactaactcatctccccatcttctctgcaagcatctgaagcatatttcactatatttcctgcgttttttcctctataacacctaggaggtcttaataaaaatatccaatccagtccagttatagaaaacaaagcaaaaacatcagataggttcttcatttactatataaagccacttttattctagatagttatagaatgtaaaggctaagagaaaacattagaagggtaagcttatgaaggttttcttcatgtaagaccaagattctatcattatgtccattttgttagaaaataagccttcaggccggacgccgtggctcacgcctgtaatcccagcactttaggaggccaaggcgggcagataatgagatcaagagattgagaccctcctggccaacatggtgaaaccccgtctctattaaaaatacaaaaattagctgggcatggtggtgggcgcctgtagtcccagtactcgggatcatgaggcaggagaatcgcttgaacccaggaggcaagggttgcagtgagctgagattgtgccactgcactccagcctggcaacagagtgagactctctccaaaaaaaaaaaaaaaagaaaaaaaaaaaaaagaaagaaaaaggaaaagaaaataagccttgggtatttttgacaacttctaatgaaaaaccagttcaaatattttcatcagtaacaagtctcatagttagtacaatttattttttctgaaatttaacctgaaacctatgttcagatatgattcccagtcttttcaaatactttatactatttagaataatgtttagaattcttccctttaaccattccatatcatgcctattttagtgcaaatatttcttctctttgaaaatgcattctcaaaagaagacatttatgcagccaaaatcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtatactagttcaaccatgtggaagtcagtgtggcgattcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatgttctcactcataggtgggaattgaacaatgagaacacatggacacaggaaggggaacatcacactctggggactgttgtagggtggggggagaggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaaaaataaaaaaagaaaatgcattctaaaactttgatattaaatgtaagttaaaagtttcaaagctaaacttgcactctaatataagcttatgctgcatagactggactccaatttaaatatgtttgtaatattgtccttttgttttaagtaataataagtaaccaacttttttatttgtttttcctatttttataggtgtgcacatcaatttataccatatattatctctttgacaatttgttttatctgattcatattgttgatgtctgtatcacttactactttgctaatgatttaaactagaagaatcagagcctaaatagccagaaaaataaaagtttatgcattaaacatattcatataaaaaagatatgcagccagaatatttcggtctaatggaccgaagtaaatataatcgctccctatttgcttaaacgaatccaaaatacctagttgtcaaaacagttctgaagttcaaatgaaagcaatttgtttaaaggcttatgtgaaagacacagtaatactcttatgccatcatgtttatcctttatatcaataaacttccatgtacatacctatttaatgtattctgctagtgtttatttttgccaagctaggtaggccaggattatctacacttcttataaatgaaaaatctgaggtaaggggaggttaaatgactttgccaaggttgcacagtgagtccacagcagatctaagatgaaaacaaagtgtaatgagccatggtgcctcccttcctggaaaataatttatcaagcacttatcccaaatcaagattaataaggtcagatgataacttttccttcactgaaacacattcagctaatacaactgagatctgtttaagttaccatttctaaattttgtgtgtaatgaatcgcaaagagaaagacagttaaaaacagaagttctttctgttctctaataatatcaaaggtttcacatcttttcactatcacagcatctgtgtgaggtaggacatgtatagtgaatttatcacacctatctccagataaaagctcaaaagaaaaataggtctatggctcttcaatgctctgatatcatacgtgtttctagaattaaggctgtgtctagtgtgtttccataagcattatgctttcctttggagtcacatggttcctgtttaaacagctgtcctcagtgcaactgctttcatactggttgtaattatacttcaaatgaaaaacattgttgcattgttatttataaattggggagggagagcaacttaaactacatagaggttagtttttcagatctggaatcagttaaattatttactaagggcgccagtgtcagaaagattatcctctggtatatttatacatttaaaggggaaaaactcaattacaaaatccctgagcattaaatgggtagcaatgcttactgcaacttaatttgaaatggatttttaaaactggtggaagttgttactaatgatgtcatggaggaggcatggtgattaagttaatgttcagtatatgcccaggatttaaatatctgcatttggtctcccattcagtttgtaacagtttaataaataactaccaacaaggtataaatttgggaaaattgttattttttatttgaaatgtagtgtagtttgatggatgaaggccaccataaatccactccactatgtactaactatgatgattttgggcattttaagaggcaaagcattggtctgtttaattatctgctcctagatatggacaaggggcttattgtgtttacacaaattttcttacatccatcacttattgacctattagaaatccctggtgggaatggagaaaaatatagtgactccctaatattccacaagatttccaaaggtggctttaaaaaacaacctcaagtcagctacctgagaactgggaagttctctgctttatgataggtagatattcactttaagaaaaatatgacttcagatcaggagacaagaatattagaaataattgtagtacattcattttatacttacttgtattaggcatttattttatatcaagcattatgctaagtgttaagaatagcaaaataattaatcatagtctttgtcttcagtgagctgtctaataaaataaccaagcatgtaagcaaataaccacaatgtaatggtagagtctctaattgagacacatagatcaacaaagaaaaattaactaggatagttcaaaaatataacagagatgttactgaagagataattgttcaatgatttttcaaagtattttatttaccaacaaactgatagatgaggagggggttgtgagcaatgtgtgtgatacaaaattaggaaatctaaaagggcatgacacattgtggggaggggacttcaacctagccagaacatgtaagagttgggagccaatgttggaggaagaggttggaaatataaaaagaggttaggctgataaaggtcctgcatgctctgctaagtaatttcaggaagcagctgttgaagatttttgaccagaaaattgacatgattagattgtactttgataaaatgtctctgtcaacgaggaaataaatagatagaaagagtaacacaagtcatataaagctagcagccaagagtttagtatagaagtcatggcatggtccaggccaaaggtgaagaggtcagtagggatggtttaaaaagactggtttgaaataaaattgtttattttggttagaagagtagtgtggcatggatggcaatggataatgaggacaaagaaggacatgaagagcagatctaggtttagggcaaaagacaatttttcttaaaaattgtgcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccagggacggttgtggggtaggggaggggggagggatagcattaggagatatacctaatgctaaacacgagttaatgggtgcagcacaccaacatggcacatgtatacatatgtaacaaacctgcacgttgtgcacatgtaccctaaaacttaaagtataataataataaaaaattgtatatttattaaagtctttcctcttatataaaacaaattctaagtgaaaaccaagtaccaagaaaggaaagagctgctagaagtggatttcccttggttggatgggccaaacctaagtcctataaaggcctaaagaaaaacatttgccacttgagggtggagactttctagagttgggcagcaagacattcctggaagaaaagttgctccttatgggtatcattatttaccttcagtaagcataaagactgggttctttgagagttaaagagtttccttctaataatttgggaaagacatgttaatctcagttccgtgaattagtagttataaaattttgtatgaatcagttggattctctctgaaactcagttgtattatgcttaaaatgggagaataatatctgcctcataattatttctaaaattaaatgaaatagtataagtaaggtgttttgtattctgctcagcacatacgtaatttgtaaatgatagctattcgtcaaattcctattgaaagtagtacatgtgtccattaaattaagggttgccaaacctcaattttatatttctttatatcttgtttctctcctttattcaatcaacaagcagtttttgaagtgttgtcctgtatcaaggggtcacagatttgctggctatggtctgacaatctaatggagagagagaagtattgtcaaataaagacagtaaaatgtgatttcgcagtctataaatatatacaaataatatttcattcatgagtattcttttaatgtccttcttaaaataacttaatttggggatttgtctttaaaactctcgcaaaaatttgaagccaaattaagttactcatgagataactagtttgaattaccatcaacattccagggttatactgcaaaacctatagatgatataactacataaaccaatctacacattgataatatcataatgatagtaatcataatgaagttaaaagttaatgcaaacattatatttcagagtgcctacctaccacagttgctatctgtatagatgtaattatcaaggataatcaacatgagagacattttatttatgattcatctgcctggttggtactatgttggttacttttaacttcgatgggaaaaatgacattggactgggaggagttagaagtgaagaaacgacctacagcatttatttatttatttattttactaaactcctttcatgtcagagaaacataaaactgctgattagagaaaccaggagtaaaatttgtcagtgaaacaaaacaaattctaatcaattcttgttacagtactaaaatgctttcattttcataacccatttaacaagtagatgtttcctgtgatgcaaaaatacattttttttccttttcacacctctacaaattgcttttgtgtgatacactgcaccacaggacacttatccaaagagctaatgtaaaaacctcattttgagaaacaaaagtagtgtcaatttatatgtcaagagaatgaatactgcattccaagttgatacaggatctgacatttcaaatccaacataaattatttggaagactcctgtctttttccctgatctctgtattaacagcttttgtgaccttgaatgcaaatgaagtacaatactaaggatgttcttcatcagtatgaattagaagttttttaatgtatgtttctgtgatcatcagcttattttccaacatttattttttatctccctaaatcagtttaaccagcagcatgttgcgaatgtgactcatgtcatctgtgcctgtggttaacattatgttgctgcaacaagtccacctgacagattttttgagcctaggaagttgtccatttcaattaacaggatgcccaggacatttccctggcagaataataaaagctcacactggttctcctcctctctgaaaaagaagaaaatattatgtactattaccataaagtcaactttctatttttgtttgaaagcacagtcttagcaggaaaccaatataaacaacaacaaaaaaagtatgtgctgaaacttagagaagtgtgatttctttattctctgcattatagtatatgcaccaggcattcctttcttaattctgtctctcctgtggaaaatagatggatacatccatgagtttatattgctgctattgcctgctgttccctgtccatagcaataggtctgggttttctgtgctctggaaagaaagcactttgaagaaaatgcatcattctaatgtttaaatagcatttactctatgaactctttgaagaaacctgtggtgtttaattcctagaccattgctaagcaaggctacctaatgggtggtaaagtaaaaacacagtgtgatgatgactccaaagggcttcaagaagaatttatgcagcttctcaataatactttaatgagataggaaactgacattttctcttagtcaacgttggtgctaaacttttaacaaaattgcattgtaagccataactcttttagtccaactcaatttctctctgttctattcttgataaatatttttaattttcatgtaaacctacatcagaaaagaggccaaaaaaagaaaaccaaactgaagcaaagctccattcagctataaaaacatccttgcaaatgtatgcaggcactccttagatataccattttgtatggttgagcttcacaaactcatctctgcagcaggctgcacatttggctaggagacaactgagttataaaattggttttggactgttgagaaaagaaatggagctaaagcatagagattctatcatgagcctagtaaaataggaaccatttcttttagtaaatttttcctctaatattggtttattgtctttcataaggggcctgatcattatcaagctgcctcaccctgtttctccatgcacagtgatcctcaattaaaattgtgcatatatagatagtgaggagatgagcctaaaatactgaaaatatctcctttcttaaaaaaatcaattattactgaaaatagtatcatagcatcgtacaattgataaattatagcattatgaaaaataattataaaaaaagaaccatagcatcatacaatttgagaactgaaaggatgatcagttaacccctccaaaaattattttaaagatgaaaattgctgtgcacaaatgttgatttgcaccaaatcagaaagctagctagtattggaagaatagaagtttagaaaatatataatgcccaaacctaggctttttaagaaaataatttagtgtaattctttttatttgatttttcaaagaattgaattctaagcagaaaatttaactcactcattaacatttttattctgttgccaaaataaaattattttttatatttgtacgcccccttttttttgaaagcatcttcaaatctattatttttgtcttcatagccattctgtaagttagctataaaaatttctgatttacttttttcccactgaggacagtgtaaaacagagataaactacaacatttctaagttcacaaatcaatgtcactacagacattgactatataattatgagtgccaatgaatttgcggaagaaaaaaaaaagaggaaacttactttcactgaatacaaagttatttgtgctgaaaactattgagagaagttttatatttattaggtaattatctgtggagagccattatctcaatttcccaaacaacagactgagtctcttagatagggtaaataattcaactgaggctttaaaactgcttggagacaaaggtgggattcaaactcagtattgttactccaaaacaactacatggtctgctacgtcagtggctctcaaagtatgatctgggtacctgtagaccccaagacgtttttaaagaagattctaggattaaaactattttcattataataccatttaaaatctcattctctaacaattgtacactggagttttctagaggttacctccagctgcttgactgaagaagcagagtccatctgttttctcttaaatcaaacatttaataagatttgcagatacaaaaaataatgtcatgcttcttattatttgttttgttttggaaaattgttttaaatatattaattatgttacatgttagaggtttattgtttattttaaaataaattaattatatttttattttttacttttaatatctagtaggttatatgtctgtagatgcagctcacacacataaaacctctcatgcatccttaatttttaagagtataaaggagttctgatacaaaaaacattttgagaactgtgctaaattaagcttctttactgagtaaaattggaagctacaatatacagcaaaacaacccaggatctagctttcgaaagacaagcaaatctctgtgtaccttagttttagtgctagaaataacctttagataaaatcttgcttccatgccggttttttatttaacttatcctagaaataaatcagtaattattgttctttgcttggaggtcatgagttatgaattgtcactgtaaccaggtatttaaatcagactcttttgacttagtttgagcaaaggtctaaaaagccaaaaaggaaaagatgggtgataaaacttgcacgttccaatgtgaggggctagagtctccacagggctttcaaagacaactttaaaaattggtttgacaatgctgcttctacctgaatataaaagagttgaagtaggaaaagccaggtttttggaaattaaataatttatttgattatggctgtcattgtgctctgaatcttcatagaggagggaagaagaaagcttctgtctcccacaaaacctgaggggtggggctttagagagaccatctggagatcctcatctgtaacacatgacatttctggggctccacagaggatgtctgacccacagcaggaaaagtcaaaggtggggatattgtgactgactcagccctcaaatggaggagcatgcattgggagcttcattgagagcaatctgtgcttacagagactgagagccaagaatgatgtttcctctgggaccagatattgagaaaccagcctgtagtcgttgtttttagtaactttttattttttattatatataactgacaataatacattcattattattacataattatattgcattatttcatgcctacagacgttacaagacaagcacaaaaatccccatatactctttaccaagcttcatcaattgtttctgttatctcatttgctttattattccatctctctctctctctttctctctctctccatgcacattcatcacacatccacttttgttttctgaactattcacctataggttagagacatcatacctctttactcctaaacacttaagtatgtacttcctaagaataagcacattttcttatataaccacagtacagtggtcaacatcaggaaatttcacattgatgcaataggattacctaacacatagctggagttgttttaaattcttcgcaacactgcctggaagagcatcctaacctcacggagggagagaactgctgttttcccaaaggttgaaggaggaagtgtgaagggcaaacagatggaaatgcatggggttctaactcagtcttgagtgtctagcaatgattctaggaaattggggctggaaatagaatagaatcatttactgaaggacaattcaaagacgtatttgctgggtaatgggattgagagaggcgtgtggccagcaagcagcaaggcaaattcgaggatgggttggagagcacctatcccaagcttctgtttgtgcctattgactaatgtcagaattggtggcagaacccagggttgtgctgcttcaaaaagtaaagcacatttatgttagctgctgtactcttatccaaatccagaattttgcttgacagtatgttaatataatgtgtaatgtatctttaacattctagggctataaactcatttattcatttaataatcaaatattaactgaatgtctaccttgtaaagatacctgagcagtttgttcaacactcattcattcaacaaacacttacagataagaatgatgtaccagagtttctaattgctaggaaaacagtatttgactaaaatgggcaagacccctgctctcccctggaaagtactttctagggtacattctgttgtccttgttgaacttagcaatatcatttctgtagggggatgctgaaatgatgttttggtatatctgacatactatattttttatttttgtgattaaggaaagatttggattggagaataacgctaaataaaattttgatctagctttgttcctcagaatgatctactgtcttcttaaagtcctgtttgttggctacatattttgttatttttaaatattttcaggatagcaggtactttatgctgcatttattgtgacctttgatagtctaaagcaaagcagaacacacttatttaaaatgtgcttataagatgcttctttaggcaaatagaatttatacattcatgagcaaaagcttacagatgtatacattaatgaactaattattgtgaataccaagtgttgattttatatccaaagttccatgtgtgtttttaatatttaggaagttatgatttgtctacaagtattttgacgtgatacatgtattaaacactcaagcctgaattcagagtaattttcctctggaggcaagaaaaaaattatctgaaccatcattagttttacttcaatgtgaatcatgactccacatcaacatgattccatttcccctaagctgactttaaaactcttaaactcaaagccaaagctataatgacatttgcttgttgagctttatagaagcactgggaagcctggaaatgatgcttaaattatattgaaccttgttgtttctagtagccttttttaaaccatgagaaactaagtttagtagcttgctttggggatattatttctagacacacaaatctagtgaaaagaactcgaagtacactgtgtcagatttctggctattatacgttgtagaataaaaacatgattgatatcttaggcatacacacacatataacacatatgcatatatatgatatatgtatgtatatgtgttttatatatacatatatatttcttctatacatatgtatataggctctgtattttgttcttcagtacttgtaatgtatgcattcatatatatgtttatgtgtgcgtgcataatagctattaagtggtagcaagttataaagcctgtttgactctagagcttttttaaaaaataccagacattgtaactgtataagtgaccttttcagaaggttggtaatattgacaacctcgttgggaaatgtgttttgattttgctaaatagaagtagattatgtttatatatgaatatgaaactactttaaagtgaatctttccctcagtgctagatataagatactgaaaatagatatttaaaaagatccttgaaatgcaaatgcctttggcataatattatgataaagcattgtgtttaaagcctgatttgttaattttatgcatcatttatttgaattttatataatttttaaaggaaatattactattcaagtgttttaaatcacttccttttataattctaagttaacagattgcttacagcagtttatgcttctgttcaaacattttaaaggaagaagaactttattaacttgttgggcatagaaattatatctgttccataaacatgttccaagtacagtacacagttattattgcttcttgatgaaggaggagtgcatgtcctagttatagaaatgaggaagtaaagatccaaagagttagttgcattctctgaatgtgtaatgcatttatatattgaacattggaaaaaatgcccattcttatccatttaacatgttctttcttgataagaaaatgcaattttgcagttaagaaaagcgaaaagttataacaaataaaacactatgcttttatgttattggaatcacgtggtttatttatttattggtttttagctattagaatatatttaaagctaattgaaattccacagaactggatactgacttgttccttttatacacatatatgtataatattgtgtgtgtatatacatatatattttatatatatatatatatatatatatatatatatatcacactttcattgtccattcactatcaatggacacttaggttgtttccatttcttagctattgtgaataatgctgcaagaaatatgaagtggagatatctctttgagatactaatttcttttcctttggatttatcaagaccacaatgagatttcacctcacacctattaggatggctactacaaaaaaagataagcgataacaagtgttggaaagggaatggagaaaagggaatcctgtacattgttgatagaaaaacaaatgctacagccgttatagaaaacagtgtggaggttcctcaaaaaattgaaaatagaactaccacacaatccagtatagcccacttgtggatgtactctgctttattaagaggactgaggttcttgctatttcttgaacacagagaactatctgctgcctcaggccactgagccttcagctctctccaccttctctccaggaagtttcttacctggatcctcagctgaatgtctttctcactttactctggtttctgctgaaatatctttccagagacccctttgctgaccgcctactttaaataggctctcctccctgtctcctgcttacttccattaagctttacctgcctatatttttcttcatagccattattactaccaagagttatattgattcactttctcaatgagtccatgagagtgaggacttcatcatatttaacactagaaacactgtctatcatattaaggaggtgtcaaaaaataaaatgtcaatgcatatataaggcatataaatatataagtatgctttttattatatataagtataacaaataatacatagatattatgtagatatatataaacttgtcaagccctctgtggaataaatgcattgggcaggttgaaactcgaaagcttttaggcatgtgacaaccatacatactcgaagccaatttgtgatcttaaaaaaattcatttttttcccaaagaagaagtcaaactaaaacataatattctatggatattttaatgtggaacaatagaaataatttatttaaaaccataaataagaagctttattaagatacattctatctgcagcaatataaaagcatagcaccacatcaattatcttgagtttgctttaaacagatagagaccagtatagccatagacttcacatcaaccaccggccaaattttcatggtctgatagcctttctgtggatggacatttctccttatacattcccaccttgtgtgcatttgaacttgtctgtctctttatgcagtcatattatggactgataaagatctccacatttgatcagattaaaggggaaaaagaggatattgaatatgaccaaatccataagatgagattatcaattgcttgttcaagtaatattgtaaaaacacgtggttaattttgtcatctcaaaggtatttctatggtgaatgtgttcaaaaaccagaaaaatcacatactgtgtactgaaagcctcttcaaattttctgtctgtcgagttattttttgtgttctactaaccctgtcagaccttatcagatatttcttcacttcaatacaaatctgtttttaagcataatcttctcttatgttactgttcttctaaaattttaagtgtaaatgctgcagaataatgcatgttgctgactaatctaatactatagaagttcaaaattcaaaacacagaaataaaggaatattgatagagctaagtgctattcaaagttttttctgtagagaaaattagagcctgtatattcgttacagagactgtaaacactaggagagtaaagtccctgtgcgcactgtgggcctcatatccagggcacttagcactatataggcactcaatacatctttgttggataaacaaaaatttgaggctatgtaaatgatcccttttcccccaaaataaaaataattataacacagtattagccatttaggtataattggtaaatagttaatatagtcttactttggtctaaaatgtgcctgtttttctggatgtggtattgggaaggaatgaattatattcaataaacaatgaaatgtataagtattatagttgtataattgagtgacaattttatgccgttccataagtaaaaacttcactttacccatgaccttgtctcaagagcaatagaatagttgaaatgggacaagacatagaaaacgtatgtagaggttcctgccattcaaggtggaataataacagtaataaatattctaagagcattatttcaaaagagtcttttatgttaacaatagtcacaaaaatatttcatttttctatatcttgtggttgggacattagtctcttatgcagaaatatgtacaagatatatttttgtttttgaagtcctacatggtagtaggatactttcttgttcctgggtaatttctactaatgcaggtatcagttatgccttcaaactattcaatacctcacccttgcatactatcggtagtgcagatttgtttttgttttatagcctttgttaatgcatttgcagattgcactgaaaagagcctgagaaaattactccatatatcagcatcaacagtacaaattgtttttgtttcttttcttttttaattcacacactgtgctagtgtgccatattgtacaaatcagtaaaaaaaaaaaaaaaataggtaattaaagctgttctggaaagttgtagtgctggagcaaatatattttttcaatgtttctcaaaaccaagcaacagaaagggtaaataaaataaaacgtgaagccaaacatacattctgccctcttccaaccacaaggattcagaaatatttgcaacttctgatttggtgattaatttagcatcacttgtgaaattagtgaaattaaaatatttttcatgcatgtaatgttattctctagctaaggaatcctgaatgaaattttatttatgtagatatgctaagtgtggccataggaggttacatggtataagttaagtaattaataatagctgtaataaatgttattctaagaattctcacagtaacattttacaattagagattattttataatcaactgtattataaagataatgattttcttctttactcaaatgtagaaagaaaagttagctgatttgtatgttgctagccacatgtattatataaattctaatacaattacatgtcactgtgcttagtttttatgtcagacttgcttcaccattcacagttttcctttttctccttgaacacagatcatcagtaccatataaactacatgaaattttgtgattttaagtcaatcatgttttctcttcaacatgtgatgaatttcagtattaaatacacttctatgaaagaagcaaaaattctacatacttcataattcactttctaaattttgccttacaatattttattttattcaagtactgtgacacattaaatgaaacattacctgatcaaataaatgctaccaaattcttgtgctatattaattttctgagtttatcactgttctcatgagaaacctgaatttgctctttgttgccctttgtgaccttattctaaggatgtctacaatatggtccaatcaactttttcagtcttctttctctctccttcccatacttaccttattctcctgccacactaacctactctctagaatccaaacattcccagtgcttttctccctccataacttttctccttcataactgaaacacttttctctatcaaaacgcatagaaagaatggtcacccttcaaggaccaaatgccattagggcttttactattccattgagctctaatttgtatgcataaaaaactcattatagtctgccttgggtagagttttaaatgggttgaactctccttttcccactccatcttctggattaaaaattcttgaaagcagaaatttcttgagatttcttgcttttctattttaaacagcatttgggaaaatgctttgcccaaaatagtctatcagcaaaatataatgaaccaatatacattatgagtgaatggcaccaattactttggtgaggccatcccaaaataaaaacaatagttctttatacacttttatgtttaaattaagtgaaggagtaaggtgatgccatcagctctactttgtcttagaagtatacctacattgtctttaaataatgatgacatttagatgagatgggttgagttctcctcagagatatgttatgtctccagtagagttatagtattctccaatccttacctccaatgcgtactcactcccaacaaccactatctaaacttttggagctgctgctcatttatatatattccagaaagaatgaaatgcgtaagtttaaatagagaataaacacataattttaaaaaatgatttacataaataacatctattaaaattagctgctcaataaaatctctactagttgaaataatcatcaaaatagtattgattatactgatattaactattaatatcacaattatttgacttctctcatgttaaaactctattctagaaaataaataagaacattttccttagtatattaaataaacgtaaattttattttatgccttctgcaaatacttctgatattcccttttaagtaatattataaaatttgaggttgtagtagattgtgcctaatgtattcatcagggcttccatgttaagttattttcttagctttggcttcttcacaataaagaaacatgaacaatgtacaacacagaaacgacctctcaggtttgtggataatctgttatagcttgtcagaaaatgcaggggaattttatatttatggcttgaatatccctaaatcaccaaatccatccgctcttacttcctgttaagatgctaattcttgttagaaccctattatgtaactttcatattaaacacatcacagaattaatcctggctcttccttatagaacttaaaagaaaagcaaaggcatgcatagttaatgggcaggaggttagtaaggtttgaggtgtagtaattatcagactgggaaagaggaaaaatgagacatagaataagatataataatattctacttttggaaatcctaatcatgggaaatgtctagaatatatgcccacatatggcaaagtatctcctgtacccgttttttctttctattaatggtcacaaatcatgtttaatgatgcaagctggcatgtaagcctttgtgaaaatatatatatgttattaatctaaataaataaatatcatgggagataattgaaaattattttatgtcctacataataactaaatatcctgtagaaatcaagtaacttttttcacgtttacataaaagtcaggagcatagctagtattaagcctaagtgtaattgtagctccatgattcaactgtaccaccagattggcaaggtaaattctgagtgagaggatgctgtgttgggaaaggggactgattgtgtcctttgagcttttagtttaacaaatatttatttagaaccttatatgtatataccaggcaatgtgctaggtactgtgaactgaagattagttagatagcatttcttggggagcttctattgccctaaacaacaataacaaaaacaaacagtgtaatgcactaagtgatatatgatagagacatgaattttataggcagggaccttatcttgtactcttttttacaccacacaactcctggaattaaacaatttgttgatgtttgcctgttttatagaaatggaactttggcttcacttggggctacctccagtgtattgacataagaatacaactcacaaaaatactgtgatttgtattcagctagaagggctgagcttcccatcaacctctgccaaccaagtttgctagtcttaatacagttagcatttaaacgatttcattatgttgacattttaggtcatgttacaattgttagtaaaattaaaaatccacatgtgatagatggtgttacaagattccagtaaagtctgttaaagtgaattattttatgattattttctgattattccctatttcaaggatacaaagtaattgtaagaaagacagtttcttttcaaaagtgttacaaacttaaaccataacaagagagaaaatcacaacgctaagggattctatggcaaataccacaatgatgacattgaaaaacaaagcaaaaaaatcacttgaaatcacttgctatagtatataactccaaaagaatttgaatttcaaattgaacttcagtctctttagttgagttttatatcagaagaccaaaaactcagatccttataatctgcctcgagttgtacctcccaggaaatttgcctgttctaaggaattaatctgatatttctcttgaatatgttcttttgtcagtaaaaattagttgccattcacattagacacctaaaagatcaaagattggaagctgagaaaacagctcatccatgttattgcttcacttgatctgctgttattctattcattgtatcatttcatgggtgaaatgagagtctccttccaaccaagtcaaatagtgtcaaaattgtaggtgtaattagattgaactcttccccaaatctctaaccatagtgcacccaattgcttcctctagtgaaaactttagtatgacttaactatacgttcctcatgtaatttgttgaatgctgtctatttctctcaaatataattacattactttaaaaacatctttgaattctcctctgaataaatcattgatttagaatttcataggattgcatttatgctcattttaacattaaagaataatttgatcagaattaggtggttggttcttaacttatggtgagcttctttcttgcatcgtctcctacctttggtcttttctgtttatcagtatgtttcatccattgaagggggatctagagtctagtattctgaaatcatggcttcataagtactccaacttccgaacatctaaatctaagaactagcttttaaaatgtgttttaaccaaagtaaatttttaaaaattttacttctagggcttttagaattaaagaaatgctgtccatttaaaaggagtgtggctatttgggttaacatggtcttttgtgatttcaagtctccatataacatatcttacccatctctctagtacttacctcttcacttagattttcactcatattttatagactataattaagacaaaacatatctctagacctccatagacatgtggttttgttttatgcctaatgtaattctatgtgaactatgtagaaatagatgttctggagttaaaagtagtatgacaaatgttttgaacttctcataaatttatcctgaaggcaagcccacaatattaaatcatcatgtgtagaggaagctgtcctgttgattttgaattttttaaatataagaatcatgctgttcaggcaaaagccccaggaaaactgatcaatttaaagatgttttatcttgaaaattctttggaaagcccttttgttttaaggcttttgttcctctaagattagataaatgattttcagaaatctaagatacctcaataaattagtaaatctgttctctttcctttgggtaaatactgctttctccccattttactgatgaagaaattaagatgaagaaaacttacattaatatgaaggtaatatatctaataagtagtaaggaatgtctaaaaaattgatttactaccctctcaaagtccattccaaaattacagagacttttttgcaagagaaaaacaggatttggatacaaacagaattgaatttagatcccagctctgatacttattaactccaaagaagttatgaactgagtttgctcatatgtaaatagagataattaacgcctactgaacaatttccttgtgaagctgaatgtgataaacatatgcaatctgctgaatgcagcttattaaatagcagctgtaatttttttaaactatgctgcttctccataaataggcatatagcctcctccagtgaatctctgaagagggcaattttcatgtgaatataaaggtccaggatacctgtgaacaaagctgtattattttttataatctgacacctttttaaaaagttttattctatttttaattgatatatgcccttttgatatacctgtaagttggtgtcttaaagacagggataaaaaataatggtgtctttagagtaatttagcatgagaagttgattatttcctattttatttctacagttgttctccacatggatgcccaacagtggaaaccaaagaccacttcctctaggctgtaatttttgtccttactggtcttgcatttccagcttggcaccttcccaccattgtcatcacagggtatggtactgaactaaactcagaatatagcaaagcacctaaagatgagccgctagtcagctcagaactataaaaatctcacgccgaaccccaacataccacttacttgttcaatgacacactgctgggtttgaatatggagcaaaccaaggtttaaatacataattttctcttcttcagtcttaggcgtgtatagagaattgctaccccattctctctacctcacttccccaaaagttgggaaagctgaatccatttatgttcattgtttgtcatttcaccaacatcctccatccttataggaaatgtgcagagtttaggcagttaccttagagcactttgtaaagatttttggttggcttctcctttttatgaagccaacaattatgtatctgttttatctcaacattctccagactctaactgttgcagcatcagaatctgtgtagatatcaataccttctggaaatgaaataattcctttgcattctctttccctcatgccttcctcctcttctgtagtcccctttgtttacccaccacttcctgcccacaaagccacccattctgccatcactgccatgccagcttccttataggaatattgccatggtggtcttgatttgtacatagaatcataagagacattctgctctgttttgatatagctgagaaaatgacccctgctcacccctgcagactcaactggcaaggaaacttgaagctgtagcttcagttgcttgtaatgctttttaaatagacctttctcattaaagaactgtacatctttgaacctcatgtgataagtgccctggcctctctttccaagaacacctaggagaatatgacaatgagaaaacaaaacaaacaaacaaacaaaaaaaaaaaaaacaaggtagaggcatcacagaagtcccaggaaccatccagccttcatggctgagaagtcatctttggcagctgccaatcaacattcctgtccagtttttaagctcagagtattttctgctcatctccattcattgatgagagtttatctaacaactactcattttaagtaccagcttattacagggaagcacaaatatatagtgcatggcctcctctagttgtcaagactaaatgagcattgatgaaactgggaaaatagagagatcatgtgtaagtaagtgttgaattttgtgttacagaatgtaagtacctgacaagcttgtaggaaaaaaaatacctaaggaagccattgttggtatggaaagcttcatggaggtgtcagtaattgccagatgggtattgaattagctcttcatggaattaaatatagatgctaagaatttattcagctccttttcctctacaatgagtagtctcaattatatgaccctgtagtaaaagaatgtttacataaactcctaccattttgtagcatcttttgaacactcttcatatctcttcacttggggatgctaaacgtggaagcaggaagtgtgtagagtcactctgactgtaataaaaagaaaagataaagatttctacatctgcatacctatatcaatagtacatgtgaatgtcagttcatgcatacaaaaaccataaattacctttggcattctctcctttatattaaagcccctttcagtggtacttacttttcattatttgaatcagtgcattgatcctttattcatcttttctatttttctcatttctctttatataattcatatcaggctattctctttcacgagagtgttcacaatggcccattttaataaacggacctgtatgcagaaatatttaaagctggaagtcaccttggagaatcaacttctcccactctctcatttcacagctaatgaaatcaaggtcagaatagatgaagtgatttgcctaaggttatggactaaatagaggcatcagaaataggattataagatacagaattttacttttgtcattatgtaaccttattaattgaacatttatttatgtgacaggtactattctaggggctggagaccaaccaaagcccccccaggtacaattctgctcctgatattcacatctctgcagatttcagttagatgtgctcaatgtgactttccgttatagattttggtaaatagttttgtttcttcatgctttgatagtgcccttatcgtcactcagtcccaattaacttccccaagcttctcatttaattaattcccatcctttttttttcaaggtacatactagctctcctgacttagtgccatcctgcctcattgtcatcccccctttctaaaataattattttgagtataatgaaatgttaaacatgattgaacccagtatgtgattattgtaactctggctgccaacagatgttttcgtatttgttgacttgtataataaagtgtcaaaacagaaaaaatgagtagttctttcatccctgccccctttccctttttaaaatctttgttactaaacatttgttctgtcataatgagagcgggcttgtagacttatgcctcttacatggttgtcaatggttagacaacaaaagagaaaaaataggaaaattcttctgccctaaatatgaggtacaatcttttggccttctaccttcatttccaagaaagtccatattctgaaccattaccttccatactgttcctaccagcaaccccacaggtacttctagtggttacctgtaaccatagaacatttctttgtttactctattacttgatgaattctttttctttcactacctaatactctttagtagttatccaggtaaacattattatcttctatagctgtagacacaatcagataatgttgtgcttaatgaacaaaataaaatagccacagtttcatgtaatacagtattgataatgaaaatggcattttatttttgtttaatatttttaaaggatagttgtatggtctttttttggtaatgtttattgctctataattttaagttctcacaaaaagctgcagggatagtacaggttctcatatgccctctaccttgactcactaattatttaccttttgtcatatgtcattttttctctatcttctctctctctgtgaatatatgaatatatatatatatacacacacacatatatatacacatatatatacacacatatatatatacacacatacatatatatatatagttgtccaatacaggcaatttatctttaatataatggtattaatataataccattatctaaatcacaatctatattcaaatttcatctactgtcctaataatgttcttaacagttaattgttttatttcccactggtccaggatccaatctagaatcatgcagtgaatttagttgccatacagtgctttatttttgtgttgaaaagcttacattaacaataatgatctggacagtgtccttttaaaaataatccctgcttactgactgctgttccaataataagaatttaagtcaaaagatatgtaacaaaatcccttaggattagtgatatctgtgctgaggatatctgtgcacatcaaccttgtaactattttctaaccaccagttttggcatttcaatgggagagggtccaagacagaaaactctgagtttattaatattttacagttttgaaatttaaaccttaggactaggattctactgccattctagtccatcatgggttaaagggatagtgtttataagtagccatggaacaaggattcacagtgccctctttaaagccaatcctaaataaatatttagctcagcactatgctaccgaagcctcaaataaaatcaatattctcctcaaaagaaatgcttgatatatttaaaacaaaacctggatgtaaatatgagttgtcattcttgaaagtaagttatctttttaaaaacatacagctatgcacttttaaatgtccaacattaaaatgaatataaatagttgtcttcctccccaaaaatgccgcaaaaattatttgtatatttctgatgcctaaagcatgcagtgttttgcttaattctgtaaatagactatggttaggtctacagggtgtgagcagtttgctttctagcctctgtcgaagcaacaataatccctaaatctcagatatattttctcaatgtcaagcctgtttctaaaactagatacaaaaaaacactaaaaagtcatcagctttaccaactatgaatgtatataatattttgtgaaaaacacacaaccctacctaaacagattaatgttctttaaaagtattgtacaaaaacataaaagtatcaagccttgataagagaaaattatctgagtcagttaataccaattacattactgaaacatcagatagatgatggaaggtgcaaaataatcctttgctatgttcactttctcctctaaaataaagacaaggcatttatacatgcaagaaatagaaattagctaccagaaaaatgctgtgcccatccatattcagagcatagattaagaataaaatagttttttaattgattctaccacattttttatttttttattttttatttatttttatttttttattttttttattatactttaagttttagggtacatgtgcacattgtgcaggttagttacatatgtatacatgtgccatgctggtgcgctgcacccactaactggtcatctagcattaggtatatctcccaatgctatcccttccccctccccccacccaacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtaatgccgcaataaacatacgggtgcatgtgtctttatagcagcatgctttatagtcctttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtgatgatgagcatttcttcatgtgttttttggcagcataaatgtcttcttttgagaagtgtctgttcatgtccttcacccactttttgatggggttgtttgtttttttcttgtaaatttgtttgagttcattgtagattctggatattagccctttgacagatgagcaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtactgaatggtaatgcctaagttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccctgctgttttggttactgtagccttgtagtgtagtttgaagtcaggtagtgtgatgcctccagctttgttcttttggcttaagattgacttggcaatgcgggctcttttttggttccatatgaactttaaagtagttttttccaattctgtgaagaaagtcattggtagcttgatggggatggcattgaatctgtaaattaccttgggcagtatggccattttcatgatattcattcttcctacccatgagcatggaatgttcttccatttgtttgtatcctcttttatttcattgagcagtggtttgtagttctccttgaagaggtccttcacatcccctgtaagttggattcctaggtattttattctctttgaagcaattgtgaatgggatttcactcatgatttggctctctgtttgtctgttgttggtgtataagaatgcttgtgatttttgtacattgattttgtatcctgagactttgctgaagttgcttatcagcttaaggagattttgggctgagacaatggggttttcttgatacacaatcatgtcgtctgcaaacagggacagtttgacttcttattttcctaattgaataccctttatttccttctcctgcctaattgccctggccagaacttccaacactatgttgaataggagtggtgagacagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcaactattgagataatcatgtggtttttgtctttggttctgtttatatgctggattccatttattgatttgcatatattgaaccagccttgcatcccagtgatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtgggcatttagtgctataaatttccctctacacactgctttgaatgtgtcccagagattctggtatgttgtgtctttgttctcattggtttcaaagaacatctttatttctgccttcattttgttatgtacccagtagtcactcaggagcaggttgtttagtttccatgtagttgagcggttttgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagggttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtgggtcactcaggacttgctttatgaatctgggtcctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatatgccagtctgtgtcttttaattggagcatttagtccatttacatttaaagttagtattgttatgtgtgaatttaatcctgtcattatgatgttagctggttcttttgctggttagtcgatgcagtttcttcctagtctccatggtctttacattttggcatgattttgcagcggctggtgccagttgttcctttccatgtttagcacttccttcaggagctcttttagggcgggcctggtggtgacaaaatctctcagcatttgcttgtctgtaaagtattttatttctccttcgcttatgaagtttagtttggctggatatgaaattctgggtcgaaaattgttttctttaagaatgttgaatattggcccccactctcttctggcttgtagggtttctgccgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccagtcagacgtagacttggtcttttcacatagtcccatatttcttggaagctttgctcatttctttttattcttttttctctaaacttcccttctcgcttcatttcattcatttcatcttctattgctgataccctttcttccagttgatcgcattggctcctgaggcttctgcattcttcacgtagttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacgctgccgtgtgaggtgtcagtgtgcccctgctggggggtgcctcccagttaggccgctcgggggtcagggacacacttgaggaggcagtctgcccgttctcagatctgcagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcccgggcaatggcgggcgcccctcccccagcctggctgccgccttgcagtttgatctcagactgctgtgctagcaatcagcgagactacgtgggcgtaggacccgccgagccaggtgcgggatataatctcgtggtgcgccattttttaagccggtcggaaaagcgcagtattcgggagggagtgacccgattttccaggtgcgtctgttacccctttctttgactccgaaagggaactccctgaccccttgcgcttcccaagtgaggcaatgcctcgcccctgtttcggctcgcgcacggtgcgcacacccactgacctgctcccactgtctggcactccctagtgagatgaacccggtacctcagatggaaatgcagaaatcacctgtcttctgcgtcactcacgctgggagctgtagacagcactgttcctattcggccatcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttggtaagtagtaatgtacaatgtatatagtgtcaactattctcttattttttaatagaatgtctttgtcttatttaacaggtttttttcccatatttcttgtaagaagctctgtgtcactgtttaccttaatgtgtatgtccacagaatcttgctctagtttttgttttaataaaaaagaagtgtccgtatactaaaactatacaaagcatatctaaaattgattatggctctaagtcatgtttttagaggcagtcaggcaaacctaggtgcattttaacattgctcttccaaatggattttactaagaaacagttgagtttcaagcaggaataaaggaaaagcagatcttggagatttaactgttgagcagatgcagtaaatgaggttttggaaataccgctgtcactttagatattttatgctgagttacctatgtgacccaatagctagagctgctgatattaaaatatttttgtaattctgttgaaaatagatgccatgagaactcttaaaaacagagtaacatacttattataagacctattttaaatatttcattctttcctcattttcatgatacctaaattttttgaagactgaaaatgatgagaacttatataaaaaggtacttgtctgtagcatcatggaaattttcatttatgagttgttaacatgtcaaaccaaatcagaaattcctgatatctttattacattaaagcaattcttaatgttgcctcttgagaagggtttaatttttttactctttaaactgaaagtttatcttttttatgcaatgacgtgcaatcatttttctcttaattcctgatgggcttgtaatatatacatatttatttgtgtgtgtatgtacctacatatctattaatatgtatataaacatgtatatttaaatacatgtatgtttatcctatgtactagaatagttagtaggttatatctagatattgattagcttctgaaaataggcaaatatgtataacatattgaggtgtttctaacatcggtgaaaaatataaaacttaaaagtaacatggggctgtacaaggttgatttgtaatagtcatattggtaattgagacagcaccagatatttaattgactaagaatcatgtgatttatttcttaataaatgtaatattctctaatgtctgcctagattagtgttactctaatttcaaattaaaacactatagaaagcataattgacttttcataaaatcagtatataaactatccacagactctcaatctctagctcatcaaacaactttaaaatccaaactatctgtattatatatactaaatatggatatatatgacattatttttattggaatatatagtaaaattttaagtagaaatattaaataataaaattaacatatttatgacaaaaatgattctgaactatgtgtagtcaagtaacctctgtatatattgttttccttttagaaaaacagaataattctgaaagaaagaaaacaaagaaaaacatactccagaattcctaatagaacagtaagtactttaatgacacaatgatgataataaatctgtaaaattagagcttacaaatgtcttttatagaaatactaacttctattttctaagataataaattagtagaggaagcaagttgagccttctctttcaatttactggagtaaactgaaaatcatttgtcctataatcctcttacataagagggcaaagtactcgttgtgatacatttatggggcagaaaacgtttatgatgactccatcatatcttttgactagcatagtatcatcttaaattctaaagaagaaaacagtaataagctagatgtaatcaaagtgcctcattttctccatatgtgataaaaagtttttacttattttgaacaaaattttaaatactattgatgtgcttggtttatttataatcactaaattgggattattaaaaaatggcagctatctgcaggcttaaaatctacaccatattctcattagtacatttgtttctaatctcacaacttaactaaaagtgtatttcctagaaatgtatttccttgctattgtttgatgataatatagttttcctaaatatgttctcactaagcaaagtacatgttgatgtcaatctttatggtaaaattggtgacaatataaaattttcaagatgcaggcaattataaattttgaatatgtgaatatgaagaacaataacataaagatagaaaagcaaaacccatgttgatgacccacgttgtatcacatttaatatttttgaaactgcatttgaaattgcatttcaaactcaatgtttcaaaagtttcaaacaaatattagagtaaaacatagtataataaattaacaaaatgaaacatctatatcttagtacatatcaaactagagtcaagttcaatggaaaaaaatgtaagtttgatatataaaaagtagaaatttctaaataattttataggatatatacaaattattcctgcataataacattttttagccccaaagaactttgatgcataaattacatcttaactttgaatgattgggtataattaatcatcatcacgatgatataaatgaagtttatctgaaatatattttatttatttttgaggtgtgagaaaggcagagaaaacacatttcttttacctgcctgtctgaaggttatgtatgttacaacttcacacaaagcactctgccacttactttttgttgtagttatgaacggccatatattttaaacagaaatctataaaatttataattcaaaatgtttacacttttaaaaactactctttgatttaaaaaattaactctaaatgtatgaaagtctattttgagtattcagagcaggttacgggcatgtttacatagttctgggtacagggataatttaagaatcagatttttctgtcatatataacaatttttgaaacctgcaaatctgcgtgagttacaagatatgaaataagtgagaaatttctttttgacatagaaattttttatcatcttaataccctaacatagacaatgaaatcattcagccaaaacaaacctttttcaacatctaaaagactagactgtcttaaagttttgtttttatatatataattctgtttctaaacataatttcaattctgtacaatactcattggaaaatggttgaattttttaaactgacaggactgacataagctctttatgcaagaaccaagtgatatctacttcactccctcacaatttctcggccctctgagtataatttcatgtgaaaagccatcaatgactccttttctgcgctgatttatgtataagttatttgatctattgttcaggtgtgacctatataagttatttgactggaactgtaattttcataattgtattgaaataggatttagcctagcatacctcggagacatctcattcaagtaatgagatctcctgttcatttgcagtaatcttagaaaaaaataacatacatgtttccaaagaagaaattatgcctcttttcatgcatttttatgtggtttggagcaggttttaatctcagattttaattacctattatttaataattatatgctaaatcactcataaattacatgcaaaaaaagactcttcttattatactgtaataaaaagtataatttatcctttaaaaattttatcagatattgtgaagaggaatactctgacttaaatgacattgtcaaaacataagagttcttaaaatatcttagccactaaaggctcgtgagttagtgttagacaatacatggaataaaacatgatatcagatgaatataatagataatacagtgacattttatctatagattgtgcatgtgtttctagcccatgaatgagttttatgaattgtattggaatcaaaactttataaatgaaagctttttagcacaggaaagctctacaaacctcttacaattttgcttttaaatccatagcttaagaacaagttgataattgattaaaatattactataatattgctaaagacgcttagagcacattgcatttattgcttacaaaaggtttttgtgcttaagaaatataaaagataaaaatataagatgctttcttataagaatagaaaaataaaagaccactggaaagtgtattctaaaatacagttgactcttgatcaccaactcccacacagtcctaaaattccatggttaacttttaactcctccaaaacttaactactaatagcctactgttgactggatgttatcaataacataaatagttgattaattcttatttttcatgttatgtgtattatatactcttcttaacaataaagtaggaaaagtgaagaaaatattactaagaaaattgtaaggaagagaaaatgtatttactattcattaagtggaagtggatcatcataaaggtctccatcctcatcttcacattaactaggctgaggaggagaaggaagaggaggggttggttggttttactgtctcagcagtggcagaggcagaagaaaacctgtgaataagtggacctgcatagttcaaacccgtgttgttcaagtgtcaactatagtcatctttcttttgattgctgaagctcagtaatactttcaagaacttcatagtctcctccttgtaaactctgatcacactggatactaataataaagagggtgtgtttaaaaaatcattcagatgctcagacatccgtgttagaaactcttcatattatcctagatttcctaagcctctttaataaaactgggagttgatacactcactcaaagtgtgacaactattaacaacactgctttcctgaaaaaacaaatatagcaagaagtttttagtaagagtgattctaatggaaggcagattttaaccaataaaacatcttgtggctcattagagaataaatattatttgcaaatatcccaaatgttacctgcaaatgctcctgacaagttttacttagtcaatatttccctattagaagtaataaagtcctgcaataaaaaagcataagcctgtgagtgtgtgtaatagtggcataaagctaggagaaaatttagaggtcacctattctaatattttcattttatagaggttacctcctctaatattatcatttatatatggcctgataggtcaagtcatttgcctaagctcttatatctagtgatagaattgaaaaaaaaatctgtgctaattaaccacccaccatttttttctatctgccatattaactgaaagtgctgttattaaaaaatgcatgtgtcggaactgttaaaaaaaaactcttctccaaatttaatcttttttcaaccaaaacactagtgaaaatttatgtaaattattgtttgtctaatctctagtagtttaaaattgtattttgatatagtttattagaatgatgtttataaaagttatatatctccacagtataacctttataaataaatatatatatacatatatatgtatctccactatgtatgtataaagagagctcatttatataggtatttatttatttatatttatatatatctctactatatatgtataaagagagaggtaatctgagtcttggcttaatccatctccacctaatatttattaatgataagtagtaaagaaaaataacatatgcacattaagttttcatgtgcagcgaatccataggaaaatgtgaggacattcaagattacacagtgaaaaaacaactagataataataatatgtaataataatacataaaagcaatctgccatcagcaacacttaagcagttatctcaatgagtctcccttttctcatctgggtaatgaaaaatgtctacccagcatacttcccaagattctctgagattggattaagtatatgaagatctctatagtgatatttaatttaaaattcttatatatattatcctttccccattgcttgtttttgtcaggtttgtcaaagatcagatagctgtagatatgcggcattatttctgagggctctgttctgttccattggtctatatctttgttttggtaccagtaccctgctgtttcagttactgtagccttgtagtatagtttgaagtcaggtagcgtgatgcctccagctttgttcttttggcttaggattgacttggcaatgcaggctcttttttggttccatatgaactttaaaatagttttttccaattctgtgaagaaagtcattggtagcttgatggggatggcattgaatctataaattaccttgggcagtatggccattttcacaatattgattcttcctacccacgagcatggaatgctcttccatttgtttgtatcctcttttatttcattgagcagtggtttgtagttctccttgaaggggtccttcacatcccttgtaagttggattccctatttaataaatggtgctgggaaaactggctagccatatgtagaaagctgaaatgggatcccttccttacaccttatacaaaaattaattcaagatggattaaagacttacatgttagacctaaaaccataaaaaccctagaagaaaacctagacgataccattcaggacatatgcatgggcaaggacttcatgtctaaaacaccaaaagcaatggcaacaaaagccaaaattgataaatgggatctaattaaactaaagagcttctgcacagcaaaagaaactaccatcagagtgaataggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacgcttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttctacactgttggtgggactgtaaactagttcaacccttatggaagtcagtgtggtgattcctcagggatctagaactagaaataccatttgacccagcaacaccattactgggtatacacccaaaggattataaatcatgctgctataaagacatgtgcacatgtatgtttattgcggcactattcacaatagcaaagacttggaaccaacccaaatgtccaacaatgatagactggattaagaaaatgtggcacacatacaccatggaatactatgcagccataaaaaatgatgagttcatgtcctttgtagggacatagatgaagctggaaaccatcattctcagcaaactatcgcaaggataaaaaaccaaataccgcatgttctcactcataggtgggaattgaacaatgagaacacatggacacaggagggtgaacatcacacaccgaggactgttgtggggtggggggagcagggagggatagcgttaggagatatacctaatgctaaatgacgagttaatgggtgcagcacaccaacacggcacatgtatacatatgtaacaaacctgcacattgtgcacacgcaccccaaaacttaaagtacaataataataaaatttaaaaaaattcttatatatattatataaattcttatgtataaaataatgcatattaactttaattaaaattattttataatattgacaattatttaaaatatatatcaccaataaaatatattgatttttaattaaaaataattaaaatttatatataaataaacaacacttatttttaaacaaacaataagtattattacataaaacttagactatattattgtaaaaataagttgtttttgtgaacatttgccttaattgtttttggagtaccatgcatcattttatgaaggcatgtttctgaaacaaccaaagttgttggttgatttttgctttaggcaataatgatcatccagaaaaaaaattctctttttcttgaatttataatttatctttaatcctgatctgtgttcccacacataagcctaagagagttcatatatagaaggaagggagttgggaaaggaaaggaagcatttattgggctcttgttttgtgtcagctgtttagtaggcattgaactaaatttcatttaattattcaaagaattcttctgatgttatagtggttttgcagatgatgaaaatgtggattgaaaggtttataaggttagcttacttagtatgcagcagagttgccatttaaactcaggtctgtctgatttctccttttcaagttaggactcaactaaacggggacaactagtgaaagtaaggcatatttcaccttcctatatgaatgtctatgcaaaatacttaatgtgcacacgttacttttcttttctacttatcatcaataaatattagattgcatcatgcatatttgtccttcagatgctaaaaataaaccatggtaggagaatttaattattaaagacagcaatcttttgataggaaaagtagaacccaaatcaaaatggattatagccataagtataaacattcacctaaaggagaaaaacaatatttattttgtttgtaaataacaatacagtggacattcaccatatatacttagatttttatacatgctacattatctggacttattttctttaaaaactttggtacaactttggaaattcattcctttatccttcattctttattcaacagctgctattgattacccactgtatacatagttccaggtgttttagatataggaataaataaagtatagtctctgtcatcaagtagtttatatttttagtaattacaaatatagaaaagtttgcttcataaggagaataaaagttatattgactataagtcatagattttcttttcaagctactcgtctgtttaaccatgatcagattaaattatgtttttatttgtcaaatgattcagtgttttgtcactttccctggaaattgagtaaaatgggtttcccacaatcattattattcatgataaatctaaaccatatttcatgatttacagtattttttgatacactaacaaaggagtcttttataatcttattatagcatagtactggctttgaaaattctctatattcaaatgccagctccaccacttattaactatgggatgtaggacaattttttagacctctgtgagttttgatttctccattgagtaattgtgatattcaaatgagtcaaatataggcaatgtctttgtttatataagtgtcttgttgattgtagttactgtattcaagttagctattataattagttgatagaattcagttcattgtttctaaaacttcttattaatctttgatttgtaagctctcattgatattagtctttattttattctgaaaaacattatctttcatgactctgatatgtaagttgtctagtcaaaagagataaagtggaaattatttaaccagcatttacagttttaaagaaatcatgtaaagtccaaagttaataagactttaaatcaaatgatttagctatatgaattattagttttgatctgctataacattatgatttatttacttggctacaccagggttttgccttgggttgcattattctcctttgtaattaagaatgtttgcactggataaaaaactgtattcaagtgctatttctgccacttactacctgtgtgtcagcaggaaaacaaaataagctgcctcaatgtcctcttctataaaaatgaaaatgaatcctattttatacgtttcatatgagaataatgacatgtttattaactgcttattacagaaattaatatagtaacataagtaaaaattattgttgttatatttgttatttaaaacatcttagtaatatcaaaggggcattcttttctttcaaatttatttatttattataaattgacatcttttaaattataaaacatagtcatgtaccacctaacaaatttcagtcaatgatggactgcatatatagcagtgacaccttaagattataatatcagatttttactgtaccttttctgttaagatgcacagatacttaccaatgtgttataattgcctacagtattcagtacagtgacatgtacaggtttgtagcccaagaacaaaaggctaaaccatacagcctaggtgtgaggtagactgtaccatctaggttagtataagtacatgctatgctgttcagcaacaacaaaattgcctaatgatgcatttctcaggatgtacccctgttgttgagtgattcataactgtatatagaagtctagatggaataaagaggaagggaaagtgtgagggaagaaagaaaaggagaaaagtctggttggaaatctttaacacaagatgaaatttcgatttgatagagtaggatgcaggcttgctttgggaggagtccatcaggagccctctccttgaaggcctcttccttcttaaagcaaacacagaaattagacaatctcaatagcatgactcacttccagaaaggtggagagtaaagcttgagacattttgacagtcttcgtggccctagaagtaggctgaatcagtatgcatcacgatgtgaagggtagcaaaaatgctttctatcttatcatgaaattattttctttgtaataacaaaggggaccacttcctccagagaaaatagacctaaccaaactctagactgaacagatgtccagaaataaattacatcccacacattgttattacatgcaccattttaaagttaagggcagtatgatgccattacatggcaactctcattttaaaaaataataaaattttgtatgtgatgtctgaaattgaaatcacagcattattcttttaccaaagaaatctcagttgacaaagttgcttattttgctgcatttttccctcatgatacagaatactgtttctcctcattttaaaacctcaattaattatcttcaaatgaaaattttcatattcaccattttaagtggttttgttgtttgagtcattcttttgcaaacaccataaaaatccctttacagtctgacatgggctatcaatcctaacaccacttctcctttcaatgtaaaatcttgttatgcctctaaagatgagtatatcccagtcttagtaataactattcctgtttcagcagaaagtaattcataataagtatcttagcattttcctcctttccttggaattgaatcattacaaatactgacaattttatttcttttctattctgaaagatgaaaaatctggttcagcatatgctccattgtacatttgagcaatctatatcctctgttcttatggttaatatgaattgcttaatcctgtgattgtttttgttttccattttcaaaggaatcctggcaaagcctatgttcatgaatttgtacaaaatgtttcagactaaggaaaatgtctctaaacaaaagctcaaaatacattggtttctaactcatatgaccccccccaaatgatattatacaatttttcaatagtctgaaatatattataagaaataattcttagcagtagttttgcaagttgctcaggatttttgcttatccattttatatttgcatgtggcattgacacaatttgctataacatctcctaggaagtaatatattttttttaggcatttactatttgagctgtgaaggttagtcttagatgttctttctcttttgtactttaaaattttttttctaattttgcacaaggtaaaaatgtttttaataccctctatgtcttagactcaccatgcaggggtgtccaagggagagagtacagtcatgggttcttagtttctgtttctggttgggccagtaaaaccccttcctcatccctccttcctgcttacaattagacacagaaaccaaaaattatggcttcaggctgctaaaagcctgaaacaaaacaaaataaaaacaacaacaacaaaataaggcaggttggacaagctcatgagcattacatatgtcacaacctttataataaataccattttattacagaatgcaacaaaataattatttgaattatgcctagtaacataattccagaaagaaatgggtttggacaattgtatatttatggatatatccattgttcccattttaagaagtgaacaattattagtgtgtttttttgaaaggcaaagccagatttgtcattaaatgagacagctaaaagaatggaagcaatacaagcagtccccaacttatgaatgagttatataacaaaattccttttaagatgttttctttccattttataagatggatatttatcgacagtggccacacaaaaaaacctgtgaaaacccacagcttatgctaaatgacaatatttttagcattggttatggtgactgtgtgagtgagagggacacaaggaaaaacatgtttctccatttttcctgatactcagttgaccctgcccaatatgtgaaaaataactaaagccagcttttcacacagccttctctctctttgtcacctttgttttcttcctgaggtaatgctgtttcccaactgatattctctagctgccttttctttaaagtggttttggtttccaattttctaacccaacttatctcttgatcaaaatgactcagtacagctggtatggggaaatgtctaagaaaaaataattgggccaaagtgtccacaccagccctgcatcttgcatcccctctgcttctcacttcccgacccccacaccacaattgttaatttaaataaacaaataacttaaggaatttctggcagtgtggggtcctggagtgatacatgtatagatagtatgggtgaagatatttggagacaggaactgggataggtgggaattcagccttaaatgcagcatcccctgcactgctcttgaagtgatacattttcttcaatactatacttaggagcctatagtttctttattttaatacatacacattttcccagtgggtcttgcaaagcttgtgatagaagatttgttaatgaggtatgtattagtctgttctcacactgctaataaagacatacccaagactgggtaatttataaaggaaagaggtttaattgactcacagttccacatagctggggaggcctcacaatcatgccagaaggtgaatgggggtcaaaggcacatcttacatggcagcaggcaagggagcacgtgcagaggaactcctttttataaaaccatcagatctcatgagacttattcactgtcacgagaacagcatgggaaagacgcccccataattcaatgacctcccattgggtctctcccacaacaggtgggaattatgggagctacaattcaagatgaaatttgggtggggacacaaccaaaccatatcaagatgtaataagctagagataactgcttcattttttctaaaatgtaaaagtaaatgtaaaatacatgattatataatattgtttacctatattttaattttaattcttttcaatacctcaaatgtaaaaccatccactcataaagtaaattttaagagttacctctatatgaaagaaatcgttatttgtgttagttataacattccttatacctggccacccaaaacaagaaaataatcaagttttcaattttcaatttttttatcataactctggatataaatataactaaaatgttttcagtaataactccatgcacaatgatcaaacaaatgctgtacttgttgtgggctggcatcaacaattatgaaagtggcttggtaaggccaggccagacctttgtaaccagttataccaggctactgttagacagccccagatagcccatccctctgcctcagggcttatggaaacagtggatgttggtaactgaacacttactccctgctgcatgcttcccatgtcatttcattcctgtgaagtgcattttcatatctatatttcataaatgaggagacagattctgaaaggcaaaccaacttgctcaaaataactagcttatatattttgagccagatgcagactaaagtctgtgtaatgctaaaacctgtgctcctagacattatgcaaactgtttcatgggcttacactgaaataatatctgatgaatttctctttgcataagagagtgagctccacaagtgtggtaggcagagcatcctcctatctcagaacctgacacagcgaaggtgctcaatgctggttgaaccaaagtgacaacttgtttatccagctctatcatagcagtaactttactaaaagttctctgttcccttactttttttcagaaaagttatccacgtccccaaacaaaacctacgtccctgtaacaaaaagcttttattttcaagagctgtatctttagccatttttttaattgtggtaaaatatatataacatcaaatttaccattttaaccatttgaaagtatacagctcagtggtattaagtacattcacactgttgtttgatcatcagcatcagccaccctcagaattttttcatcttcccaaagtgaaactccgtacatattaaacagcaactccccattccccctccctgcagcccctggccatcactattttaccttcagtcttgatgaaactgactattctaactacgtcatataagtggaattaaacagtatttttccttttgtaactaggttattttgtatattgtcaaggtttatccttattgtagcatgtgtcaaaattttcttcctaaggctgaataatattccattgtatgtatatatcacattttgtttatccatttatctgatgatttattgagtaatggagttgtccaaaatgaaatctttttgccaattctttgatggaaagataagatgcaaatatagaaatgcaatgagttcatgatttttagaacatctctctttttatatcataagccctaaaattaatcatggaaaactagttcagtttaggcaatcagcaaaaaaaaatagatgggcttaagataatttaggatttatgagttataaatatgccacattttaactactcaggctggaattagcctgtcttcatttgattatctgttttgatacattgactgttcttcagaagattcgtgaagttagggtatttaaaaattgccatttctctaaaattaaatagaataatagggaagggagcattgattctaaataagaatgcaaatttatagccatcaagttttctactactaccatttaacttctaatcagcgtattatggaatattcttgttcaagaattggtgtctgaaccttaagtcaataagaaggaaataatctatacagtttttagtattttcagcagttttccttatgtgctaaccaataattttttagctggcatttatcaatgccagagacacgctcatatacacatattatatatcctataatacacagcattatcctctaatcctcacactgaaaagtagacatcatcaccattttacaaatgaggaaggagaggatcagaaaggttaagtgactttctcagttaataactggcagagttggcatttgagaacaggacttctagatacaaggctgctgctctgtcacctcacacttcccctacatgttgtgaatggtgctgggccacaaaaatgaatgggacagtctccaccctggaaaaatttatattatactggaatggatgggcatttttaactaattaaaatataatagtatgaagattagaagttctttggatgccagcaggtagacatagcttaacagtgcctgaaaagctttgcaaaggaaagggcattccatcttggccttacatgacttccttccatgctggttttccattttaattagtaaagaatttagttaagcacatgggatgattggttaaagttgaagctgtaatgagatcatgaaggttaaattaaagtgtttgaagtttatctcttagcagtggaaaacaaatgtttttatgttttcattcttgctacttttttctgcttaatctaccattctgtagaagccttagtaatagaacaagcgaaggagaagaaaaagataatttttttaaaaaagaatccttttatgagcttatgctagcttattttaatgttcttgcattataggcatgattaaagattttaagtgtatgactttgcattttgatcagagttatcatctccctcaaggctgctcaataacatgatccataatgacattttgttgttattttctgacctgttgggtgaggcactaaagccagcttccctaggtctatgtagctttaagttattgcagtgaggaaatttcacagtgctgtcatgcttttggttaatacagttttgtgttttgcttgggaaagacaattctgagagtgtcctattgattcagatgttttctgacagtagctgcctaccaggtttgccttcattgacttttcaatgttctgttacaaataacttgcatgtacaatttgatattgaaaagcctagaaggttccccactgtgcatgaagttagagcagccctgagccatggggtggtgagtgcttattatcattctgaaaatcatccacttgtcctaggctgttgccataaaagggttgtgttttctctgttattcttttttgttctcctgcttcttttattctttcagacattccaatgcacttcttattctttaaaagtttaaacttcattcttaaaaattccccatggtgactgaaacttgaaatataaagtcacaggtgttttctgatatttttgaacacacggaatgtgagatggcttggattggaagtacttattttgttagtacaatttaaaagaatcacttctgtgagattttcctaaaatgatgaatggttagaaatgttcttttataatcataataaaaataactaccatttatcgaatgcctaccatctgccaagatctgtgcttagcaactttcatgctatctataatattgacaactctgtaaggtaggtatcattaaaccatttacagataaagaaacaaagactctgagaagttaagtgacttgtccaagacaagaatgattacttctatctttctaattgtggttgacttctacttattaaaaatgatggtaatatcatttgggtttgcagagcacgtcacggtttacatagcagtttcacatatgccacctcctttaacctcacaaaactgataactatattttgcatttcaccttaatctttgtgagaccatcttgaggctttagatcagaaatggggtatgaatttccttgtgctgaaatatgaccctttgttaagttagcatcatttgcaaaaatgtcttcttttctaccattactagtttatgcttctattttatcaggggagaaggcagctggagaacttgtctgttgatgcccttgaagagtttgtgggattatgtttacccagaaaatagttgcctgtagcaaaagcataataatgtttttgagacccagctgctctgcccctgaaaactatgtaggaaatacttacatagctgctatttcctgctctctcctcccaggatcccagcccgtggcatctctgcctttcaaagacattccactgtgcagtctgtccctatgtctgcttgtaaaccaaagcataatgttcatttacacataagtggaggagggggaaggagaaccttatagaattacaaataagataatattataatgggtaataagtacatttctgccttatcaccagtatttccaaaacccaatggcatcaaattctctgaaataatttagggctctgaaatgggaattgggtaaagaaaataagtaaaaaagttgttggattcaatagggaaaaataataaaacaaatacagtaacaggtacactaccctcctctatcccccttgggaacaccaaagcaaacccactcacccttccaaaaagtatcatttctttcaaatatcagagctttgacccaggagtctgacctcacttttcctgacctaactcctcctaggcgagattggtttctccctctcttctgtattctcaaagcacctaggacatgcctctgcttcagtatccatcttctctactggacatgagcaaaatgagccccctccttatccctaccattccggagaacagtccatcacttggagcataaagcttagtgcacaagtagatgaatctattcagccatgcaacagtaccagaccttctgttagtgctgtgtgctacactcagagaatgtttaaagaaatgaggaatgaagaaagggagtgaagaagacagggaatgtaggaatgagagagacagggaagaaaagactgaaggagaaaggaaagagggagtaaggaaggaaggaaagaagaaagcctggcccaagatgtgaataagagtgtaatgatttcacttatcacatagtatttcacataatatctattgtttactttcagcaaagaaatttattttgagaatatgaatatttcagaggaataattcacagtggagatggggtagatagttttgtagaagactagaaatcagtttctaaatgtttctctttccactaatttcaaagtctatttttcttattactaaaatatttccacttttatatatgtgaagataaaacttttgcttactccttagctaatgaattttataaacaaactcttttatatgtttttataatataatatgtgaaatgagaagactaagggattttacctaccacctacatattaccatattaagatattcctgaataaagtaaaccccaccataaatgtgtgtgtgttggggggtatgatttttctttttggtctatgaaacagattatgctaatttacaccagcacttccaataacaactaactattctgcaccccaaacacacacacacacacatacacacacaacacaccccatctactcttctctctcctgctccagtactctgtagcattagtttagtttctcttattccctcagccccactctttagacaaaaaaatagagagaaagaaagaaagaaagaaagaaagaaagaaagaaagaaagaaagaaagaaagaaagaaagaaagaaagaaaaggaaacctttccttctcatttctagggctctaagggtttgcacgctgccactctaccattcttcacacattccaattagaaacttaagggaggccagcgtagtggcttgtgcctgtgatcccagcactttgggaggctgaggtgggtgaatcgcttcagcccaggagtttgagatcagcctgggcaacatggtgaaaacccgtcttcacaaaaataaaaacaaacaacaacaaaaatagccggcattatagcacacacctgtagtcccagatactagggaagctgaagtgggagggtcgcttgagtccgggaggtgaaggatataggctgcagtgagcctttagtgtgccactgcattccagcctgggcgactgagcgagactctgtcccaaaagagaggagtggaggggaggggaggagaggggcacaaaggtgccatgcatatcagaggatgctttcttgtctgcttatctcaaatctggccatacatttgaatatcaaataaagctgatattctcattttcttcctctctactgaaaaataatctatcccagtaacaacagttagcagtcactgcaggcaagatgataaagaggaaaataaaaaaatcttgaggaaaaaaaaagtcaaggatgattttgaatatttattatattatcttgaaacccatcataatcacttcacaaattcttaatgaaatctgaccaaaatgtgctcccactatttgttgagatctataggaaagtcaaaatgatacaatttctcattttatcattattttttgtgcacttatgcgcacagaagatactgtgtgaattggtttgaagttttccttcttttcactatcttatagcttaattggtaatgagcagcaaattttaaaagattaaaaattacgggggggaagggaagaggaaagttagtgccctagatagagtgaaaaaaattacaaaagaacaaagtaattattcacaagatgggaaaaagatataaatgaattgaattatgagtcagacagaaaagaccacacacatatatacccacatgcatgaacatacacaaacacaaatacacatgcacacacaaaaagacatgcacacacagtctacactacacacatatcatccacccacacaaatgcagagaccacacatttgacacatgctcacaaacacacttatccaaacatggcaaaattatgctcccaatttaattagcaaagaatacattttaccagaagcagggtaaacaccacataggatagtagcatatatcagagtagcttcccttgatccccagagtccttgtgggggctcacagctgcctatgaactggacatataagcaaacctataaacctgaattctttctgcaacaccgaacttttataagccagaggtacaggatgacttcagaaaatcttaaacttacaatttttatgcctctgattaacattaagcatcacatctcttggtttgaaaaaaaaaattaaaaaaaaaaacaactcagtgacatggaggccatatcatcatctggggagagagagcagagtcagtgagcagaagctatgagcaaaatggcattaccttgcagtaaatattgtgaattatacttaatctaatattcaatttacaaatggggataattaataattagtgcctaattagaaataaatgaaataatattggtaacatagctaatacaatgcctggcacatcaaagatgcttaaaaaaacagaaatggggaaaggtgagacagattttcacttccttgttataactgatgattatccagttgcttttggtctagttggttccccttgcataatccattagcttaaactaattgcattttccaacttgatctccatttagtgtcctaacatgtattaatatgggctactgaatctgcattcatatgtctctgagacctgaataaaaccttaaaattttcagggataggttggaaatacacattacatgaatgttactatacattgccttgatgcagtgttactataattgcctccacgcagtgtgctttgggatcatagatcaaaatgatgggaaaaccttcctgccacaacaagccagttggcttgtcccactgtgagattctcccccagcttacaaaatagacatgctttttcaaaagtgtttcttttaatttgttgaaatgtcaagaagagcctaatgttatagattttggtgaaaggtagttttcccttatcaaaatcatatagctcatacctatctatttttttcaaatgtccattgtacaaaaatacagtctttatgggtatttaactcctacagttgactttaagttctgctctctatattgagcagaaaaatagtcatggaactgtggaattggaatttgaaggtatgtatatcaatgccatttaaatattaaaagtagtaggaaactatatctatataaatatagtcattttctagagtcagttagtttcaagaggcttttctttttttaacatttaagatgctttacttggagttccttagagaaaaatttcttcaaatgctaagataatataaaaaccatagctttccaaaaacttttacattaactttgaaacaagtaactaatgcaagtgaggccaagcaattagtttgtaaggagaccttgtaatgcagaggtgtaggggattccaggtaaaacatcaataccaactgtacttttttgctgtgtggtgtagaaaggcagatgagagaagtcgggatatggacacaggtcctggactttaaagattcacttaaatttccccacttctttatcctggcatacatcctcccctaggatcaagctgccatgggctagaaataaagactcagaatatatttgttcaagaccaacagatcaagtagaaattgttgtagaacatatatgtgctgctgcgtttcagggttgaatataatcatttggcaatatcacctctacatttttatttccacgaagacacacccatgagacaagccttaaagaaggtgacagcaatagatattatttccagagctcctaccatgctttggattacaatcttatcaatttgggttgaagttgcaaaaaattcaggccaaaaatgaactttgagtagtttatgaaacccaaacacacttgtcaaacctaaccatgcaaaacagcacaaattaagtcaactttcaatctggttttgtgccaaatggaatgaagcctctggtgggctagacagctctatttcctgctttcaattttggagattccaattagtaaattaaactttaaaaagctgtctaaaataattaattaggtcataattattcagaagcatattttatagtgtactctaatctagtgtctagtctaaatacttgaaaacggtatcaatttcattattaaagaattaattataattgggcctaatcctttgctgatgaacgttgaaaaaatactctggggataaactgttcacatatgcgaagtggataaattctttcagagctcaagaataatagttatgctctggaagtgttttctgcttatattaattcctttgttaaaattcttacagatatcacccaacaaataaaagtttcataggaaaaagagccctctgtttaaatgagtttatcacatatggacaactgattttcctcctactctattccaaacattttccataatcagtacattggtacagaaaagagaaaagaaacagggagaagtaacctgccgggcatggtagctcatgcctgtaatcccagcactttgggaggccgagccaggagaattgtttgaactcaggagttcatgagcagcctggacaacatcatgagatccatgtgggaaaaattttgatatttctttaacttccttctcatttcttcctaatgtccttttatgatctagcaaatcaaatttaaaaactcaacatatcataaataatgataccagagatcagtatagcttacctgtttccatctatgtcagagagaagaaataaatatagaccatttcaatactcttcctgcatatacaggccaaatagaattataaagccaaagctctagagttcaataaaggaaaggcagttaatgattatagttttatgggtaaattgttgtagtgaattaatgtgtttttcagaagagagagaacaggaatggcaggtgttcatctataaatggtgatgaacaatgtgaaaccaagaccacaggtaatatttctggtaaggatttcacaagagtgtaaaccacagcagctaaaaacaaaacttaaatccataagtagacaagttaatcagaaacatattttatgcactgtttcttctataattttaggcttcacaaaatacattacatacataactaaggccataatgctgacttaagctcttatttaaatgtatttgttgaaaatattcacagactttttcagaacatatgttctttttatatttgtctatacatgtttctattttttttcaattgtgtttggatgttgagactctaagtgatttttctattttatttatggatattataatattaattttaatactaattcaaaattttaaaaatataaaaaggaatctaaaaatccctgtaatgtagaaagatggctactaactatgacttacatgtgacttgacattgatagaaaaatactcgtgtgtttacaaatgaacacataataagtatgaaataaggatatagtcagatgttaaaatccctttctggatctcagtcctcttggcaaacataactgttgtgttactctttttattttaatgggagtaaagtgtttgggtgaaagaataatttttacttttatgtttccaaaaatacaaatactgctgttttgagatgcaaaatggaaaaattgaatagaatagaattaagtctcattgtccaacagaatcaataaataataaatgagaaaaataaagagatgctcaaatataaccttgaacataatgctttgcagggttataagagtgttcaaatgcctttcattttcatcctttcaaatttttcaaaagctaattaaggtgtcataggtaaataataatgcttctattataaccaaagcctattctttgaaggcggtttatcaagcatttctgctagtttatataaccgtagtggatctaccaatacacccaatgagtggcatacaaactgatcaagatagacccaggaatctagatacatgtccatcagtgtgagaatagcatttgccaagtcaacatttttgcctccaaaatgctttatagacctcaagaaattctaacaacactcttgagagaacatttgctcttattaacaatttctagtgagaaattaatggctaattaatttgcccaaggacaaagaaagtcagattatggttttcaggctcatttttttttagtctaattgattattagcgttgcattatctctttttttaaccttgaaggtctttttgttttcttaaaaatgcagcattctttgctattgtgaatccatgttgtggctatacttgtatttgaggttacacttctattctaagttcctatttccaacaccaattttttaggcgtttttctcttcttttttttctttttctaaagttttactttattctgcaaagctaaactagaaagatgtactaaagattgtttggcactgggtacacttgaacataaacacgggaacaacagatactggggattactgaagaggaaagacagcgacaggggcaaggctgaacaactacctattgggtactatgcttactacctgagtgacagatcatttattctcgaaacctcaatatcatgcagtatacttttgtaacaaacctgcatgggtgccctctgaatctgaaataaaagttgaaaggaaaaaaaagaaagaaaattgtttggttttgtttcaattagccaaaatttgagataagtaatagctgcaagtagtaaaaaatagtctacgctgtgtgtacataagagtagataactcaaacctcggttcccctctaaacacaaactctaaataaaggaagagggttctgcccttcaaaagtgaagatatatagacaaaagaaacaaatatcttgaaatgctgagcctcatccttttcaaaaaatacttaaataactagaaaaacaaaataaaaatagaattcagggtgtgtgtttgagagcaacagatccttcttcagtatattattggctggaagtgtacagaaatctttgtaaattttatttaaaaataatttattggctaattcaagattttatttactactttctatgccagacactattatgagttctgaagttacaataacaaatgatatggactttgtccttaaaaagctcacagtctaagagagtgggggaacccaaatataataaatctgtgctaaaagagtacaaggaaagaagtaattattaatacttctgtggacaataaacactactatagatcagaaaactgtatcccaaagcctaaatgtggttaaatgcctactatatttgtttgctaccataacaaaccaccaatttgcataacctcaacaaaagaaatttattctctcacagttctgaagactagaaatccaaactcaagatgtcagtcaggcagtgcttcctctgaactcctttagggaaggctccttccttgcttcttccagcttctggtagccccaggcacttcttaactgtggcaacataactctaattgctgcctctgtcttcacatggctgtcttccctcattgtctttgtctcttctgttcatttaagaacaccagttatgttggacttaaggcctaccctactcaagaatgacttcaccttaattacatctgcaaagaccctatttccacataaagtcatattcatagataccggggattaggacttcaacatatctttttaagaggcacaattcaacacaaaacacttactcagctaggtgctcattaaaacactggatttctgccattctgaatttaaaaggtaatgatttaattaaaacatcagagaataaaatgacatattgttttacagtttacagttctatatataggcatatatatacacagctgtcattatttcattgttatctgtagaatttcttattctgtctttaaatataaaaaggattatcttctatgaacaataaaaaagataaactaaatttaattaccaattaaagatggggtaaaaaagagcaacaacactctaaaacagaataatcatggatattgtgtaacctctctctttcgtagtttgttcatactgggagactaatgaaatagaatgataaaatcttgtccagagatgaggaggagtattaaatgacatcctgttcatttaatgtgaatataataaacttcaaagtcaaaaatgtgactataataaagtttgaaatttttgaaaatatgacacataagcataaatacgtacataagattaacacattttatctataagttatttaaatttatatacatatccaacctgaaaattgtttaatatttgagttttttatagtgtctaagaatgcgtaaatggtatgcaaaaatattttcaattttttgcttaccatagttgaatgttacaaacttactgtatccagcaaattccaaactatatgctagaacttgcagagaaaacaaaatgttttccatgacagcaagagactctatttaatcattatattaagagatttaaacaagatgagaattaaggatgggatggatattccagagaaatggaacgattaattcattcaatttatatatgttgagtttctgctctataccaggcaccggtcaaggtattgggaacacagcaatgaacacaatgttccaagtctctgccctcaaataggttaacctcaagtagcttaaattctaggtgaaggagtaaggggaaggaagggaaacgggatgaataatagataaacaacaaataaatttttagtacaagtatgttccatgaaatatttgggacacttaaataattaaacaatgaataagttgtcagaataggtaatgacaaggacaagtaataatatttttcatatgtctgatgcaatagttagaacataattattcttttttttaaaaaaagacaaggtctcactctgttgccatgctggggtgtagtggtgccataatagctcactgcagccttgaactcctagactcaagccatcttcccacctcagcctccctagtagctgggactatgggtgcatgccaccatgcctggataggatataattaactaaaaagttttttgttgcttgtctgaagttcaaatttaactgggtgccctgtattttcatttgctccatcaaaccatcttaacaggaggagatagcaaataaaggcatttttaaaagtagtatgttatatggtgataaatgctttggagaaaataaggcaaggttaggcgaattcggaatgttgtgaggagtggggaatccctactccatacatcagcgggatgacctctccaataatgaagcatttcagcagatacttgaagaaagtgagcatgtggtccaagccaccggagtcttcctggcttggctagaaggacagcaggtgaaaatccctgaggcagaagaatggtaggtctctccagaaacagagagtccagtgaactggagtagagggaggaaggagaaaagcaaatttttgcttacccttgcagtatttgttgttggccagaattacttcttcgacattaatcaaaacatgaccttcagctgtatgtatctgctcacctctgtctacctgactctctttttctgtctctccctttatctctgcctctcagcacaggcacctatctgtcttcatatatagcttacttataaaccaaacacaaagcaatgtctgctgcaagaaaaaataatgagcaacttaattcaggccttatttaccctcacgttgtcaattttgatcatttgcttatttaactaaattgttctgctttcattccagtcattagcttccatatataaaaaataatgtgctcacattccataagtatgttagatattcacacattttgcattttgcaatagagaccaagactctggagtgtttttatttaatgaaacctctaatcagatcctgtggatttactagtaattaatctttaaaataacaccatatacaggactttaataccccaatatgttaatctcatcttttgttttgaaaatcgtcctctatttaacattctatcacactgtatgctgcctcactcctgcagccctcatctccacacagctgtggtctacatggccccaacatgtgtattcagtactgccctgccaattgtaaatgagaggtttaaaaggctccagatccaagtgacacatgcagcatttgtgttgaggttctgcctccatctttgtgcctaaatctctaactgtgtagcttcccacaactagtctctagaagcctggaactccacctttatcctctcattaagtcttttaaaaatctacttgttctctgatttctagcccagttgctgatagaatttcacctgctgataaaattttctgaataaaatgtcagaatatgaatcatccttcattcttgagttttgcttacttatgaactgcgacatcctatgtcagcctctcagactcctattcttgactttcccctcgacctgtaccctgctattatcatgcttcttgacacaggccaaggtttgcctgatagactaaatttctctgagcatcagctgatgctcttgggcttcattcaagcccaattctgaatgtgattccagattttattatccctgtcttccctctttggatttggcagggctgagacacttagggataaggtaagttctgccctcttctcaataatgggattggttggatattgctttttacttcttgttttccatgcagtaggaatataaccaaaaaatactatgtacttcactgtgaagtcctgaaacaaaaatatcatcgtaaataccctggatctcaaggatctctaattagatgtaccatacacatattgtataacacttccagaaccagggattagaagaacaagccctatatttgcagaaatgcgaaccttaactaatatatgtctaatctctttaattttacatactgatgcaaaagagatactaggagttcccccatcagttcgttcaatctcttgcttcttgggcaaaatcttcaaggctcttgaatttcatagtgaatttctctttttggtctgtgggcctactctccatctttgttacttctcttttgaggctttcaccttatactcactacaacttctctctctctctctcttttttgtgctaatccaaatagactttttggccttgccctagcagacatttagattttccttcccagcaagtgtctgtctctaaagcttgatgaatagttgccaaagaacactttcctgatataaggaaatagagccatgtttggttgggctttaagatgaaacacagaatcgtctttttcactgtggtgaagtacatctgatgctttaacatttatattctagatctaacatttagactatcagttgtgtgaccttaatccccaagtcttggtttccttatttgtaaaataagaatatcggctatttgatcttgaaggtcacctacacctctgcagtttgtgatacaactattcatcacatttagcagatgcccttctctttagaaaaatctcaagcctatagaatcggatacaatttaaacgatccccagcataattttgccctctcaggatttctatcttcatagtcatacacagatttttttgaaaaccccaagaaaagaaaaccatgcaaattagaagtgaatatatattagatgattataaatcacaaattatatcaaccttgtagggaagaaaagatttcttttctaacccatagctaggtttgtagctgaggcctttataacaaaagtcattaacaagagaaaagcacacagattttttaataaaaattttatgacatgtcataaaattacattacagaacacaggaaccttcagaagtgaagagcaaaggaacggggaaacctatgacctttttgctaagtttgatgaagaagtggatagttgtggagaagtatgatgtgatctaatggaacaagctgggggaatttaggagggcctatttgttcagattctcctctgtgtccctgttccttcagagataaggatgtttcttttctctgggtatagcgaggcacctctagaatgagggttttatgacctgcttcaggggagaaaaatcaaaggaaggtgaccgtgaccttcttgcttctgttgtttcctcaaatgccaagatacattattttgtggtagcgtgttctgaactccatatttaaaaaatagaatgttaccaaaattttctaaaaagaaataatatactattttatatgttgttactctcatactttctatccattctttactgttttatttgtaggtgaatacataaaaagtttcagaattttctaaattaaccaaatcaggtgaaatgcaattgtgacccctggtcctctgtttttgcttttcatagtagatattataaatataaaacattcagtgcgagcatatttataagaatataaattgttgaggcagggtgcggtggctcacacctgtaattccagcattttgggaggccgaggcaggcagggatcacgaggtttttgggaggattttgggatcacgaggtcaggagatcgaggccatcctggccaacgtggtgaaaccccctgtctactaaaaatacaaaaattggctgggcatggtggcacgcatctatagtcccagctatgcgagaggctgaggcagtgggcttgtcattgcagacttccatgcctagatttcactagtatttacagagatgttttttagcctgtcttccttcctacccctaaccccaactcttctctggattttccacttgctggatctactgtgtcaattactgagccagtcttgacaaagttcaggtgttttagtgcaggctgcatctcagcatgcctttattcccttgtcccagctgttgcattaaccaccatgaattttctactttggtctgctgctgccctgagctctcttggataaagccttattcctgcttggtttctgtcagccccacctctagagaatgagaagctatttattcctacaacattgctatattccttccagaaatgggctactttgcccagatacaaagcactgccatccacctaattctgatattaaacatactgcttattcttccatgatacagtgcattcacactattgtattcaatgctcacagtaaccacacagagatctaccatttgacactggataggaccaagggaaggtacactttctagtttccagtttcttgcccatttcctttccattgtctcttgttgatgaaatggctctctggcccattctgaccgatccaaatagtgagggaaattaggtggttatttgggtaagttatcatgttcttgggcaattaatgggaaaggaattgaggcaaattatgaatattcttcttttaaaataaagtgatattaagcaatgtattgaagggtcaactgtgcagtatttgcaagaaataaatgacaattaattaaagacataaattttgacaagagcattacatactttctgcttttcaatgtgttgttgcttttcctacaaattgttagctgaagggaactatgaaaagctgattaaaaataatgtcacataaaaataagcattgggccattcagtattatcatgtctatcttgctggccctattagaaataccatgccctttttaaaaaattgtatgctttttttttctggtttgataaatttttacatttaaattttaaatcattaaaaagtactactcacatttttttctgatatgttttctgaaatatttttgcattagtttttatgttagtaggtacagaggcaattttgtaaaactacatttaagaatacatttttggtgtttaaaacttgttttttatgaaatggttttttttctctaaaatttcaataagcttcactagaactataaaattaaggttgcctttttccctttactcactggtcattgtccagttgtaatttatcctactgactatcacttgagagccagagcaatgttggggaagaagcaagttgactttagacttagagttgggagctgagcgtgccttctcccctcaccttcactctgttcttggatctcaccctcttcagcccccaaattttctcatctctaaatagttaagaatatcagtgtcttctctagcagaggtcatttttagggcttttataatagccaatatatataaagcacttagtttagtgcctgacatacagtaggagcttaataaaataattacttaataaaacaacataattacctatctctgaaggaattaacctttttatattttccattattttttttctaatactaacaacctccttgtttttttcttcaacttttaaaattctggggttcatgtgcaggatgtacaggtttgttacataggtaaacctgtgtatggtggtttgctgcacagaccaacccatcacctaggtattatgcctggcctccattagctattcttcctgatgctctccctccctcaacctacccacccccaaaaggccccagtgtgtgttgttccctccatgtgtccatatgaaaaaactgccttttaagagaagaatacatcagtttgtgtatacacacacacagaaagaaacgggagcgttatttcctggtttagagtttcaagaaggttttatacatactgtttgcccctggatgcaaatggatacttatgatgtatggtgtgacttcatggagagtccattgtactcaatggtaagtgataaatatattcagctatattaagaggaagaatttaaaaggcacattaatttaaaagaatgcatgagatccacctaaaaattctgttctgacaggggactaatttaggctacaaccctgaatccccagtatgtttagcgcttgtgatgtttggaataccctataactaaagaatgaatagaaaatatttaacttgcaatcatggtaaaatataagtctaataaactattgtcacaagttggcaaaactattgtcacaagttggcaagaacatgagaacgatttcaactgactttcacctctccctacacagagattaatacagtaataattttactttgatgtataatccatattaaaaatacactgagtgatttaaatggttcctatgctatatgaagcattaggtatatcaaaagcccctgaatccaagatgtaaaagccttggaactttataagaagattgacatgtatttgtgagattatttttgtagaatgtaaaataggaaattttatctagctaaatttaaatccccactaatacagattatcatctcatttaaattatgatatatatgttgttatttaaattaattacctagatattttatacatagatatatcaaataaaattaatgtatcaaagtatgatagtagaaatgacattttcagatatttgaattcctttattttttctttcattgtagcaatgttctatatcaaccacagaacctttgaaacatgcacgttatgttatgaacatataaataaataattttattcatttgaaaggccacaataatttcaaagaactatttgcagttgacattgaccaaaataaaatacactgaagtgataaaacagattttagatcttaaagttgtagtggctgttaacattgaatagatccataaacatgaaaaatgggccatctgtcctttgtgctgactcaaggataatactttaaaaataagatcagtacttttacatagctgctgattgttatggataacaatcttaaattcaaatttaagattgaatttaatcttaattcaatcttaattaatttaaggagaatcttaaattcaaagtacaatattttctattattcgccagtgagtcattgttaccaaagtaaaaccttcacttcttcaatagcaaactttctgctctttcaatgagattaagcatttgactaatcctcattttatgtttaatattaacttattggtcctataggaaaacagcctgaggatttagtatatagacatttatccaatgatataaaatctgtgtatttggacaagaaagaaagaattatgcaaattacttatttctttttatattatatcagacatctgcatatttgggacatctggatatttgacaaccacgaacctcaatatgattaactgagcatttcattttttatctaaatgatttggcaccaggcaaaacagatttaatgattattaattaaccttcaggtccaaggagagttagagaaagttctgctataaaatataagaaaagccattcactacactaaaattattgtccctaaatctgaatctgaaaggaatcacaatggattttggtggatatacatataaatacattttcttcaatctttaagacaaaaaaaaatcacaaaaagatggtggggttgaatatataggttttataggctaaatatcacaagcaaaaattgatgagaatgtactggctccaatataaattagcagcaattacaccagacaatttttagactctattatcttaaaggcattcagatcttaccaagtccacaagccatctacttggatataacagctcccgagaggctgcctagcagccacaaggatgctgtagactaactaggttagtaccttccactttcaatacttcgtcaaaacagtttaagatgacagatgggacaaggaatttaggaatcctgtaatggatgtgagattggagagtgtctacagccaagacatgggtttatgataaaagcagattaaagaggatactattgtgactagatgggggatttaggtcatgctgtaaaactcttcagatggtatagagctatatgttaggtcagtgcagaggctgagggtggtgggaatgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatctataaagaaaagaaaaaagcaaattactacatttttacctccacagtggaatctgagacactgttatgtcacacaaattcacttttttttttttttttgacagaatctcactctatcacccaggctggagtgcagtggcatgatcttggctcactacaacctctgtctcctggttaatctgattctcctgcctcagcctcccaagtagctggggttatatgcacctgccaccatacccagctaatttttttattttttagtggagacgggtttcatcatgttggccagtctagtctcaaactcctgctctcaggcaatcagcccaccttggcctcccaaagtgctgggcttacgggtgtgagccacggtgcccagcccaagttcactttttctacaagtgacatgtgaggcctattctgtatctagtcattcgtcctcatttctctctgtattccacagtttcttcttcctatcaaatttaaaattaacaatttgtttctctgatggagcatattctctgtcaattcaagtacttctgctctgctttccccaggagcttctaagagcacaagtgactgctttaccattgaattcatctcactgtaaaggagtatttgtcacaataagcctcttattttcaaacctgaaataaatacaaaaatatatagaaaaaatagaaaattatttttctacaaaatagaagtagtacatacattgacattaaaactttttcctactgaaactattgtggccaagatgaataatgtagtaagctggacctcaaatgcccatctattgaaaggcttgtgtgaattcaacacagattttggaaggaattttgaccttttatagatgctttcttagagaggaagttatatagccttttttcagagttttgtcattttttaatcttttattatttttaaaaatgtttgtgggttggtgtcctttgtcttcttttctgtatgtttccacaaaggcttagagacccatctcccactcaacagtctgcaagaagtagcttcaataaacatcacaggatagcaactttccagggagaataagaaaatctaatcattcatttattagttcatttaccataaatttttgtgcacctactatatcccaggaagtaccctaagcacaagtatgttagctctgaacagacatgatccctatcctcaggaaactggtacaacagagcagaagtcagacaataaatgaataagaaaataatatatacataaacatataccttataatatgtgttacgaagaaaataagttgagcagtgatggaaaatagctatcagagaattatgggaagaggatggcttgaatatatccctgaacccttgctgcttgctgtatctgagccaatcagctgctaaggcctcctgccctgctgaactattgaaagaaagagctaaggcaagaatttttacttcatgagccaaggaagaggcagggaccagttaggggaggtccaaggtgaggccccagtgcatgtgttagattctgagaaaagcctggcctgaggggtatatgagctaaacctgcctgtgagaatggtccttgccaggtgaacacgtcttctcaggctttgagtagcttccaggtaaaggaaaaattttttaatgaaaaaacaaaaataaaataagcaataaaagaaatgattgtcaaagataactccaagaggattaaaagaaacaaacagacacaaatgaaaaaaaaggtaaaaaacatgaaagaacaagtcaagactaagaaaatatatttaaaaaacaaataaataatccagaagaaaaataggtaaaagataacatcagatatttcattgaggaaaaaattataatgtcaataaatatatcaaacgttaaagctcactagcaacttctgaaatattaataaaggaggttgattgaaattaattaatttttaaaaaccaaggtactagtgaagatgtgaaaagataagacttatatacattactgactgaagtataaattagtaccactgcaaaggagagtatcttcaaaacacctggtgaatttgaacaggcttatgagctatgactcagcagttttagtagatgaatcccctagagtagctcccacacatttccataaggagttatgggccaggatgctcaggtcagctccctttgtaaaggtgaaacatagcaacaacataattatttttagtaagaaaacagataaatagtattggctgaaaaatactatactagccatatgatttttaaaaagcaaattgctaaaaataagagtattaaagtatttaaagttgtaaaacgtatattaatgtaaaaaatgcatttatatacaatctttaagtctagaaaatagcattacatatattgtttatatagatatccatattttatgaaatataaaattatgtggagatgtaatatacaccaacttcagcaaaatgattgcatttgagaaggaagggagggcaaaataatagaagaagctttagctgatatctaatatttgattcttggagagagagaacactgatgcaaagatgtcaacacgaacatctttgtgttcatggaagtggacatcctttgtaatattatttttgtatttcataaaatcaaaatcacaatggaagattcacaaatgagcatatctcctaacaagaactaaaacagcagtttgtcaaggagagaggcaggttgagggtgtcctatgtcacagaagtgcatatgtatagagtagctgttggtgtgctttgagatcaggtgtggagcagttcagatgtaactatttaccagatgtgaattttttaaaagagttatttctccttttaaagattcattattttcattaataaagtggaatctacttcacagtactgtgatgcaatgtactaatattgcctatataaaacaattgtcactatgcctagaataaatattccataaatgttgatggacacatagtttattcattcatctagatattattaaaatttcaggaataaaaacataattagcataaagatattatgagggtaaatggtactttaatagtgagaattagttgaacatacactagtctccaactaccttacataattaacctgataccctccaaataaccatgcagtggtgactccatcattctatgtaaggagaccgagactccaagaggctcagtgctttgcctaaatctgaggtccagattaaagtccatatctgactgctgcactctttcacttttagtgatattcacactggacttgcagaggatatgacagcttaaaaacatttgagaaccataattctacactacatgctctttatgaatactagtagatgttttctaaggttcagaggaaggcctgtacaattggccaatctataactttgataccagtgtaatatatcaattatatactacaagtaaaattttaaaaagaacaaaattgtttaaccttaagcttatgatttaatttttttgatgtgtattatagaatttgatatagataaagtagttaatcagatgtataaagaaaataatacaggttgagtatcctgtagccaaaatgcttgggaccagaagtgttttgaattttttgatttttttcaaactttggaatatttgatatacataaagggatatcttgggtttgggacccaaatctaaacacaagattcatttatatttcatagagtacttatacacatgacctgaagataattttatacaatattttttaaaatttttgtatgaagcaaagtttgtgtatgttgaactatcagaaagcagaggtgtcactgtctcagccacctatgtggacaacctgtagttgtttggcatcaccatcattcctgactctgaatttatatgctaatgataagcaatcattttcttgcagttactcacacataagtattagcagtaagaaatatgacataccattactacagtgaaaaattaatgtggcagaggtggaattttccacttgtggcgtcatgtctgtgctcaaacagtttcaagttttgaagcatttcagattttggatttttgtgttagtgatgctcagcctatacaaaaatgactcttatgcttgaaaatcttagtccgtctcttctggtttttaagtcatccaggaagtttatatgtggtggaaaatgcaactggccatgtcccagggcagacacctcctccagtgctcacagtggaggccactgaagtgttatgaccatgttctgtcagtgatgtgtacctttctttgggctcacaatggcatagaaagatgtaaccaaagtctagggaattgggtcctaattagagaactgccagtaaccaggagtaggaccataacacctgggactctgagcttcacctctccaggctccagtttcctcatctatgtaaatgaaaacattgaacaagaacaatacagcagttatcaggtctgttttgactcctacagtcctttattcacttgaaattttaagcaaatgttaaatatgtaaacctgagcctgagatgggactttgagtactctccccaaatcctcagagacatttcaagaagcactttggaacaactcagagaaatctttgtaaaaattagtggacaagatgaactctaagattaaattaattaaggagaaaattgagggtcccataatatgatcaccaggtttgaatcccagatcttccagttactagtcagtctgaatattgactaaattacttaactactctacaagcagtttactaaccttacaggattattgtgaatattaattaagataattcatgtgaagcacttagaaaagaatctagaacataaagaagaaatcaataaagtgatctgtgatcaatttaccatcaccatcatcatcatcatcattgttatataaatgtgatcaaatacatgagaaaaacctaacacttgtctggcacaagggagctgtgtataggtatatgtgtgtgtgtgagcctgtgactaattttttagcctccgtcatttttcctactttcctgtcaagatatctactctctatcaggcactagaaatataaaatgtgattagtttagattaaaagatactgaggaatgaagtaccaatctcagaacacggtgacgaaaaatattttctgcagattaaaatgaatattgaactaatagcatttttgttagaaactttctttcatccccagaagtttagtattcccttttctggacattttagtggttgaatcattcctggcttcgcaggatgtgaaatgttcattaaaagaagcatcatggttactgccttgtaaagatgatcctaacagcttagttctttgtgaactatttgtgtgttggcttgccgtgactttgcacaagttagccactgaagcagaaaaatcactgccggggttgtcaaatatcattggtgcaaggtgcctttctgtgtgcctggctgagcagcttccaatgacatgtgatgtggggttttctcccaaggctgttgcgtgctgtgtgcagcatatctaagctgaaaaactaatgcatggccgggtattcttggtaggcctccaggcatttcacattcatttataaaatgccttttttctacttcaaattaatcttatgttctttccaatcaccattgtaatactcttttgactttatattctgacaagcttgaaatagcctgataggattgaactaaagtataaaaaaccagagttacaacagtcagaaacaaatgaaaaactgaaaccgagtctgcagcgttaccttcacagctgtgttagtacacaattcgggccttttctagctttatgattctaaaatatgtctttgttttgaattaagttgctggcattatgtttgcagagcagttaatccatctccaaaatttgtaatagtcatggttattctgtgactttcattgcaaatggaacttcagtgtcaggtttatgggacagctattaaaaaagcagaaggagagttatcacaagtctcttatggaactcgttaacttatggtaattaatctaaataggacatttatttgaattctatctcaggaaaccaaatgaactttctcttcttgaatgtgcagtttaatgctcatttatgttaatattatatttctttaagttgttagtcacaatttgtgttgctgtctcatctattcatctaacaagcatgtatttggcacctcctgtatgtctgacttgtaattgagtgatgaataggactagttcctgtcctcagagagttcctagtctggtggaggggaagctttgcaggcaaagaatgagtaaggtgcatcaagcccagtggtgagtaacatacaccaggcagagggataacagaagagaatggcattaactcattctgggagttgaaggaacactttctgaagaaagtgatgtctcagctggatgaaaaggagtaaaatagtgacaatccatgatagaagctcaggtatagtaatttgttaaccaaaatattccaagtgaaagtaattgaaatagggcatctgaacaatttgcatggggctttatatttaacactttcctgctttcaactgttcattttttcctccctcttacagaaactccctgagatacacaaactgatattcctctgagttttcaagttggagaactggcccttagggtacactcagtgactattagttgaatgggataacacaaccaatatttattgagtgcctactgcctctctgtgccttaattctttatttgtaaaattagcataataaccaggcctctctcctatgattatggtaaggaaaaaatgagattaatatgttattaacatagactagcattggtctcaaaatcagggttatataagccagttattattactagtaactgctactggttattaattagttattattagtaactggctagttactagccagttattattactagtaattttctagataacaagaagttggtttaggggtgaagggaatcttccttacccccttcggaaggttcaataatttgagtctgtaaaacaaactgacaatagacaggttaacaggaaacaggcatacaaaacgatactagtaataataattagtagagacatgccacgcactgttttaggcactgaacgtcagcagagcaaaggctggctttcatgcagtttaaaccgtgtggccagagcggagtggctgaggaagggagtaaataaaaagaaacgaagttgaaagacttgctggaggagggaaaggcacagattacagagggatttataagccatggtgagacttcaaaattttaagccaagaaggaacctgatctaacttaggttttaaaagaattacttatgcactctgaatagattggaggagcgcaaacatggagagaacagaagaatcagaaggttattcagatcacagtggctttgggcctgtgtgtgtgtgtgtgtgtgtgtgtgtgtgtgtgtgtgtgtatgtgtgtgtgtgtgagggggcagagagaagtggtcaaaatctggatatattttggaggtttactaggcagaattcactaatggagtagatatgtggcattcaacaaagagaggttccagaattttggcctaagcagaaaaatagaagcttccatttcttgagatgggagaagatttatgaggaagaaaactggcttcaagaatgaaaatttccattttagacatgttaataataaatcagtgaatataatatggtattgcaaaagaccaaggaattaacctgggttaggaaagatggatagagataaaagagaaaagaatgtgagaaagatgttactatggcttcaagatccaaggtgagaaatgggagacaataaggctcataaaagagaaatctgtttggatctgaatcagaaagatcacacagtatagtaatgagaattaaaactgcacagaaacaatcagggtttagaaggctaaagtggacaatttgaactcatttactagtagcttggcaacagttaaaattttcaaaacaagctgatttgagctaagtctcttagcattcaccacattatactgagttatctatttctgtgttttgctatcccaccaaactgtaaattctgctgtgttttattcatcattttactgcctctgcctagcatggtacctggtacatgcttgccactcagtaatcacttgtggaagtcaactgaaaaaaaaaaaaagaaaagaaaaaaaaaaaggcttgtgcccaaacaaggacacaaattgaaataacaggctccattggttcaaattcaaactattcccttatgcaaaggattcaagtttgctgagaccccagatccaaggccctatatctgtcttaatatgataacaaggggtaacactcacctcacatatcccaaaaataattttcagtatcctgctactacctcattttgtctcataccagaattgagagcaaacactcaatgtttctttatctcttgcgtttaatttgctaaactccaaatcaaattgaaccctggtctatttgaagaaaatacactgtagtagtttctcctcccctgtgcaggttcatttatctgtaccctaattcactcaaaactcagaggaaaaacacatctgtattgaaacatttttgtggcattgattgctccccatgtgattattccaacaacaactatgtaacaacgtgagggtgaaaataatctctgtagcttgttttgtgtgggctaacaccctagtgagatggaaaaatagcctaaaactatgtctactttttcctgagacttgtcttttcaataagagcttatttactatacctcctgcttgcttttagtcagtaatatgttttgaagatagaacaaatgatcttttctacttgaaaacacaatttatttttattgtagtaaaactatcccattaaaaagtttttaagatgtggagaatagatctcattgtaagttggtacagcctgttcaaattttgatacaataaatcaaactgaaggtgttgaaggtgtaggatagcaaacttttttctccagtcccacttaacagccaaaactacatcactccaatatatctgcctccatttggtttcttgctctttcgtatcttccctcaattattatggtatctcaaaacacctctcacactttcctgttttgcccatccagccaatactccctcattcctgaagaattcgccccatcagagacccataagcagtgctggggttcatgtacatcataattttctagataataagttggtttaggagtgaagggaatttttcttaccccttctgaaggttagataatttgagcctataaaccaaacagacagattcacaggaaaaagcatacaaatttattacatgcacgtgcacagggagctacacaaaatacaggactcaaagaagggcctaaggtttttatatgatacagaaagaaaaagaggcctgaagctcctggaggctgtggtgacaggttatggaagggtaaggggaagaatgcactgtgaacaaaggctgttgtttcattgtgcagagaaggtctatcaggtaatagccctcaaaaagagtagatggtaacctgtggtaatagtttctctgtcagacctttaaaagtgtcaaacctgtctttagtcttcttttcctgtgagttaatctttcctagattcaaataaaaggacctcagagaaaccgtctgcctgcatcccttgtttgctttattaatatatacatgtaaatttattttacaaaaggataaattttcagagccatgctttgtgtctgcagaccctctgaatagccatctcaaaatatgccaaagaggcacgctttggatggcatattttggtttcccacagtcccctctttgaaatttattttcagaaagttttacatattaaaataggattgataactgtggaaaatttgctttagacattttgagataagacattagcaaagggaagaaaaacatatattggaataagtagaaaaatgtctcattttaggaagtggtgttgcagggttcccacagttaagtctctacatggtgtaagcaaacaagtttttaatatgaggcttctctaaagaaacaaaagaaagacaaaagttaataattgaagcagcatataaactagttctgagtctagcagttgaaaagatttctagatttggcctcaaaacatcttcagttgaagtgtggatagacagtgacaatctgacagattttaagttgttattgtgatttatctggagtcaaccagcttcagctttcagggcttcaagaaaaaggcacatttaatttcagtgattccaagtcagaaaaaaattggagaaaaaagtgaaaatgttattttggagagttgcagtcagacattagaggaaactaacaatttcagaatccagtctaaattgtaggtaaataataaaatctcaaaaaaatgaacagagctagaatctaataacagatacactgtagttttcttttaagtcataatttttctctctcgagttcccccctttttaccaaagttaatcacaataaaactaatttgtttgcaaaataagttttaggcttgttatactttgcctaataatttacagaagtacagcaaaatgatgattaatcatataagctcattttcaattttgctttgctggaacttttcacaaggaatctcagattaaacttttgaaagcctcttgaggctgggaagccaatccaaggaggagtcaccctcaaattgtgcctgtaatacctttaaacttgagtgaatacttctcttctcaaggttcccaaaaatatattcaggttccagggcctctcaggaagtgacattttttctcacctgtaaatcaaccatgttaattatttatccaagatatcaagatagattttccaaggggttttaattggctttataaagtcaactttaattccttagagcaatctggtcatatctcagaataggacatgtcaggcaaagccttggtaatatggccaatgtttccaattgtgtcctattagaaagagaatagattcttcttaaatgtaagcaaataactatattgttattgaaataagaatactcacaaatagtctccaaactctggagggatcaggtagggagaaaaaaaaatttcaattctgcacacaaaagtacaccttcccatattcccgtaaactgtagatagctgaaagaaaaaaaaaattaatgtggaaaatgaaacatgaaagaataagccatgtgccaaacaaaaaagtcataaaatcataatctttcattgctttagtcccatgtaataattcttattctgcttgatgttgggttagtagttttttgagttcagttttttcactgaagttcggaattcttacccagtcaaatactacgatctcaaaatcatcagaaaactatattcaatggtacttgtgagagtcttttctataaatttcattgaagaaaagcaatttggggctataactgactgcaagatgcttttagagaagaagcaaaaccactgtctgtcaatgacaaaaacttacaatagccatggttaaaaacctaatgagaattcataacaagtcattgacaaggaaatgtgttgtggcacacaacgctttaacataataaccataattattactgataatgtacactaggatataaatttctagaaatttcatacaattttggaatacatgtgaataacatatctataaaattataactcaaagaaggttaaacatacatgtgaataacacatgtataaaattgtaactcaaagaaggttaaacatcacttgctatttggagtgcttcccatataacttagcgtattaaataggcctaacttgtttaatatctctcttttgtactgctaggggtccttctggaatgcccaaaagttagtctgaggtcaaaaagacttaattttgatttggagaaggttgttaaaaaataaaggttcgaagcattcgatcaaaaataagatcacaggttactgttaaattcatttaaccagaatggcaatttaaagacttcaaaataaaatgcaggaagttacataattatagaaacagtttaattctttaacccagtttttctaagtaatcaaagacctaataaagacagtataaagcataggaaattattttgataaaatgcaaaatctatcaatactcttgtttttaaaagagaagaccaaagtttagttttttaccagtgcactttttctattaaagctcatttctgaaacctttataataattttattcaactttagtcagtttaaccttacaatattttctctcactctctttacccaactctcttgaactgtcattcagctttttatgtatcatttcttcattctgaaacaacctttaaactagaataattatttttcttcaacaacaaaaaatccttatgccttccttataactttcctcaccaaaaacacatcctagtttccttctacacttacatacagaattttttatcttatttctagtagttttaattacatatattaattagaatttcaattcttagtaatcttattttccagtgaaaatctaggaagtaaacaatcttgaactggcattgtaccaacatgttatcaatagatttcataatttctagaaacaaaagctttctcataaagtaattttacaatgtggatcaggacatatttaccagccaaaccaaatatatttagttctcttgtaacaagaagttaaaagtaaataagctaaaatgtatgattaacaattaatgttccagtattatatcttatttggaaatgatctaattatttaaagaatattcattatctaatttagtttagcaatactttaagggtgtagttacctgaaagatttgagaaacctttgaaagtatatattataaatcataattattgttaaaaattaaatttataaagttttatctcacttacatctatttaattactttaaaaccaacagcattaagctagtcctatttgtgaaagatttacccaagtcacatgaacttgaaaagcctttgagtttgttaccatatttctagcagttttaaaagtatttaattcataagaacaaatttttctttaagccaatttgaaattcttccaagaaattttatcccatgtagatacaacttgcaccatacatgcacacatgtataaacatatacaaacatacagataggacacaaacaaaaatattatagtttttattgtaaaactttagacagatacaataatataaaactcaccaatttatgaagtattaaccaagttaacactacctgtttacaatggtcaaaaccctttatcaatattaatagaaaagacctttaagatttttcatttgttttaaatttttaaatagctttttttccctgagtatatagttccattttagcttaggagagaaggcaaagaaattcttattatgctctgagtatgaaccacagccctaaaacaaaggtatatctacaagaaactcaacagcaaaaataattctcatgacctaaattaataagccttttaatggctttaaccaagtgtctaaagttagagcaaaaagatacaggctgctgaaaatccaaagccactcccaaaagaaaggcagtcaaaaagaaagaaaagctttgcttgccaaaaatggggtacaacccatatttctgtccagccatatttgtgggtctctcaaccttttggtaggccacccatacatgagggcctaataacctgtgtgccctcagtagacaaaatgtttaaaaaagacaacagttggtaagacaaacaggaaaacaaaagccattcatgagagggaagaggatcattatcaaacgagtaccccaaaagtcaagagttatacaaattcaaaacaaataattcaaataaattcttataaactaattcttacaagtatttatctcctgagctaaagaaatgtactgaaaaaaatggaggtggattcagagaagggaagttttaaactttggagcccagagatccaaaaacttttctcatttaaaaggattttaactttgttctaaaactgatttttattattttaatattgccaaaggagtctttaagggtaacagttatatttacgtgtgtctcttcttttttttaatttgatcttttcatagatagcaatagttaagatgagagtttttctacatataaccaatttatttattacaaaagtgattcaaatcaataaaagacttcatttatagacctgttttcaccagcaactccaaatttgaaggaaaaagagacaaggagtgactcttgccactcttactcaactgggctctaaaggcagagatctgggaatactgaccttggtaaaaattcttacctttcttggctggcttttttgttagttgtcccagggtcccatttacagcctctaaactgagcagagtgacttgttctcctgcctgggctcaccaaaactgttagggacaaaggcaactttcctccctcttccttctgaagattcaataatttgtgtctataaaaccaactgacaagagacagattaacagggtaaaaacacatacaaatttattatatgcacatgagcatgagagtcacacaaaatatgagactcaaaaaagagcctgatggctgacgttttcatattgtacaggaaggatagagtcttggcggtcctgagggctgtggtggcaggttatgggaggatgaggggaagaaatgcactgtgaacaaaggctgttgtttcattgtacagataaagtctctcaggcaatagcccacagaaagaatagatcataacctgtagtgataatttctctgtcagacctttaaaagtgtcagacctttctttaattcccttttcctgtgatttaatctttcctaggtttagaaaaaagggacctcagaaaaagcctctccctgcaacttttgtttgctttattaatatagatagatgtaaatttcttttacaaaaggatagatttttcagagctatgcttgtgtctgcagcccctctgaatagccgtctcaaaatatgccaaagaggtacactctgaggtgatgtattttggtttcctgcattggtcaggtggaacaatataccagctagcagggatcttttgatctcctgagagacactttgctaagtgtgattaatgctttaacagatgtagtccagaagatacgtttcttaacacttcctggggcagctgaggaatattacactgcagagatgttgtttagttgaaccttgaaggatgagacagagtttccccttgaaaggaggcattttaggtgaaataagcagtatgttaaaaggaacagaggaatgcaacaatatgacccatttggaggaaagaaactaggtgtgattggaaggaagaatcatgaaagatcagggtagatactggtggggcagctattaaaggagtttgagcaggggcatgacatcttcacattgaaagcaatatgggagtcgaattaaatttagtacccagttgagataaaagtccattgccatattcacagtgaggtgggacaaaagcagagtcagagagattaagaggctgggaaagattgaagtgatttttaggaatcagaatccacatcagttgatgacaagtacagaagggcacaatagcaagaagaagaagtaaatgataattcctagatgccattagtcacaatcaagtacggaagagacattattgactgaggttgaatcagggcagagaagataatatacctgattttggaagtgttgcatgtaagggggcttcgatttcagctacttacatacttgggaatctttacaaaagcaggaaggctgaagccacagatgtggatgtaattactaaaagtagaagaggtagagtgaaaagggacatgggatgaagcaaaagcaacatttgagactgtccaaagaatacaggtatattcccttactgcagtagtcaaagtccacaagaccctgaataggcctagtccgtcttaactagtctgagggctatcagccatacatccggtacataagcatatattccttggtttaaataattaaaataatatattgtcatcctctaagatgcatgagactgccagaatgacctgttagccagaggtcattgatatcatctatccacaagagattaaacctctgaggtattagaaagcagtttttggagggcctatagaaacacatgtttcccttttcttatgactccctatagcagctggtatcactataaaatactgtgtaatctttgaaagtccctctagaaaaaccaacacgctcacaaactaaagctaagattttgtcaaatgaggccttacccagctttattcaagaaataagcagtcctattgacctctggaaaatgacctatttgtcttctcctccaaggaatagtagtaaaactataacaactgtacatttatatttaataatgatagaaaatttaaactttcaagtatcctgcttagagatggaaagccaggactcccaaagcaacactgcttgttcctaactagggaaaagcttagtttcttcgccttctttagtgtgaaacaagagcccatttcgggtgtgtgcatgtgagcatgcatattactcacacatacacatttacctgaaatctaccagacattgcatggtcttttaaaaacttgttttgttctcctgaaatgttttctattttgttttctcctagtctctctgggcttatgttttatctcagccaccatttaatgagtttctatgctgttcaaaaccatagaagtttcacattcttcatttcattttatttttcaatatttatatgaatgagatgttaacatccacttttatacacgaatctccctctgcaaaaggctcaacaacttgcccaaagtaagtctttctgacactaaagccatcacttcttccacgacactgtcatctccaaatgagctggggagaaagtggcccctaataattctaagttaccttgaacctctttattccagaattcatcatctactaacaaaattttttgtatgtaaataataaaactagaaatgaaaaatctcaaagtattagcaacaagagcccaataagtatgaaacacccagcaacagaaactatttatattggctagatctaaatttgtctatgtcagttaatattatttatgttacctcatctcaaagggtatactagaatttcaagttataaagatgtggtttcaattaaatatattaaagtagttctcaaaacagttattttacagtgtccagttattcactaagaaaaaaacatttaatgttctggttagtggtgacttagtacgatgtttccatccttgggctcttggccccagtccaatcataaacatgttgtaccctgctgtggtacaacaggagaaaaccacgtgttagcagaggctcctatcaggacctttgaggaactgaatctctttgtgaataagcagctcctaagaaagatctgatctaagcataacatgatctgaaaatttttgcctctccacgtgccattttagaacctgtgaacagcacactacacagattggtagcagagcaacttcaactggtccaatgtatgagtatcgactttttatcctttagagctttactgctgccactcaagggcaaattgggaaataattccaaaaaatgcagccaatggtaattttctacattgtaagcacaggaaaggaggaaataaaagaaaagataaataggttaccttagtgctatccttagtaactctgttcaatcttggcaatgacaaacctatataaactttaactaaataaaggcaatgcagccagaaggtgaattttgctacttggcttacagtcctgatcctgagaaaactgttaattcccctgatgtcactaaatactccctacaattaattactccctcaactaatacattgagaaatgtattaattcaaaaaatccattttccacataaaagagaagctttagcacaataacgttttgtctaaacattatttattcattgccactgagagttttaaaacaatgcaatttggaataaacatatgcctggttaatgttatcctttagagagaaataaaaattaataatttaaaaccacatagttgtaaggcatctggtttgatagaaatgtactcttgaggtagaacagtgaacaattactcaaaaatcagaaatattggaggaatcacaacttctcagatggttaaagtagtctatctgtaaatacaaagtagggtttttaatccttaaatagcttgtcatttctaacaatgtgaagaatatattgataaatatctttaaaagaatgagttttttttttaacttctgtgtctgtgttaaaaacaaacactggtatactttgaaataaattgtcagtaatgtactgtgtgattttataaaaatagcatagacactaattcctaattatgacagtgactggcttactggattcaattggagattaatctagttcacatttttcaaagcacagcactaatactctgtactcctaatccggatcctctaaattagaatcccaggggaagcatttccattcaacattccaggtaatcgtaggcatgctaaagctttagaatcacagtaaacatattttgccatagaaatttctgaagatttgtcaaattatttaacacttgattaaataattgtacatgttctttgaactttaaagtaatagagtaatatattattcatacgttatatataagcatattcaaaaatagatgtatgttaaataataataacgaacatttggagtgcttctttggaggtattgttttaaggaggagttcgttaatattattttgttgagtactcacagcaactgtacgaagtattatgtttatcgcccattttatgatgaggaaaagaggtaactaatttgaataaattgcctgaggtcacacacctagcaagtggcagagccaactttggactcatgcaatctagctcccaaacctcgtcttaaccaccaggtcatactatatcttaaaggtttttcagtgaaaactggtctgctaagaagtcataataataggaaatgcttttaacacattattagttgaacaagaggaaccaaggtaaggaggagagaggagaggaaggaaaagaaggaaaggaggaggaggagagaaaggatcttacaaaacaatatagacacaactgttttgcagtgaaaatatacatagaaaaaaaagactaaaaaggtataaaccaaaatacttattatcagatgatggggtggcagtaatttactgtgttttctctattttccaaattccctataataagagaatgaatgatcatgtattgctcttatagtcagaaaacaataaatgagtcattttacaggctgattacatatgtcttagttgacctgtttcgtaaatataggaattgatttagatttttaattatacttattacttagctacctttagaacacataaatgtataataactgttttttaaaaactttgaagaatggtttaatccttatatgtaaattctatatttttatattatgtttaggtgctctgtgaagaaaaaaatgcaaaccacattgtggctttaaaataagtatgttatttctacctcactgcaatggaaaacattccaatcttattttgttctccaatattatatacataatgaaataaataagattatttatcaatacattttattttacatttgttttattattctgatcagaatttattttgttagaattcagaaaaactgtaccttaaaatgtaaggtaagaacagatatttgcacactggcgttcatagtaccactattcacaagcatcattcacaagccaaataattcatagcactattcacaagtaccacttatcagtggataagtgaataaacaaaatgtggtataaccgtacaatggaatatttttcagacttaaaaaggaacaaatttctgacacatgttacaaaatggatgaaccttggagacattatgctaagtgaaataatccagtcacaaaagaacaaatattgtatgatttcacttatatgaagtgactagagttgtcaaattcatagagacagaaagtagagtgctgaaggaagggaagaatggagagtcagagtatacaaggtacaaagttttagagaaggtgaaaagttctgaagatggagagtggtgttggttgtacaatgtgaatgtagttaatggcaaagaactgtccacttaaaatggttaaaatagtcaagtttgtgttatatataaatttcctcaataaataagcttggtgtggtggcttatacatgtaatcttagcactttgcaaagttgaggtgtagaaaccacttgagaagagcctgggcaacatggcaaaaccccatctctacaaaaagtaaaaaaattagccaggcatggtgatgcatgcctgtagtcccagctactcgagggctgaggccagaggatcacttgagcctgacaggtcgaggctgcaatgagctatgatcatgccactgcattccagcctaggtgacagagtgaaacacttcctcaaataataagtaaaattgaaataaattaattaataaaataaaagatattaaatagtatttttcatttgttattgcgttcaagacagatcacattctcaaaatcttaaaattacctattcataagggttgtactcctaaagatgctttaatagacatcttttttagaaaccttgcatttatcgcctcctaattggtctttgatcataatatatccctgcttattgaactcctcctgtgggtatcattcacattataaataaaatccaaattctgcaaaaaatgctttataatattgatttctgtgcatagaaatatacctacacatatgtcccctctccctctctttccttctctctctctctctttctctctctctctctctctgtccttcctacagctgcacaggcttcttgctgttcctggtacataccaactttttaactttgacaaagacatgacactcaatacttccacccctggaaagcttcccctagacttctgttgttccttttcagcaaggtcattcctaagggccccatccaaaacagtgctgcttctaagatgcagccactctacgctttagccttctctctgtgtttcctccttagcacttcaataactaaaatgctgtatggttcacttgtgtgttttctttctttctgtagtggaatgtgagcaccaggacagcacacatctcaactgtcttgttaccactgtatctccagtgtcacagcacttagcacagtgcctggtacaaagtaaatactcagcaaatactgcgtgtgcaactgtttgtataaacatattcgaaatacctcattggctgtcattgatatttgtggtatagataaaatgagattgaggtttgcagtagtaaggatgagccatttctgaatcaacaaattttaagtaggtggtcatttgttctctgagataatatcctgattttaggtaatagaatttcataaaatggacccaacttttttctccactgagaaataatttgaatatgagcatttgtcatgtattttcttaaatgctttacattcattgtagcatttcatcctcacaacactataaggtaaatattattattgccattttacagatacagaaactgaggtacacagagccatttaccccaggtcaagtaagtattcaaattggatttcattattagcaatgattcccaagctaatgcctttaagcagtattgactgtggctttccctaaacacagataagttttacttatcgtggcaattttttattacctattacatttaaaatgtgtgctcattcaaaaaagtgaagacatgaatattcaaataagaaaataatataaaaatcatccctaatcctttaattagacattaccacttttaaaataaattttccttatctttgggctttgcatagacaacttaaaataaataaaagtgaaagaggaatgaaaatagtgaaccagtaaaattccagaataagcaaagtcctaaaagatatttttttcatttaacatgttaaatgtttttttcaattgtatccattcatcttttactttatgatatggaatgaggagtgaaagtttccttactaaaaattttttttaaaaaactgacctggcagatagtaggtatattcttttatgtaagtaaatatgaaattatttaaagggtattcaaaaagttttaattgaataatatagcataatatttattccataaaataaaaatattttaagtagttataatattagattcatagtggcttctaatatttttagggaaataagaatgatgtgacctcttagtgtccaactcaacttccctggttaaactgtatctgtgataattaaccatattttgaacagatttactctgagcaggcatttttcatatgtgtgaaaatgagccataagagcttcaacagataatgccagaggatggggctctcttaagaatatgtacttacccacaccagcagtgcaaccttacccttgggtctgtaaatttcacttgatagatattccacatgcatactgtaagaacataaggcaggaaatatagaaaaattgaatgctcccacagtgacaaatagtaaaattatactaaaaatagctgcacagggattgttttacagtattattatatgctgttgtcactggaaaatagtgtttttcttgcaatacattgcaatgttatatgatatgttattataaaaaaattatgttgacatcattcaatggagtcaatttttttttttttgtaatttggtctactctatcagacaacactcatctcaatgtgtccttcaaaatacagagttcttttttcaaatttaatagagatttagtgaaaactgtagaaagtatataaataaggatttctgttgcttacaaaactgaataaaagatcatacctctctttagggaacttacaaattaggagggagagggatttttaaaaacacagtacatgatatatatatacaatacatatatagcatgttccctaatcgctacaaaatcctaaggcaatttagagaaaaaagtgaccataaaaattatgattaggaaataatggggagatgcataagtcctgatgtttcatcaggataatggctttaatttggatcctgaagtattagtaggctattaataggcaaggatctctttattccttacacacatattaatttagcatcatactatgaacttgtccaagggctagacagatcaattgaacagcactaagtaaaccctactctaaaggcttctggtaaacgaatactagataaattaggtaagttcagatactgataaattctattacaataataagataggataatagcaagttgcttgaaagagtaagttgcaagcaaacttgaaagttgtttgaaagaggagagaatggggcctttttgtgaggtagggctttctggaaacacagtatctgaataaatattaaaagccaatctcaaatagagcatttcagaaaaaggaaatagatttattagagattccgagattgaaacaatattggtcatgagttcaagaaacaataactagaacaaaacggcggtgggacagaatgaggtcagattagagaggtagacacagatcatactgtgcaggatcaaggagatattcaagacagaaagaacagctagagccaaaatacaattcaaaacacatagagcacaatggttgaacataggtggctattgggatcaaatggcttggcttcaaattctagctcttccacctcctgtttgtttagcgttgaccacattatctattttttcgagcttcagccttctcatttttaatgcaaaaataatgatgatgcccagcttcccatgtgtgatgagtacttcttggtatgatgcatgtacagggcttagcaacgtgtccagcactaacaaagtaaccattctagagtattttgaagaacagaattgagtccagtttaattgttacatataaggaagagtaatggaaaatgagtctacaaataaaacaggaactagagttaagcagaatatgaaacatcagactatttcataatcaggagaaaatccttgcactcctttaagcagggaagtgatgtgtcagcagtaaactttgggtagattaatatagcaattgttgacaaagtattttggatattggagataagaaaataagcagtttggccgggcgtggtggctcacgcctgtaatcccagcactttggtaggccgaggcagacagatcaggaggtcaggagatcgagaccatcctggctaacacggtgaaaccccgtctctactaaaaatacaaaaaattagctgggcctggtggcgggcgcctgtagtcccagctactcgggaggctgaggcaggagaatggcatgaacccgggaggcggagcttgcagtgagcctagattgcgccactgcactccagcctgggcaacagagctagactccgtctcaagaaaagaaaaaaaaaaaaaaggcaatttaatttgttctaagatagagaccaaagagaaggactggattgaagacattgtagaggttaacttggcaggactttgtgactaaatgaatgagtacaatctcaggagcctgagagaatatataattgaaatacagacggtggggaaggaaccagtttgagtcagaagaaattgagtgaactgtagacctgctgctctgagattcctgcagctatccagcaagcagttggaaatgcaaaagtaaactaaggggaaaagtactggctggaaatgtaggctaacattcagattttagctgcagctttcagattgccggttggattgtcaagagaaaagaatgaagataaaagagcagaatactaaggatataaccctaaggtccaagtatagttcactaacaagactagaagaatgagtttatgaatgagataggcgagtgatccacatggtcaaaggaaagccagaagaacagggatcatattctacatgtcaattgctggatataaatgatacctaaataatgaatttaaacattttaactcagatattcagtttatggcatggcaaacaactgatttaaaaattgtttataatgctttttttttttttgctcataatgaaaatgatgtaaaaattcctgaactctgtgtgtttttcctgtatatatctaatttacttacaaaactctcatagggaacttttttttaatgttccatttttaaagcctagaataacttcctaaggaaagtgtgaaatattcagacccataatagcttcctagaaagtagttcttactttccatatgaaaaaaaaaaaattctttgacataatagctaaaggtgatgaaattgtttcttctttaaatgactctagtcttatggtggcatttagaaatgcatcttaagtgaggggttatcacaaagtcttttttatctgctagtttttcctctactttacctttaatcatagtaggaacaaagtataaacaaaatcagcaaatataaataaaaattgtatacattgttctattttatttgttatccaacatatgtctcactttgcattgtgtagaccagaattcgggttcatagaaaaaattctttcttcaaatgagcatgcttatctatataaataaaattataaatggaattaagaaataataaaacttatgtaaggtatttaattactatgaccaactatatattaataaacttgcaaatatcagtgaaataaatatctcaaaagctagaaatgatcaaaattaactcaagacatttaaaacataaagagttcaataaaccaggaataaattttattttttatccaagaactttagggccagagagtttactaatgttattttgaaattcaagtaataacttgatatagtgtttgtataatataaagtgtaatggttatctattattgttcctgatgattacaaaatttgatcaacaatttgatcaacagcatgaaaaaatgtagtacaatgatgcaactattaacatagatgaatacaaaagtataaaatatataccaacaaggtatttccaataatacattaatgtattgatgacataagataggtttgttccagaagtttaaaaaatgttgtcaatgaatttgataaagtttaatattcacattaaaagtattaccgttaaaaccaaaatatagcatacttattctctccattattttggaataagaaaaaattattctttgcagagctcatgcttatatgcatagaataccccagagagttatctgaaaactgtcagacattattcttaaagactttagctacaagaatttagatacaatataaatagcctaaaaaccagtaacttgatgttgtatcactgatgactgcttacaagatggaaataatttattatcaattaagaaaaaagctaaaacatacccagaaacaatcctaacaaatctgtgggaactttaccaataaaactataaagcttcatttaaaaaacaaaaaactaaataaacagagagatgtactagatgggctactggatggaaacaaatattgtaaaaatataaattctaaatttagagatttaatgcaatcttcagcaaattactagaatattgttaagaacttaacataatcataaagtacatttggaacaatcaaagtagaaagacagctacaattaaatgacattacttttttttaatacaagaaaaaagagcaaagatgaagatatgcaccaagctgataacaatataatctcttgggggtggaattaaaagggtttgatggaggggtgaggctatttctttttttctatatttctttagtgggagtgatttttactttcttctgactgtatttttttaaaaagttgttaaagcaataaaagctgaaaatctagggaaatatttacatccaatataacaaatgtttaatatctttaatatgtaaacatatgtatcacttataataaaagtattctaatagaaaattttataaatattatcaggtaattggcactgaaaataagaaattaaaaattcaatataacaaaaacattttaaaaatagagaaagcttttttatctctgtaattttgtgatttaaatgttaagactgataaggatacagtgagagagaccctcccatgccccttggataggaatgcaaaaggggaaatgaaaatctctgattgctgaatcataatgcatttttactttccttctcatacatttgtggattttaaaaaattctataatactacacattatttctatattaaggaaaataaaaagtatttcaaattcaagaaagttatgttttatgtaaatgcagcaagctagaacttttaaatatagtacttctttaaaacactgctttttaaaatttatttatgagtactgaacatggttatggtctcaatttctctccccagtaagttcatgcctaacattttagtccttgaaatggaaatacacaatgtcttctcataaggatagtagatggtatatatagtaataactatcataacattagtaacgttgcgggaacttttccttagttcagctaaagatgggtgtccacaagaaattaggcttgcagacaatttgaagcatgaggagggcagggttcaaggaaaagagggaaaacagggactctccacaaggccaggggccctgctagggtgcttccagcctggcagattgaatcccaggttctactcaggaagaggagggccaggctcctccctgctgcaaacagcacaaacttttatggctccaacccagtgcgcactcctcccaatgttcaggccagttggaggctctgccagggagcccttcccacctgtctcagtaatagtcaaaatattgaactttatcatatgccggatactgtgttaagctcttcagaggcattagcccagttaatcatcaaaccctatgtgatggatgttactgctttcaccattttgtagataaaagaatcgagggtcagagaagttacatgaatgtccaggatggtgggacttggaggaggaatgccaacacctacgcccagctagatcacttatttatttgctatcttccctgagaggccatttaacttacttgagccaaaaggttctcaactcagctataaaatggaaataataatacttggcaatgttgtgaaacccaaatgatgtactatatgtgaacgcaccctgaatagcaaattctataaattcaaagcataatagagattaagtatttacagtttccttctttaaagtatctttcttattttaccacttatctttgccccaaactttaaaaattgtgatatttcataggagaaattatttttccttattgaatccaatatctgaagctttgtctacccagtgttgctagtcagtgttttattgcagactaacctattaatgacctctttaaaagtaaattccaaccacagaacctgtcttcctgtgtaagactttaggtgcagcaaatcatcatgcatctacagcaagttttccactctatattgctactgccaaagaatctcagatgagatatgagagaaaataaattagtctcatatgattcaaaatgtagtgaacactttgcaaacaagtattttttagcatcttaaataaattttggttgaattacgtctcatttacaatatcacatttcatcctaatttcagttgttttccatattgtctcctattgacttctactccatttctcaagaagagtaaaccttactttaatttatctccgaatagaagattgaaggaagaccctgctataagcatagcgtcctacacaaggaatagctagagatgtaggaaaatttttattgattggaaaaaaaaaagtgagctgacctccaatattttctgttaggttttctctgtaatatggcacaggaaaaaataaataataatttgaaaaaagaggcagctttttcatattgctatggagcaatttatgaataggacataagtccttttttcctcctaaaatagggactttatggggttttcatcttcttttttattagtggttggattatctgatcatttacattataagaaacacacgaaaatctagaaaacattttacattttgttacagatttacaaatagcatgttttcactttcattctaaaactaattattgatatcagaaatttgtatcttacctagatcattggttaacaagacagatttttaattcataaactttaattcttcatatggcagtctgattgaaccaatacattttttaaaaatttatagctaattgaagtataacatgaattaaacacacatagacttcaaaataaagcataaatagaagtgcatggaaagatgtaccgatgattggttcttaggaaattaataataaaggctaacatttgttgaactcttaccaagtacgacctgcagttataatatgcgttacttcttttaatattcacaataattttataattaagtaccattgctactttatagtcaaactattaagtgatttgcccaaggacatgccacaaaaaaagtgatgaagttggattatgcaggcactggtcgaactcaacaagcagtgttcctcacctctcacctacactctgggtaacatttatttttcaaaatcttaactatataaagtatagcaatgaaaaatgaaggatgttctaaatgtaaattgccctcacttaaaagcttaaaaagaaactagctacaatgaaaggagaattcgtatatgtcagcgtgatctagcgcagtatttgtaataaagctgaggtggggggcagtggaataaagaagggaaaatccctaggggaatatattagaattaaaaaggagcattttaatactatgcacacaccacctcccaactctagaatttcccaccagtttttctcctgccttacgtagcctttcaaatactctttctcttcctggaacaccctttctacctctccctcacttcagggctaagttctgcaagttgatctcttctagactatcagaacctttcaagcaaggaccatgagtttttttattcatcttaacataataataagttgtaataattataataaattataataagttataacaacttttaaaactatcacgatgcctcccacagactcaacactcaagaagtatttgttgaatagacaaatatgatatatttcaaagtatctcacagtttgcaacgcattttcttataatacctcattctattttcatgataagcccctatggtgagtatttaaataagaagaaacctgagacacagagaagctaagaaacttgtctagattcacaaatcctgcaaaaaaaaaaactgagactcaaactcatgcctttcagttctgcatccagtgttgtttccctcacagctcagacaagaaattggtcttctggtaaattataaggccttcctgtcatgtacctaatttcatgttctaaaaaattttactacaccgaagtgtttacattccacagaaattttttaacttttcatttcaacttaactgtttattgcagagcgcagtggtagtaaataatagatacaatctttgcccttgagagaacttaaagtttagttagaaaggatcaggaaaaaaaaaaaaacacaaagaactgcaattcaaagcaagaaagacatggtataagagagtcaacagttagttggacaaattttattaggtaattaatctatgcaccagccttaatacaatatgctagtacatgaggaatttaaaagaggggattgtggactcaaaagaaagagatactaacagactcatgggtatggtagaatctgagacaaaacttgaagaactggtttacttttagaagacaaatataaaggtagtcattctgagataataatgagacgttgagtaaaagctacgatgtggagacgtgtggggcatgttttggagagagccagtttagtaagagtgatacaaaaaaaagttctatttcttagaatataagagtgaaatattaggaccttaaatgccagactaaggaattcattcataatttgataagccatgtggagccattgagagttttgagcaggggaatgacattattggaggtggggtttataaagattgacctaccagtgaatacaggatgctgtaagaagctcaaagtagggacactagtcaagttttcaaagataaaaatgataaagtagcatcacttaattacaccattgtatctcagaaaatatttaggtgatctaaaataaacatattcttttagtttattccctcaaatagataaaatgagtttaagagagtccctgatgatgagtttttatactaaacaaaatgcttatttgggtgagagattgcaactcagtatggttaaattagatttgttatttcttagaactacattccctttggtacttgtagagaacttctatttctgatttaaaaagaacacaaggcatatggcaatttttcatagttattacaggtgacatctaaactggcagagtgcagacaaaggaaaggcatataaattagacaaataaaagtttctttagactcatacacaaacaccaacagaagtgtacaaagagataatgaacttgcctaggatcactgcaactgaatgaacaagcccagatatctatcaattccaaaatgtattcgacataaaagtcaagttatgttttttattgctgttttcaaaagcagccatttttaggatatttgtgtttctgatatgttaaccaaaatgttttatgtatggtgtccattttaatggtgtcaatactgagtatattgtgctaataatgaccataacaattggcatctctaaacaacatagaaggtcaacttcattgatttaacttgaagtttttagcaaataaaataggaaagtattttccttgatgctggctattgagtctggcacttactggcactgaataagcagttttttaatgataactatcttatactagagagatatgactttgaaactacgttgtattcgttgaccaaaaaaattcttagagttataaattctgtgaaatgatctagaaaaaattatattgtcaattgaattttggaaatttgtgtatttttttcttttggagatacatactgtgtagtagcatattaaagtctaacatgtgctacctaaaaataaaacctatttaactttctttaacccagtgctttccaaacttatttgaccatgaaattgattaatcttccttgaacatatattcagattccatgctgactttaggaaattttgccagagaacaaggaaagcagcattatataccagagaaatgtgaagttttaataaaagatctgctcaccactaatcccagttcccacaaaaactgctatagtgtcctgtaacctcacccaacacctcaacccaataggtgttcaaatttaacctaagtgtttacaggattttcatagtcctatctaattctgcctcaaaaatagaaaattatctctgattattttatctccccatctctgctgcctccatccgttcattcaaccaaggctttctatgttctgactccacaacaggaagcatgacatatgttgaaatgaactcatgagcagacctcatggtcctcaccttcactaaacaagcagggtagtagaagaaaaagacaaggaaagagcctgatatgtctttgctaaggaaaataccttgggttgtgggaactgccttggtggataaaggtagttctgtgaataaaccaaaatctgaaggatgagtaggtaagagggaaggaagagtttcaaacaaggtctttgtgtgggagagcacggctttatggggaaaaataagtgcagtaattcattccattcatgcagtacagagcctaagggaaaatattttttactgttggatttcccttgtcaggaaagcttagaaacactaagcaaaccctggtacatgtaggataatctggaggcagaatgagtggcatcacacctcttacaagctttacctttggctctttaatcaggtagctacaggtattgggaggtaagggggctgatgctcaattcctccaacccctaactcccatgtcttaagcccagagttgcaaagggtgacccacctacatcataactcctacagtgctttacctctggggttttatccaactttggagaaattccttcatgcagactctgggtcttgattgcaatcatatcttcaggccagagcacttctttattgagatagaacacagctctttgaagtatattcccaaaatacaatatatgttagaatacttctggccaggcctatattgatgtgtttacttcttgtcaaaatattcatttgtctttgaggagaagaccccccagattttgaaatcaatgtgtaagccatatagaagcaaaattagagtttctacaattgaaaatttcagcatttttcacataatctcaaaaataccaaactggcaacattccagtaaaatgaagattaaaatgttttaaaaaatgaaaaactggaatatgttagtatatgcaattattctacatttttgaaaggaaacattcacaggacaatgtgctcatttatcatcctgaccagacctctcccactcttttctctttaaagttgaaaatgctgcaattattctgttatgcctcataaaatagtaaattatctccaattactgtacagtcacagtagcagtaaaaagcttgtgtagaacaacatactccccatagtcatcttgaaatttattagaatatcataaaattataactcagaaaggagtttcaaaaacatgtctagtccatttttattacctctgggcaggactgagttgcacataattccaggaaactatctaaagagaagattcaacaattattcttgttagctagagggttcaatcacacttacatagtgagaaatatttttcctatatgatacatttcttaaatgtttcctcatgttcatatgcagctaaattctcaaaattcacttctaccacctcaacccaagtgaatggcatctgagcaatacataaacaacaaattttacccttatgaacttaggaaaaacctttcatttatttgccacaatattttcattttcatctgaaagacagcactacctagacaaatttttaacccccttaagtgaaatatcaaaaatagtgttttaagagcaggaggtaaccttgcctctgcacaaaaacatcttgttctttccacagaaaccataaagtaagcacagctttcaccactgatattgtagaatattaagtaatttttttaaattataattactaatttttgttgggaatcagggcaatgccagatatcctttgtaaaattttaacacagtcaactgttcctttattgctcagcatgccatccaggctccattccagggcatgcccttccacagtttagggttgctttgaatatttctacaggatttttcagacattagcctgtcaatcaaatatgcagtaagttctcataaaatttctcacttccccacaccctgaaagctataatgagcaaacagagtagattctaatgatgtgaacaagatagcatacaacctttgaacttagatatttgtttgatacctggttctgtcactaactagctggatgaccttggaattatcatttgtcttctctaaatttcaggtaccttgtcattaaaatgggaatcatgatggttgcctcataggttagagtaggattagttgagataattaatggaaaacaaataataggtggtaaagaaaactggccctcagcccatgtttgtagttactatggctgatatttttgttgttcttagtactactatgtctattgggagtgccagaggatgatggcccaaaaagcctaacgaagacatttaggattggtattagtgttcagtaggagaagtgcttggggttttacactggcagggatgtacacaatattcaatggaggaaaagataggtgaaaattaggaaggcaaagtatttcctgcacgtgttggtgaggtgttgacttaggatccacacaaatcaagcaaaacactctcttatttgtgtcttatttcataagtgaggaactcacagcatagggtattaatataacatgcccaacgtgggtgaactaaggattcaaacttcagatttcaaagtccaaagtgaatgctttgttcacttttaccaggcttgccctctgccatttacaagagcagtctttcccatattcttccctaagcagacaacaatttagcccttacctatattgaattctcatagtatgctatactcactttattataggataactatttgctgtattctgtcactttctgctaaattgtgagctctgggaggtcaaggagaattttccattcagctacatatctcagagcctacaccaaaatcctgagtttcacctctgaaggcctgagtaggcaagttgctcctctccccctccagtgaggagggcaagtaagattctatctgggctcctctgaaatccacgagcagctctccaaatagagaagcactgatgtagagattgttgggtaataaaattaatgaggaagccatggtacaaaattttaacacctttcttttctgaactaaagttaaattcttgagtgtaggcgttccttcttgaaagtcctgttactggagagattaatctaccagcaatatacaaagacagattagtgagagatggtggtcccaataaaatcatttataggctaattacattccttcttcactcagttttactacaattaaaatgtaaaaggtctgtttacatttttggtgcctcaatatgtattgagaaatacaatattgttaagcaggttttcactttgcatttctctgctttaatataatgaagtcattatccatgcggacccacaatgctccgtgttaaattcgccaactgctgttctgtacattccctcagccaatttatttcaatttcagaaggagcaaccaactccacagtggatgactgctgactgcagttccacaccatcactcttcaagagtaaactcaaatcaaggaaaaagcttccacatgtgagcatgggtgtgctcaatctcctgttagctgcagccacagtttcaggcctgatagaccccagcttctgcccatggggtgcagagctacagacagctcacctgcctctaccacaggacagatcacaggacaggctgtgtgtgtgtgtgtgtgtattacatcatatatatatatatatatatatatatatatatatatatatatatatatatataaaataaataggttgcatacagaagattttcaaaccaatcattaacacatgtaagagctaggtcatattatttatggcactgttggtggtagccagatatcataaatgcagtgtcataaatacttttgtatgaaattatataattcttagggtaacaccttaaaactcataatttgcagagttccagggttagagcctaaatgttcagaaattttccacaaatggctatcatcaatttaaaatagctatgtttaccaaataaatttgtactgagctagacacgtggattagcaaatctgtagcacagagccgagaaaggaaccccttggtccttttgacctccctgctcttgtctcttattttctctgtttgctgattccatcaaataatttgatctttttagagctgatctagcctgttgtttgacaagacccttttttcttgaactacattatcacttaacccattaccttgtacttgtgaacagcatattagaatgaatcattttgccatttaacatgtgtggttaaaaattattggttatgtattgaactccactaaaactatgattttaatatagaagctgatgtttcaagaaatcagcagtctctactgggttaggtttttcaaagtttgggttgtgcatgatcataaggttaaacatttttcaagtgtaacattaagaacaaatttttcatgtaatttggatagataagtcatttcattcaagtctatatacaattttcttgtgctaatcttgatgtaaaaactaatggtagactgtctttttctgcttttgttgtttaaaatgacagtaatcaagtttaccatctccaccatttaataaagcaaacagcactagtatagaaattagaaaggaaataaaaggagcatttagtgaatgtcagtgttgatctagtcaatcattgtacatgtgttagctcctctagtttccacaaagccaaaatgaagtcgttattatctgagttttacaggtgttaagaaattcaccaaatgtgccctggtagctctttaaatgttgtgttccacaggctccctatcctgagcactctaattttctatggtacataatttacctgggtgatctcatctctttacttggtttcaattgctacttatatactctgattactctcaaatccattattttccactgttacctttcttctcaacttcagatccagatatccaactgcctactaaacatctcttccttgtccctagacatataatccttcacttacccacttttgaattccctattctctatgtttcctgtggttgctggtaccatccagccaaagtaggaaagggctggtcgttttcttcttctccattacccctaatatattcctacaaattttatctcctctataatgtacaaaagcaactagagaatctgtgcctgtcctctccactctcactaacttcttattgtgtctatcatcatatcctgcctgaacttttaacaggtcctcctgccttcagttttagcctcctgaactttgtcctccatactactgctggagaagtcaatagtaaacaatgcaagtatgccattttgctttttaaaaacctttaatggttctccatttcctggagaaaacaggccaagcttcctaacaagtccctccttgatctggttcacgctttcttctataaaactttaccgctcttcagttttttgacccctgacttttttctccagacacacaactccttacatattttctcacataaggtgttttttttttagtcataacttttcttcagctgagaaggtccttcttatctaccctttcactttttctatctaactcctcctcaccctttaagattcagtaaatgtcactatcaccagaaatccttttctgacccagtcttacaaaaatttgtaagggtcttatattttggaatttgttaactaaatgtctagagagttgacgtgacagcaagaaagatattcttgtaaatgaactcaagaaacccaggactcactgaaacaaagaggaacatttcaaatcattttggaagattcctttacttcctgaattaattcataagttgttttttttttctaagctaaattacttaaatagctttattctccccttgagtaaggacagaagctaattaggcattctccaaggcacagatgggaaaaatatcatctcccttcctcttttcttaatccccagtatagccagatgtagtgaaggtcccagctgcctcctaaagacctgctgtggaacaacaggatccaagagactgagggagccaatcaagcttaacatttgcatgcgaaggcctcccagaagcaaggaattcagctccctggctccctatctgttctgctgcttgtgggcaatagcaccacacaaagaaatgggcctgtgcttaggaaaaaatatatatatatttacccaagtcagaatgttcgtatgcggcgatgagaacccaatcaattcaagaggacagagcaattaatttatatatcagttataaaaatacaaattgatataaacatgggaacaataagacactgtggactactagaagggggagagagaaagggaggcatggattgaaaaactacctattgggcactaggctcactacctaggtgtaatattcccatgtaacaaatctgcacccgtacctactgtatctaaaatcaaagttaaaatttaaaaaaaatatataaaaatgcaaaatttgagagggagagctgcttaaaacagcttcaaggatttttatctttcttgaatttctatttagcagtcaatgtttcacactcttagtatataagttatcaaaactaacacattttcagtaaaactggacttcaatgatgtaacttatgcaaagtatcctctaaaacatggtttttcccttatgtagatcagctgagtgaactgtaagcatcaaagaaatctatatgaaaatgtatgtttatcaaaaagttatatgatgtttcatgtgattaaattctaagaagatgttcctaaatgtctcattcttacagctgcaaagcagtgttgacatcatccgatccaaattccctgctttacagctgaaaatccaatgcatgtagcagttcagtgactttaatgatggcacagccagtgttagcctagaaacccaaggtgcctgaccttgaaggaagttcatatgtatacacatatttgtgtatgtatatatatctatatatatatatagatatatatacacacacacatttgtatatatatatacacacacacatattcgtgtacatatatacacacatatttgtatatgtatatatatgcatatgttcatacatctatcaccaatcacatacatatatgtaacctgaatatatatatccaggttaggaatctgtttgtcttccttcagattactcctaacccctgccttctgtcttccttctcctctggcaaacccattttccaatcacgagcatcccattgcccacttacacactgctcaccacccagaatgtagggactgagtcttactcccaagagactcacttcaagccacctccttcccagccattgctggacttggcatctgaatatgttttgttctgcaggagtagatagcctcatatactaatcaagggtgaaagttttctttgtctgtcaggtttcctctaacatcttatgaataatcttaaataaaatgtagggaaagctttcagtaacatcaaatagatctcaaaagaaaggcagactgctattcaacattgctagcctctctctgattctagaagcaaagcctctgaataaagggttcaattttacacttttgttctatccccactcaggacttgctaaccacaatcaccccctcaccccataacctgctcccatgcccatttcttagtgtgggtataaagtcaggccagagacagctaacgagcaatgagtcggctgcacttgcgtactgagccaccagaggtgctaatagacaggaaattttcttattagatgctttcaaaaaataaaattctggagcccaagtattgtctttaatgtcctaagggcagatcttgtatagagaactcaagccttgtatttgtttaaatatcaagaacctgtcaatgtattgaataatatacaaatagtagatgtaattcaatttgactagtgtttattaagttcctaatacaagatagcctgatatatacaaaaaagtgaaaagccctgcttctgtggtaaaggggaactaagaaaagctgaatttaaccacacagattaatgaaaatattctgctcttgtcattgctttcagcactttttgaagtagatgtcttctgtttatcatatttcctggcaagatttataagagtcttcaaattataaatctttagcacatcttgagtaaactctcatttcttcaaactcttcatcactcgtataattagaaataaaagactgtagaaaaatatgaaattcctttgaaagaagtcaataaagagattcatatttcaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagattcatatttcaaatgcacatgaacatttaactagttattaaaaatttccaataaattgagctattactaaactggaatatacctaattcagattccaaatgtgatgagtaagacacatttttctggtcaaaagtaagttccattcattttattgcctataaattgagtctggtaagtttgagtgagagatatttgagcattatgatttttaaggtaatgctttgtttccatcaagttcttagtaaataataaattctcagttatttggagaaagatggcttttattttccccatattgcctaagcctccaagttataattctaactgttcatccaacttgctctattttttatataaatgatgacaccttctaagtaaagtgatcattaacatccatcatttttaaaagcagtttcactgaaaatgaagaatgataatgagaagagagcctagttttacaaaagggaattttaccttttctgtggagacaatttctacagtcacccacagaaacttgtatgtttaattcagttatgatggaaagaataaaatatctcttaaaagcttcaaactaatttaccattttatccgcaagtttctagtaggctctaacactaagcaaaccagaagccagtggatttctagacagaacctacctaagtgcccatctatctaaaaatgtgctttaagttgggtgcctcagcattacaattcctatcaatgggtccagtactcggtaacactctgttacatgtatctctaaaaatgcaatgtgtgtgtgtgtgtgtgtgtgtgtgtgtgtgtgtgtgtgtgtttagctatcatctcagaaatcaggtaagcaagtcacccaggaaacaaaataggtaactatgttaaaaataaacacctaatgtttatttcatttggtcctctaggtactaacatcatctccattctaaagatgaggaatctgaggctcatagggattgagtaacttgttcaaggctatgctcttaaccacagcgctgcattcttgtattgaaagcagtttgttaacttacaattcagaaacacatttactgcataaatccaatactgttgtgcatagaaccttattatacttttttcctctggctaaaataaaattgaagcattttacatttccttaattgccagcaggtgtctaaaggttctgttttccattttctggtgttaaacctgaatgagctcaaattaatgattcctgataaatatggaataaacagaaatgctttttaaaaattaacaaatattagttctttatttcattgaccagtaaatcagcaaaaaagaaaaaaaaagtcttaaagagctttactcttccccttaagtgaagaggaggctaattaaagactctttaatgccaataggagaaatatatttcccaccctgcttctgttttgttattgctcttgtgtttttggctaacatttatcaagcacatactatgcgccaggcactgtgacaaaaacctgcatctaactattcaatgtttgtcacaaccccatgaggttttcctgaaataagccacattaaaattgtcaaaaagaaaaacctcttgcaaatagctgatcaaaattcatcctctaaaagctatcctgtaacttacacattttgactctgccctaaacatagccagaagtaggttgcctttcaaaattatgtggcctgccatgggaaaaaattctccagcaccaacatgatgtaattggaagaacatagatgcctagtgttttaatatacccttcgcaactttcttgctgtatgatcttggagacaataccaccaaagctctcagaatcagaatatcacatattatcctatctgaaaagggactatgataccaaactcataatcttctgagattacaacttacgactcttctttggcttgtcgtgaggtagaatatagataatatatggataatctggaaaaaagcgtgcccaataaataacagggtattactctcaccatcatcatcatcatcaccattgccatcatcatcatcaccatcaccattatcatcatcatcatcatcatcaccattatcatcatcaccatcgccattatcatcatcctcatcgtcatcatcacctgatacattcttagattctttgggagaaaaatggtaggaaatgagtagaaaataagactcttccatgtggtagttgtgtgtattgtacatatacaacaatatatgaagtcatttcatgtttggtaactagacaattgtatctctactcttttttttaatattattagtcagatgtccagtccataaaggtttaaaaagtcaagtatggactaatttgagtataactgaagagcttcatttgtttcaaatgaaatgaaggggaaaaaagactggaggaaaccaggaaagaaaggagggaaattgagagatggggaaaaaattggaatgtcaaattttttttttccattctctgctcttgtgggttttgtttggtttggtttggtttggtttgatttggtttggtttggtaggactacagtataacatatgcatccttgcgtctttttatttctcatgacgaataatccatccattttttggtaagcatcttagggctcagcagattgctttatcacagaaggttaaatcatagaatcctcaaaagaatgggtagaatccattaaaaactgtgcaaatggaaaataacgtacctatttatttttctgttttcttcttgctacttcagaactttacttttctttggcaaacattgtaaagaaagaaaaatgttcagaggctgggcgcagtagcacgtgcctataatcccagcaatttgagaggccaaggcaggaggatcactttaacccaggagttcaagaccagcctgggaaacatagtgcgaccctcactgtctctacaaaaaaaaaaaaaaaattagctgtgtgtagaggctcgtgcctgtgatcccagccacatgggaggtggctgaggtgggaggattgcttgatcctgggaggtggagactgcactgagctgtgattgcaccactgcaccccagcctgggcaacagaacaagcccctgtcaaaaaaaaaaagaaaaaaagaaaaaaaaagaaaagagctcagagttctcagcatatttacacaaaatttaaaatataaaaactatatttttcctttgactgctctaatatcaatatgcagcttgctaataggcatatcacattcctgaataaataacattcactcttcctggaacaggtagcccccaagtttcttcatgtctttgcacaaaggcctccttatcaaagaagactttcctaacctctgcaggaagtaagttccccggctcatcaatcactactttccttatttgtttttttctttattttcttcagagcacttcttgcaatgtaacatctgtttatttagtgtcgttctcagtccattagaaagtaagctccatgagaccatggattttctttgcttcactactgtatgtcatggcagaaaacttcagcaataattatttcaatggtaatgcagtgattactgaaaagtgaatattaaagacttatcttctggaagagcaaagtcctaattattaggtatcagaaactgataaaaattaatatcagcacatttaaaatacatagctgatatcttgagtatgtaacccatatatatggccattaataaaagtggtttttgttttgttttgttttgttttgtttttgtttttgtttgagacggagtctcgctctgttgccaggctggagtgcagtagcacgatcttggctcactgcaacctctgcctcccgggttcaaacaattctcctgcctcagcctccagagtagctgggattgcaggcatgtgccaccacacctagctaatttttgtatttttagtagagacgggatttcaccatgttggccaggatggtctcgatctcttgacctcatgatccacccacctcagcctcccaaagtgctgagattataggcgtgagccaccatacccggccaaaagtgtttaataatatgctagaattgtcccttaaataactccagtgaaatagcgactttggaggatttatatatgcagtgtcaaataaccccatttaaagtatctatctggacacctcaaaatggtgttagtaagaattattttcagacctacaataagacagtgtcctagatgtcctggattagtaagtgagcaggtttaaggggtactagagagtagggactcccttattatgtcttggactcaagattgaaattagggtagggtttaccagtgacgtgaattctgtgcttatttgtcaaccctatggtgtctatactgaattcagtaaaactctggctttcaacttgagaattaacacatcatgcttgtttccaattttatgtcattgacattggtgagagactcctatgtaggaccatagcccaccaggaagagacacttgggagtctctggcagcatctctcagcatctagtctattgtctcacactgttaaaatgtgtctccaaagtttcatattttattccacaaaatgaaaacccaggaattatctggactgatcttccactgaaagcagacaagtggcatttgttacttaagcataattttagagcttcactctcttcaaccaggttgctcatcagagtgttcctcccagaggcataaacaagctctagtagatgcaattttctccatcttctaacattccaaaaataaattttagtgcccttcacacattggctttctggcaaatgcctgactggcccacacttaatctgactttgacttaacatagcactggttgcaaaagatgtgaaaaacatgggcagttcttacgaaacagattgtggttctagagcttagtcatatttaagagcaagagttttgaagccagtgtaggtggtaacagccatctgaatgtgggaaacttacttaatgtttctaaagctcagattcctcagttgtaagataggaataatgatagtacctagctcagaggagtgatgtgagaatatgagtaagcactgaacaacgttgtcttaaggcctgagcagaatagtgaacatgaaaatgactatcacatagcagttcaacatgtctgttgttttcatgtgctgccaacatcctgcatttgtgtgactgtttctgtttccagctgtctttatccagccacacagaagacgaaaagctcataggagtcctagaaaacaatggttactttgtctttatttcaagcaatagaaggggaccttctttaggaatgcatgttggatcaagttggagaagttgattaatattgtttaatgttgtttaaattcagctgtttaggaaatggaatgcctgtgctgataataaaaaagatcatagatagatagatgggtagataggtaaataaatgcatgatggatgaattaggtagacagaaaaacagaaacagtcataatatagatgagtggataagtaggtgggtggatggacacagagataaaaacatataagggtgcatagatggataattagatagagagattagatagatagaaagatagcctgggcagagtggctcacacctataatcccagaactttgggaggccaagacggggaggatctcttgagcccagtagttcaagaccagcctgggcaacataaggagaccgtgtctctctaaaaatgaaaaaattagtcaggtgtactggctcacatttgtagtcccagctacttaggaggctgaggtgggagcacctgtttgagccaggaggttgtggctgcagtgagccacagcactccagcctgggtgacagaatgagattcagtctcaaacaaacaaacaaaaaaagatacacagatagatagatgatagatagatacatagatagatagacagacacgtagatagaaagaacaaatcttggaactcccttcctcttctgagttacagctgaacacacttatgtttaaagtctatgcttttcaggcatggtgcactcaagttgcaaggaaaacctggcagattttcctagaacttctgattttgttgataccctattaaaatcatcaacatgcccctgcaaaatttgataaaatcccaatttctttatagaacataaaaacccattactgagttgatgggtgcaacaaaccaccatggcacgtgtatacctatgtaataaacctgcacgttctgcacatgtatccctgaacttgaagtataataaaaaataaattaattttaaaaatccattattatcatacttaccttactaacttctcttcctgtcagttcttcctactccttgagccaagctggacttactggtaattccctgaacacttttgatttctacatgatttctatatgctattcttactagaattttgtgtttgtgtttcaaaaagtgtagatataagacaaaacaaaaaatatatatttatattttatagaacaaaaccttaaagaatcagtgtcattttatgttagaggagcatggccttgggttacagtcccctagaccctcctgatggtatcccttccctctcctttagctttatgtgtactttggtgaaaatttttaaaaatgcgtggttaaccaaaggactgcaataattggtgtggcatgactcataaagcctttgcaatttttgttttattatgcttttattttagcaatgtataaattcatttttgctaatactaaatacacatgctattaaggtgatgctcatcagatgatattttcagcagaaaggctatgagatgcaatggaaaacagaacacagtttgctatgagcagaagataaaaggcatagatgcatgctaagccaaagaaagatcaaatgctcaatagacccataaaactttccctcatgggtctatgaaagagcacagtcaagctgataaaagttatactgaaaggaagagtcactgttgaaagaagatcaattgagtagtgtattgaccatggatgcaattttctaaagctttgtagaaatattgatgtaatctaggagggattactttgcaaaatttgctgtctaattcaccatatttgagtattttaaccccactaagtatgagtgtcagcaaagacttagtacttgaaagtgtgctaagagttcaaaatggttaagaatctctgagttaaattttgcattttaaatcaagagacttaccagtaccttttatcatcaaaccagaaccagaaaatcagggttggggaggaggcggtggcttttaatatagtaaatctaagtataaatgtataaaattccatttaagtcatagtgcttccatggaatgtaaagttgtaacaaagatgattcaaatatgggtatattataaacatttacagagatgtattattttgaaaatggtaaagacctctgcaaatggccagatggagagaattacacatatacaaaaaaagtaacatttttagattaaaagtttgcagatctttatcagaaacctttataaaagcaagtaaacttttttcattgtacataaaaacatggaaaatttgctaagtttcagcaggtatttggggtatacagttatagccaccaaagaataatttttatgctcatctggaaagaatattttttcaggaataaagtgttttttcacagtgagctgtaactgagtgattatatatgtattcatatgagacacttttgagagaggaggtgctaaaacaaatttaaaagtattagttgatctatagcaggctttgtccaggcttttctatgagcaaactggaacacacagttaatcgaggaataataactaccttcttaatatcatttgccatcctatgcattatattgtccaccatctctaaactctctgagtctcaccatcgtattgttcataagcagttctccatggatgtctgtttccaaacatcttgagagcacaggaattgtctgccttgattccagataatatattcaagaaattttgtatggcaaagagctttggaagctagaaatttggagcaaagatcaagtttatttgtttgcatcttttgtaagatttggattttctaagactaggatttctcagttctaacttcaacccattatgtgaacatcatctgcttgggccatgccataattacccgcatgggatttgggacttggggtgtcaaggggaacttgcacaaatataaagctcatgctgcttgttatgtcataaataatttggtcctttgtctttgaaccaggagtctcatgtcttctgctagcctccatgaatttatagcaggctaacttgttagcttacaagtaggtcagaacctcagtcccttcatagttcttaacacacatctacagggcaaaagcaaaacaaataaacactataatagtgatattcaatccagttgagcatgagacagggcattgaacagggatttggaagtaaattgtaatcccactgcattacaaccattttttgagttactctgtgcaaattatttcacttctttctgctactcaatttcttttttttaataaaggaacttctgctaacatgcaaatgtgtgcatgtgtgttttctttttttttttttctttgcccattgttttattatactttaagttctgggatacatgtgcagaatgtgcaggtttgttacataggtatacatgtgccatggtggtttgctgcacccaccaaccagtcatctacattaggtatttcccttaatctataaagtttttttagagagggtggtggccctataaggtctaactctaaattcttaaaacttgttaaatttttttcagtgtttttcataactctgtcccttattccttcaacaagggtttttttgtttgtttgtttgtttgttttgtgtgtgtgtgttgtgataacttaaaaatcagaaaatattacatatgggaagctccttagagatgatgtactttagggacttccacaattatgttctgatcaatcctaggtttcttcagagaaaattttgggtctctgaaatgcttgattgaactttaattttcatatacaatttaattaagttttaagctaataagacagcatgtataatcagatgtgttataagccaagtgctaacacatagaagaccatcaatgagtcaacttatatattcactgacattaaaaatgcaaatgccataaaattcaatttctaaaacaaatctatactgataatatatttattttgactgtttttctatggaaagttaagaacaataaatcactttgaacagcccattttacaaatcagaaatatgaaaaactaataggaatatgagtatgatgaaagaatgtggttaattcgagtaaagagaagacagaggaggcaggaagttagctatacatgtatggagctatgataatttagttgaagttttttattccttttgagttaaggatcacgttttgtttcttttgagtttctatagttaaatgctgcaataccatggagtgtggttaaccagagtgagttttcttcctattagaaattgttattaaagactttgttacaactaaacagaaaaaataaaggaataatcccattaaaaagtatgcaaaggactaaataaacatttctcaaaagaagacatacaggccgagagtggtggctcacacctctaatcccagcactttgggaggccaaggtgggtggatcacgaggtcagaaatttgaggcaaacctgaccaacaaggtgaaaccccgtctgtactaaacatacaaaaattagcctggtatggtggcacgtgcctgtcgtcccagctactcaggaggctgaggcaggagaatcgtttgaacctgcgaaatggaggttgcagtgagccaagatcgcaccactgcactccagcctgagcgacagagcaagattccgtctcaaaaaaaaaaaaaatgcaaatggccaagtatatgaaaaaatgctaaccgtcactaatcatcagacaaatgcaagtaaaagccgcaataaaatcatcttaacccggttaggatgtctgttatcaaaaagacaataacaagggctggtgaggatgtggaactctcatacattgtttatgggaatgtaaataagaatagccctcatggtcaacaatatggagttttctcaaaaaaaaaaaaaaaaaaaaaaaaaaaccctgaaaatagagctaccatgagatccagcaatctcaatactgggtagctatcgaaatgaaaggaaatcagtatatcaaagggatacctggattcccatatttattgcagtactattcacaatagccaagatattgaatcaacctaagtgttcatcattgaatgaataaagaatatgtggtatatatacacaatgaaatactatatagccataaaaaataataaaatcctgtcatttgcagcaacatggatggagctgaaggtcattgtcaagtgaaataaaccagaagcagaaagataaatatcacatgttctcactcatatgtggaagctaaaaagtttctctcatggaggaagagaatagaatgatagttactagaggcttggaatgtggtggtcagggtgggatgaagagagggtagttaatgagatagatagatagaaggagtaagttcttgtgtttgatagcacactaaggtaaccatagtcaagaactgtatattgtgtgttgtatatttcaaaattgctagaagagggtcaggtgcagtggctcacacctgtaatccctgcactttgggaggccgaggtgggagaatcacttaagcccaggaggtcaaggctgcagtgagcctagatggtgccactgcactccagcctgggtgtcagagtgagaccctgtctcaaaaaacaaaaaaactacaagagaagatttaaaatgcaaagaaaagataaatgcttaaggtaatggatatcctaaataccctgtttggataattataccttgtatgcatgtatcaaaatatcacctataccctgtagatatttacaaatattatgtatccaaaaaaattaaaaggctttaaaatgtacatttcttccttggcattgctacctctaatgatgagatgacagacctaaacttgggagaaaccaaccagaatgaaaaagagatatgtataaaagacaatatggaagaaaaaccacagaacttaatggcaggtacaagtacaaaaaaaattaaactttgctcttgcatcctggtgactgggaaatgattatattgttgacagaaatatgaaagttgaacagagcaaccggtttgggaaggaaaaaattatcaacacaatttcagaaagttaggagtttgaagagatagcagaactcctgctctaaatctccagtgaacaggtcagaattgaggagaaaggcctagatagaattagagatttggcagtcatctgtgtccatagattgcaggcttcatatatcagattttatctgttattcttgaatcttgaagtgctggtcatgtggcaattttctgccactctttccaataaaaagtccatattctgatttccctgtgactcagtaaattgcctcaaatctcatacactgtttttcttgttactgggtgtcaaaccaaatctgcctttactttaagtgtaaaagttttaaaactatgttgtgtatatgcaaactggataattacatattcatttactgagaatatggaagcatggaaaaaaactaataaatcattttcctcaatcaatgtaaggaatctaggtttacaaaggcatatttgaattactataaaagaaaaggagacctgacaatttctgtttgattgtgagatgtatagcatcatcaaaattacaaggtaaaagctgaggaacatttttctgaatgcttgaagaattgactgggtattcagcagaagctgaatgaaaatgtcaggctaacaatgaagattttgtactttatcacaccctgatgactggtacatagcaagatttgatcagtttcataaaagtaggaaattgaactttcaaagacatcgctagtactagaatatactagaatgctcctttagtatgcattcaagttttttaatagtatgttacttggttaatatttatgtctgtctcatcccttaagtctacctacatttaaattttatttcttggtaagtataaaattattctaagcttacctcagacactaacaaataagtaacaagggctcgatgggtatcaattccatgcctaacacagggctgggcattatgagaagtttaagacattctaatagagtagaatggtggtctccaggggccacctggagatggagaaaataaggagatgttggtctaagggtgcaaactttccattataagatgaataagttctggggatctaatgtatagcatggtaactatagataataatattgtattgtacacttgaaatttgcaaagaaagtagatcttaaatgttctcaccacacacacacacacacacacacaaatggtaacaatgtgttaactaacttgattgtggtaattatttcactatatatgtgtactaaaatatcatgttgtacacattaagtgcatatacttttttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccagtgtgtgatgttccccttcctgtgtccatgtgttctcattgttcaattcccacctatgagtgagaacagtgcatacacttttatttgtcaattatatctcaataagggtagggtgggaaagtgagccaggacttctaatatcctgctagtcaatgcatttataaaatgttatttaattaccatgttcctattgtaaagactcagtttcaatagttcataaattatttattcattattggtgtccctgacaagataaataaatatgaaacaggcttgcacttaagaggggaaaagcctatgaaaaaattacaagctacttgggaagccttttggatacttgtaaagtaggttactccagatttattctgtgatgaggaagaatgacagacttggatggtttacaggagcatcttgctttcgatagtaaaaggcactcattggaacatcagcttattcaactccatgcctttacttttagggccacaggaaacaggggtcaatgatggtgaatgcgtgctttttctcttgacagaagtaggaggattgaaagattctggtgcccttaagtgtggttgaatttctgaacaaatatgatccttgcaagagtaattaaaataagctgctaattaaaagcttttgttgtttaaacttggagaagcaaatcaaagtggcaagctttcactccaagtcaactcagtgctctttgactcccagaagggcagcttgagacaacattgcctaaaaatttcttgaatgcctgaaaggagttgggttgagttcagcttagaagtttagattggaaaagatgtctatgttagaataaatcgtggatttttagatttaacatttagatagaaaattacttaattttgattattctaaaaataaatctaccattccagttagtagaatagacatcctttcagctaccatctattgaactcttattaacagtctggcacctggtaactgcataagcttagttaaatctcacagtagtattatgaggttgataatttagttatcccatttttataaagaagggaaaaataatgaagatgttaagtaacattcaagattcattagctcacaagagtgaggctggaattggaacccaatgtactgaccccaaagccatcttctttactaccatattttgccaaccttgaccagctgtaaacttgaggaatcccatacgcatgtgctgggtaaaatagtttccaattacaaaaagacttctaatctccatttttttgtactacatattactattatactattttctgtagcttctaacaatatataatactctaataacgacattgtaattattaataaaaatgactaatgcaactctgtaattttcacttttaacatgttacctaaagcactttttgcttaaatgtttcttcttggtcaataatttattgctcttgctaaactgaaaaacaatatgtttgatgaagttatttcatgtaaatggtaaatcctttacatttagaaaaaaatcatttctcttgtgtttttcattaattataatggcagtgatcaattttaaatatggccttacttgcatattaaaattgatttccttcccagtttagttctgcaagtattacttatttaggaaacaagaaaaattataaaatgtttttactattccatgtttgcaaggtatgggtagttatttctatgggtcagatatttgttccaaaatactattcctttgcttccacaaacacaataataaaaacagttaggtctaacatttattattcaataaattgatatgttccaaatactatacttggaactttttttttttttcctccccaagatggagtttcactcttattgcccagcctggagtgcaatggtgcaatctcggctcactgcaacctccacctccctggttcaggcaattctcctgtctcagccttccgagtagctgggattacaggcgtgcaccaccacgcccagctaatttttgcatttttaatagagacagggtttcaccatgttggtcaagctggtctcgaactcctggcctcaggtgatccatccaccccaacctcccaaagtgctgggattacaggcatgagccaccccacccggccagaacttttttatacttggaactttatatctattatctcattaatactcacaaccatcctataaagcagctgacattatacacaataatacaagagcaatggggcttagataagttaaataactctcccaagtcataaattagaagagacaaatgattttctaaaaccaagactgcctgcttcctagtactaattttttaccctatcaacttgctgcattcaaaatacctttgaaaatattaaaaattaaactataagtataaaataagaccttgagttcatttaatatttggtttattcataaacattttaatgcatatttttaaattttagatgaatagaatttgatttagctgtaattctataatgcatttctttacataattggtatcatgttaactctttgttagccttgttgacctttcctagcactggtattcatgtatatgagcctgcttttgtattgacagtggatatttcttcctttcctctttctctgcacaaatttctttgctgtcatgttgttagcaaatatttattccattcctgcaagcagtcatgcataaaaatatgataatagatattcatgtcctttcttaaaccccagcacatacctacttaaccatcacgtcattcaataatacttatttcaccatgacaagaagggcaacataaataattaatattgatttccctgatcttgcctctaacccatacagctttctcaagtactgattgatagaaaaatactttacctctgaagctgtctgacatttaaatatttaactcccatctcatagttcatgaaatattactaaaatacacagaaaaaactacttaaaaagcagtaattcaaactaaaaacttgagaaagcaactgaaaccaatgaaatcatgtatgatttttaaaagatacctctagaaacttaaattcagggcatcaaatttatatttttaatctccatgaaagaggcaagaacattattgctatttagtaatgcaatattaaatgatattttgctgcatttcccaaaggcagtaataactattactagtagtttattggtttataaaaaagtactatcttaattcataaatagattactttctctcacttctattcacctcctgcctttgacccgtcagctctgcaactttgggtaaattacctctttgagctttcctcactttatctataaaatgtaatgcaattcacaggattaaatacaaatacacatacatattatttgtgtgtgtgtgcatgtgtgtgtgtgcatgcatgcatatgcataaacaaacgatgcctggcatacatgtagtaggttctcaaaaactgtgagtcccatcctttttttccctttttgtatatttacatgacctacctgtgtacacacctagttaaataccttatattttgcaaggctttcacatatggtggggccagggtgaggcaagtgtgccacttgccttatgcacaaaatttaaggtggtaagaaaaaaactcagtaattaaggtgaaataaaaatttaggcagtatttttaaaaatcagaatttatccaaaatttcctgatgaacaaaacctcaaaatattaaataaaggcaaggtccacaggactggcatttccttcgcctcagcctccagtgtggcttagcccagctctgctttcaccagcgttgcctacacatgtcccgtagctctggcccccacacagaaacaacatccaagatgtctgcgtccttagtcgcaggcctcctacataaggcagctcacagcctcattccttattctcggtttgaggttgaaaggtttaaatcttgaatttggagataggaatgaaggcaaaactcaagctgagaatttgagagaaagcaagaatgagagagtatagaacgtcacaaagatctagcaatgagggagcttcattctgaactcaccatgcttgaaaggctatagatgagcactgtctgttccctcagtctgcatcagcttcatccaagaatgatttttgatgatgacattgaataagtatccatgtttctgtaatagttttaggaagcacaaaatgaacttctggttcctcttaggcttataaatataaaggagtattccatagttattttatcttcctattggccttgaaaaaaataccctattagttatctaaatcctcatcatgtgtaggtgtagagtcaatgttaatggtactttttgataaataaaaatgatgacatcctccttctataatacctattcccaaatatttaaatacgcttctactaaaaccaaatcatagactaagttggagtgcttggtgttacttggttttgatttgttctctcctgagacaggacacatttttgtctttgatttaccccaagagaaagaattgtcaccactggataacccagtgagcagaataatcaggccactgagcagaatgagtgagtcatggtgtttctagtcctccattaccaaattgtgcacaaaatatatcgcagctggtgctgccacgtatgcagcattttaggtgggctatggactgctgggaaaagaccatacaaacctatagaaagtccctgatttatttaacaagtatcctgaaattaatggaacaggggctctccacagcaggaaaagataggtagtatatggcctcccctttgcccctgggctcccagaggggcacacagctgccagaaactcgcttcatctgagaagaccatgctaatgttgaaaatatagccaagttcttgctatgccacagtcgcttaaaatatgaggcatataataaccatataatattccagtggcatttaggctaaaaatctgcatgcttccattatagaagcatttacaaacttcagactctacaggttcttctgcacacaagaatcccatatcctcttctggtagataacgcagaatcatgtttccctttactgcgtatctgcctttagaattcttgtgtctataaaaaactcttttctaacagaacactccttgatacagatttagtatgcctttacctaggtgctttccgtatatagtgtgatcttaatagtcacttctctgaaatatattgtctttactgtgtgcaaacttaagtatttgttggggtcttagatcaaatgaatgtgttttaatccaggcctaactgactataaaagaccgtgtgcttcgttaccatgcagggttctacagattgcatacatcagaatcatctggaatgcttatcagcacctcattgcatctggtactgaatctttgtctttgggtatggggcctaggaattgttagttttacaagctcctcatacatgctgaagtttggaaatcattgctttaatattatactgcatcctggttgcactgattccttcacaatttgaagttcttgttgtcttaggaagagaagcctataggctaacagattgccagcacccctgtgaccattactgtttgcttccctcaaaaaaaccacattgttgattggcataagtcctctagtcactacctcaccctgagctcagcttgccgacatctgaatgaactggcagtcaaagccatacagtgccaagagagttagcttcctaagagttcctcatgaaaaatggaagccaggttttgccccttgctttctatcttgaattttgttaaaacaaaaactatttttatctgtggaaacaagcatgtatgccatctgttttctttgagatatcaaagttcagtattgtttttaattcagcaacaaatatttattttgcccttccatatgatgtttattcatactcgtctccttcaccctaccagctttatctgattaaattcagtctatacattggtacattaatattgtctgttaatttttttcctaattaaacctaaggaattgtatattttaatatactgtgacactctatgtattctttatttcttcaaaattatactcctttggaaatgtacaaataatgcgtatttgtatctctgccatttcttaagcttattatttaggcacataatatatataatattagacatgctggtttaactaaaataagctattcattttgttttcttccatttatattattgtggttatataggttaatatatttgaaaaacatgagaaatatattataattaaattattttgaatttcatagtccaaacaagtaaaactaatgttgttctagcactgacaatgagacaaagaggagtcattgaataattaggaaaaagataaaaaatatctagattagcaatgattatttagacatgaaaaacaagatgatatctactaaaatgtatataaactgatattcagacatattccacttgtcataattaatttgagccttgtgtatgatattcattgcttctaatgctcccacaatttttttctgtcttatggagcccatattttctaagaaacgtcatagggccataaggacaccttgccttcagatgcataattcattaggttaaacagtgtatgtcattggcttgggtttctttcttcagggtgctgcccaagtgcatcagaaccctgtttaactggcagcaatttgagatgcagaattagcatattgtttcttggggaatgcccttgaatgtgcttgagtagcttgttgtgtaaggcatgaacagaattgccaagagccagggaagaaatgggttccaagcatcatgcagtaatcctgtgtgcctgtgcatatctcaagaaagctcctcaggaaatgtcagatcattgctgaatgattaacgcacagacattgcagaccagagttatacctggggactcacagctcactcatattacagcacacctgtgcaaaattccaaagcgagggatccctgtggtgccaggtaagcgtctcaccttcactactaatgctctaaagttacagctgagaaattattgagaagttaagctacaactttgctacaacttgaaaacttacatttttcacctttgtggggatggagcttaatatatttgtgtcctgggagagacaaaatgtagaaataaatagagggctggcttggataaagtatactaaaaatgtgaccataaaaagatgtaaagaaaaacaaatcaacttccatgtggaccaatcatgagagcttagaaatacgactttttattaatctcacatgccaagaaaccatcccttactaaaatgatggaatggaatatttccatttggcaaaatgcttgcaggtgaagcaaaatttaatcaatcaaattcaaatattagtaaaatgaggagaaataaactctaggcaattcataatttcataagaactctcatttgtcttttgagcaaagaataaaatagctatcattgcttttaatcactggagaaccagaattctttttagacttccatcacttactgttgaatatgcttgtgtatgagtcctccagtgttctgaaccagagaatagtttctttatgggatttgtgtctgctgcagaatgcttggaggaatatcatttttgcttgcagaaaattgaaataggcatggtctatgtctcaagtgcattttaaagtaggaggtcaagtacaactccttggcaagtgagaagcagacataataacaaaacttcaaaccctagattgtcttcatgtaaccttgtgggtctatgattctaagaaaatcctacatttaaaaaaaagatgggtgattaggtatagagagcaatatacagttttctctgatgatactccaaaaatggattcttaagaacagaccctgttaagatctttccatgttgctaggagcaattgttaccataggaacaatggtactagtaagcatcatttatacacacataacatccaacccagaaagtgatttaattaaattacctttacaattatatactgttgtcttttgcagcgttttcatgtgtatagtacaacttattaggccctcttttaggtaagcttatgtaaatttgctcactggtaactttcactggtttatatcctcaaccattttgttacattgaagtttagtctttctttggcatagaagaaaaaaagattcaatattctgagctcaattgtcatttttgtagggaactttgagtcacagcagtgatgggtgctcagccctgatggggctgctataatcaaataagaaaatcaaagaaaatgttgacactgctgcagatttagattgtgcttcacccacaacccagtcattttatgttgagtattattttgaaaacataaaatcagaacaagtagtcatcctcaaattccttaaaacattctttttttaatttttcattaaaaatcacattctctgatgaaactgaaaagaattcagctcgagcaacgttggaaaatgctcctctacttccccccttaaaagaatagttaattagactatattacagatactgattacaggcctgtggtttgctgttgaaagaatatgctagctcaggttacagatctttctaaagccgaaagaaagaagtatgaattcaggttgtaaattgttaacatattgccagaaaacaaattgggagatgcggtcctctgctgtgatgtggatttgtgccatgattgtggatttcctgaaatactcttaagtagagagtcttaggtactggggaagataaagcacaccacacttgactgcaacaggcttcagctaatggcacatccatcctcacctccttgatctgtcatttcctccaaaattagctcatttagtttacaatgcatcaaattacttttcagtctctatcaataaagtgtgccatctattattacaactgtggaatatactggcaggcaccagacttatttctcctgaatctcaaaagtggacaggaaaagcagagtcaataacacctattagcaaggattatgcattcagcagtgtatataaaatactgggttctttaaaatataatagagaacagagctatcagtcccagggctcaaatcccttccctgacatttttcagtaagacgcttccttttttaccccaccgcccagaagggcatgtctcagcagtttcctcagcccacattgggataagggaaagaggcttctgattttctgtgcaaggaccctttccaagagcatccagatgccaggcatccatggcccaggatgtacaattcccatttacaaacaaactgggctagacagcaccaggaggtagatggctcttgcaacaagacccatcatctgggtcagccagtgcaactattgacccgacactaggaagaccagaatacctctcaaacctcttcacaccctggctcatttcgtttaagagacttatttcccaagaaattggcgtgggataagcttctaataagctttcactttaaattaccaataattctgttttaccttttcaggggagaaatactcttgaatccatctgcactgtcaaaatcaaaacactgtttcatcctatttagctatagcctgaaggcactttctaaattttgtgtcatgttagtgtttaacacattcagagcttggtaccctcagtaacgaagagtttcagagtctgaccttgccctggacaatttgtttttttcctacaaacatcatagaaagagcaagaaccttggtattagcaactttctaagcttcagtttacctgtatagaaaataaagaacatcactttactccataatattggaatattaatgaggatcaagctagataatgcatataaaagtacacaggacagcatccaaattactactcttgttcatttctactcttcccttaaatgctttagatggtaacaaatccacttaatattctggaatgtgtactatacatgcttaataatatattatctaattttataaatctctatagctttgactcatcttgattaaaaacatatttttctaattttatttagaatattaacatttttaaaaaatatgaattaacaacctttgtcattttgttatatgtgaattttaaagatcataatcttcataactcatcagaaatatttaaattaatatttatttttatctgattctttctatgactttaataattttttatctaattctttacatgcaataattagtaatagctaacaagtgtatggtatgtatgcttacaatgtccaaaacaccatgaccatttttaatgattttacatattaaaatttactactcatgacaacaacccaatgagattgacatcattaccaacagcctagttttgcaaatgtgtaaattgtggcacaaatgttttatataacttccccaatataacacagctaatttttcaaacccaaatagttggaccccagaacccaagatttaaacatagtggtttttttttttttttgtttgtttgtttgtttgttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacatagtgttttaagtcctgtggaggagagggaaaagcaaaaagctaacagcacaacaacaaaacaaaaaccacttcagacttcaaggagtttttaatcatgagaatgtacagcctgtgtcctaaccatctttcagccctaaacatattcccacagacaggcagcacattcatacaccctcagacaacacactactccgtcctcacactttagagtagaacgcaagttacaagacaatgtcaattaatgttgttgtaggaaacagtccattggaaggactggaactgtcagctgtatgtcaggctctttccctgtactgtctcattcaatcttcgtcactttagagaaaactgaggcctaagaaagttcattacctttctgaagaccacacagataattatgaaagttttagaattcaaccctcattctgacttcaaagcctacaacaccaccacaccacagtacagaggccttaacccaaacttccagtttgagaagacaatgctttgagtagtgtgaaatgctaatcttctccagacattcacctcagaagccaggagacattaataattaaacaaaaaggagtgtctgtacttcaacaattctggaaaataataaactttaaaacatgaccttatgaaatgatatggtagaagaataaacagaggccattgaagttcatcaaaggatgttttctgaacgtttttagatctgacctgggttttaaaaaaattgtgtaaagtgtctacaaagtaaaggagataaaaggctaaacagcatatatctactacttttttttgagatggagtctcactctgtcgcccaggctagagcacaatggcacgatctcagctcactgcaagctctgcttcccgggttcaggccattctcctgcctcagcctcctgattagctgggattacaggcgcccaccaccatgtccggctaatttttgtatttttagtagagaaggggtttcaccatattggccaggctggtctcgaactcctcaccttatgatttgcctgccttggcctcccaaagtgctgggattacaggtgtgagccaccgtgcccggccagcatatatctactttaaaaaataaataaatcttcagaatgtacacattgtttgtaaactgaatctttgtaatcattaccaaaaattaagctgtctactcttcatatttgctctcttcctccacctcttagctaatataatatttattcttagctattatctcctttattttctaagtatatgaaaaggaaagacaggcctttagaaaatatattcttagtgttcccctaatcacaaactttcttgaaaattaaaagacaaagaaaggagctgaagtatgtttaaggtgtacagcctattttttttctagacttacactgatttttaaaatatttttgtgaattttgaaactgggggaaaaagagtgttacaatgttcgttacaataattgtaacttaaatttggacaattttaagtaggctttgtgaggttaaacagtattaacagatcttaaactcaaaagtttgataactataactacatttcttacaatacattcagtaccaaatgcaagtagctaataattaacttgaacagtcccatcacaatgattaaaaatatgtcaactgacacaaaggaactgttatacctaatgagttcataaaagtctgagattacctacaggaagaaatatgaaatatcaatcctgaatattttaatgttttagtatttgtaagtcagggtgagggtcaaacgtaaaatttttcaaggatgtataagggaatttgtatttggtgaaatagtaatgaatttcagcactaacatataattggtttgaaataggaagttttgatgccacatctggagaacagaataatataatccacaacaggtagtaattacttactgaaggtaattgtaatgcagcttgagttgtaaacattaatgaaaaaaaagatttctaagcaaataaaatctcacgcatcaaaaagacaaaaagtttgtgataaatggttcatttaggcatgcagtgctgtgtgggcaaaattggattgcaatcataggcatttcaaaaaatgaaaacattaggagaaaagaaaattggacagaaatggcagggaaattacagcctttgatccattccgaagaacttttttttgaagcatcattatgagtgggcagcaaactccttccaatcttctgttaaaacttttatgaaaccctggagaccacaaggtaaaaataatcaatttaggacagaccatggaaatatttttcagtgataatctttttttcccgtaaaattgtacaaaactaattccaatgttaaattgctatctggtcttgaaattgacacttttaatttcaggagaaggtctttcctgaatcatttttgacctcttcaactaacgatcagttattagacacatgcttcacggtaaattatatggagatggcacaatttcacaaaaataaagagtattgtaatgctcttactgatatatcattgagaatatcatgggtccaagaatcatacctttaataatcacaccttgaaacataaatgggcactatgctatggaaacagatctttggctattgtaaataatgcactatagtttccaaagggctgaggtgctatatctgtatgtgcaaaaacttaaattaatccctacagctttgaaacaatgatgatgatagacttgttcaattgctattaaaatgtctgtaatttgattgtaaaccattaatattcgagattaccgattggctttccttattaaacactggtaattagtcatttcatgaggatttttgacctttattgttaaatctaggtttttaaattagcgtctcaatatcgtttaaattagttcttgtatataagattattttaagttattatctttggaagaatgttacatcctaaagttaaaaaggagaattactggcaaataagtataagaacattactttatatttgagtaaatagtagctttattcttctgagagggctgtttaaatcagatttacaatgcctgaagcaaaatctagatttatttttttactttatttgacttgactacattctgttttcattaacattttctatttgaccttttgaattatagaccccttctaacctaaaaagatgttattatgaaagaagaatgtgtttgttttgtatctttgaaagtgaatactggttttattgctatttgaaaatattacttaaaatatagggaggtgaaatttcaaatgaaatgactgaaatatgttttttctgtcaagatttttaactcaactatgggtaaagtagtttctaggatttattaatctgcaagttctataactaaaatgaatcatttgcatgacacttttaaggttgtaatggtaatttttctaaattatccctaacaatgtttagcatcataaaatagtttcctaaatagcctttttcttaggtcattgtaacatataacatatttttttaatctgaaagagatgaaaatccttgcctttgcccttgaagaatccatactttatggaaaagattgataagtgataaatttaaaaatagggtgatgagtgctgtaagggaggtgcttaaacatcactgcctcagggactgctagactagattatatcccctgtgatagactgccttagcacactgaacttcccctgttaaaatgatccacattctacatggcaattacgtttttcaaatctgtattcataatagaccataaactctacactggccccacaccttctctcttgctcactatagtatcttcaatgccaagcatcatttctgacacatagtagctgacttatacatactcactgaagaaataagtaaatgagggtgaatgaatgaaaggtctgaaacggtgttttgttatgtaacccagattagactagttttgaattttttatttttaatttataaatagtaattgtatatgttgatggggtccagtgagatgttttgatatttgtatacaacatggtataattaaatcaagtaattaacatatccatcagttcatattctagtgtttcatggtgagagcatttaaaatctactcttttaacaattttgaaccgtacattattactaactgtagtctccaacagatgaataaagaaaatgtggtatatacacacaatagaatactattcagccattaaaagggaaattctgtcatttgcaacaacatgaatgaacctagaagactttattctaagtaaaataagcaggcaccaagagataaatattgcatggtctcacttatatatggactcttaaaagtcaaactcacagaagtagagtaaaatggtgtttaccaaaaggtgtattggagaagaggggtagtgggactttggtcaaaggatacaaattacaattagacaggaggaataagtttttgagatgtagtggacagcatggagacagaccatagttaataataatgtatatttcagatcagaccatttttaaatgggcactgaactgtcataaaagaaattccaagtgaacatgatgaggagggcacaaaaacaagatgatagtcatgccaaggtgcagaggtgagaaagagcacagagcaagttaaatcaactgcaaggaatctggaatgattgggcattcatagaatagtattgcagaataattgcttaagatattatattgtattttgttgttgccctcctccatttcgagcaagtaacccattacttgtctaaaggcattttcttttcagagaagaaaggagaaacagccaggagtcattagcagttcttgttttttatgagagtttaaatgtattgaagagatacgttaagtgcctagaaaaaaggaaaataaaggggagcatgattttgaggacaaggagggaataagaagagcgactcctcgagataagaaaggggagctagtttgtcaggaccgtaagacaatggtaatgactgtgccacagacccagaggctgctggcttcacctcagagtcctgtgtcccaatgacagaatgaagaaaagggaagatggggtgataaacctattgaagaaaccacactggctgagaaattgggcatgtcagaggtgtcaagggttggcagaggaattatgaccagaggaacttccattcctgcttggcattcagtaaattcctgggacttcggaacaacctggagattataaagttccatatttactaagattgacattcccacctgccaggaagaatgggaacttggagtcagttttaagatgatttatgaaaataaataaatgcagtagttttgtcatttgaatttgcaacttgaaattcatatgtgctacctaacctagaaagacaggttagaggcacatcactgaagggatcatatatcaagctaatacatttgaaattgattctgaagagagtcggccattaatggtttttaatcaggagaataataaaaaacatcaccctaatgatgacaaaaggttggactggacagcaacaagactagtgggaagttgaccaggtacagccaatattgcagtcgagttgatgagctggaccaaagattatgagtatagaaaggagctgatggtttgagagctatttaggctgtagaatcaccttgattagatgtctgtggtgaagtaaaaacaaacctcagagcactcccaagttcctggttcacagcagggcagtacagaggagatgtaatattatcatttgtcccaaaaagtacgagggatgtgctgacgagagaagggagaaaatgatatggagttcaggagagagaaattgggggcttatcagcaaagttgaatgtcaaaccacataaaagagacatggcccagaaatgtatagatagtaaaagggctgagaaaagaactgtgtgtattcaggaagtttcaaagaagactgaggaagagtgagcacaaagctagaagaacagtagagaatgatgtcacaggagaagtgagaggagaaattttctggaaggagagattagtcaactgtgacagatactactaaagggagagaaattaaaataaacttaggaaatttgaacgataagactttagatgacctgcgagaaaagaatgtgcagatgtagggggataatgtggaaaccagacttcaatgggtcaaaaaggcagttctaagtgatgatgtagatatgttacagaatttgatcaggaggagagagggagatgcaggactctgaatggtttttaggacataggaagttggcagtggaaaggagtgagatacaaacagacatacctcttctattggcatggaagggtggttggaatccttatgaagtgagaatcgttttgcactttgtatagggcagttagaagtggaagaaaagtgccagctatcacggagattgttgtttgtttgcctctattttctgaagggaaatgtatgagagaggaattatctgttatatgaggaatattatgtgaggaattatatattcctcatataatctcatattacctaaatatttatccattatatctattctatgagaaattgtgtggaggtatctctataaaatgagaaaggaattgtatgctgagagtgaggacacagcttggaatattaatggtttagaagtaagcatagtaagtatttgaagaatagaatggaaagggaagcttgactagggacaggtgaaaggggtattatagaaatttttgctaggagcaaagctttcattttgggtccaaactatggaaactaattaactgatgatgcttcataaaaagcaagaaaaatgtaaaaaaaaaaaaaaaagtaagagaaattaagacctaggagaaaccttaggttttacccattattattatccttctcatttatataagaaaattattacccttctcattatatataagaatattcaagaccctttaatttaaggtaagctacattaatcttgacaataagctataagtgcctatttcccaagttgtcatcgatgaccaaaaaacaaccccaaaaaaggcattaaactcaaaaggaaccctcactgggagaggttgagggaaacggggctgagttctagcccaagacataggtatttccaaaattatttaatttcacaggtttctcagcttttgtcatctggaaaataaaaaccttaaatttaatagtacttatgatctctataatcaattggatgccaatcagatcaaattcacctggtttcaaatttaacaataaacctatgcccctagctagctatctggaaaattgtaggtcggaagaagagccattgaacatgttagaaaactctgttctgtttcactacctaaaagaaaaatcgagttacaattttgatggtttattggctaccctaatgcaatctatgttataggatggctgtggttaaaaactcagttgatgaacaatacagacacattaattatgactggaaaaaataaacataagcacagaggatataatgcattttgtatgtaaattatcctgccttatgataatcaaactatgcagcaatggtaacccttcttactataatggttattttcaaatgcttttacttcgttaagtggacttcatagatgataatctctgacataaaaatcattcaattgtcatcactatttcttcagaaaatttgaaagttcataggtctttacttaaaatgagtcattacgatggtgctatttttctttctactgtttgtctgcccatgtattcaattagacatttgaggttcagaaataaaatcaagttgaatgtttatcagttggatataaaacatgtacccacatggaaatcactgttgctaataatgttgtctctattttacagtcagagaaattgacattcagaaagattaaagaactatgaaaaccaagcagattttagttgacaaatctgagaatcaagcccctgactttataaacttaaagtccattgatgtccactctatagcttagacttcagatacattctgccaatcattagtgtgaagttaggctgagacctactagctcatgttactactaacctgattcttggttaaatttctgtggtgtatatcagagttaaatattcacaggtatgttaaagagccactgaagagctcttcagaagctcttcaatttcagaagctctaaaatttcagaaatcacaagaaaactattattttagtttagttaaatgttaccttaaaatattggttaacatgtattgagtacttaccccattgttatgagaacattatgggtaggaatttatttaatcctgaaacaactctatgacataggtacgtttttttctccttttttttttttaataaatgagggatctgagggacagagaagttaaataccttgacaaggtcatacagcttgtaagttttggagctagattaggaagcagtctgaccccagaatctatgctttacaccactgtcaggtagagataatggggggaaaaagagcaaaacattgaattcaatgattacttacattttgatgagaagcaggaaaatccctgtagagtgaagcatttagaaaataatggtgttggggcatgtgataactaaatgaggaccacatagtaacaaacggagagaacttcaaacacttcgtgaaagggtcactgaggacatattgcttcatagtttcacctggaatgtgtgaagataagtttagagggaaaagcatatggacttgaggccttggaatcaacatgacaactaaggttttgggggaaaaaaatgctgtttcactccactgaaggcatattgcaccacttagaggtgcttattactgaatacatctaccaagaaacatatgaaagagccaggaaattatctctactcccacatgaaacagccatatggccatggcaccacaatttcactcttctaagctcttaagctcaggatctgatgagcaagaaaacataaaaataaatatttagctaaatttatgagccaagtgtagaaattaaaagtatatcaacatcaagttaatggaaacaatgaaaatatattataaaaacagaaaaatacatcttgctaaaggacaagctaaagaactatgttcattgccatgaaagaccaaacaaatgtaagagagataaaaataaagcaagagattataaagagatataagaaaaatcattttattgaagagctaatcaaatattagaatgggctgccaagagggattatagaggctctgtctctgaatatcagaagggatgctgttcatcctcattagttaaaaattcagatgttggaaggcagggactccctaggatcccagtgttaatatagaaatccatactcagctgtaatcattgtctctgaggcattaacaatccaaacatgcctgagtttctctgttgacattatattcttttaaaatagggtaaaactttcttctcatctaggcatcaaatcaactgtaaagattttgtttaaaatctgtgagtaatttagtagtgtcctagattcacagtgatgtccctaaataacacaaaatatgttttaatgtactttatatatcagaaaagacagcctattacagttatgtttccatcaatgcattctttatcacaattacaaatatctagtttcacttttaaaatgtgcattaaaatggaacaaacttctctgacagacttttagtgatgactccatttcagaagggaaaaagccaaagggaattcttctgttgccttccggcctctcttgtgtatttcctcttcacagagtagaacttgaatactttcaaccaaccaacgtgagatgggaatttgttaacaattacataacctcagtggataacttgattgcctaatcagccattgttacatgtgtggagcaaattactaaatcatgtactcagtctctaaccaatcttcctagaggaaaaacatattaaaatctacttaggtctaacatctggtcattgtatatctatcaagtaccgtatgccaagtgtgttacatatacgacttcatactaagaacaaccttggacaagatgagtattattattattcattttacaagtgacaaaaccggaactcaatagggtttgacagaatgaactgacagaattgtgaagctaatccagagaggtttatctgacttagaaagcccaccatcagtgagcgaggccgtatgacctcattttaatcagggaagctcactggtgttccttgtatacacagatggcttgtacgggtaaattatctgtgtatgtgtgtaaccctttaaggttgtttgccttcagagactattcttacccccaaactgcctgaaaactgtaggctgttcagttaattgttgtggttgttgctgctgttgttgttgttgttgttgttgttgttcttgttgttgttgttgttatggagtctcgctctgtctcccaggctggagtgcagtggcatgatctcagctcactgcaacctctgcctcccaagttcaagcaattctcctgcctcagcttcccaagtagctgggactacaggcacatgccaccatgcctggctaattttttgtatttttagtagagacagggtttcaccgtgttagccaggatggtcttgatctcctgaccttgtgatctgcccgcctcagcctcccaaagtactgggattacaggcgtgagccaccgcacctggcctgttcagttaatttttaattcaattatttaatcaaaaatcatcaaaatttaacacaacttaaaggttctgattagatgtactcagtgacttcactcagagaagggtcctacttggcgagcatgactgtcacttgtcacaagcaaacacttccaggtcacctttcccctcaccaatacaggcaggaagtgtccagagcttcacctctagaattggcttaggcaagagagagacagactgatggggaggaaaagaggaggagggaaaggcggtgtcagggtgaggtgcagagaagaggaacttgtagagttcaagtagactgcctagactgatcctgggtctgggtcacccatccctgctcctgccacctctgcacctgctgcagttagtaccctctcctttccactgtcaggcaagcttgtcacgcaagacaaagtgaactgcttgccgtttattgcaagggaactttttagcagtgacctttaaaagcaccacatcctataggcatgactatcattcaccctttgcattgatgcaggtggctgaagtatgacaccaggttatgcaccttgggcaattaaaaattgcaaaagacagactgacactaggtgaaaaaaccaaaatagctacttcagaatcaacctccatcccgtcgctatttagagacttcttttttgaaatagaaagtgacaaaaagtcccccactttaaatgaaacctaaacatgtttaactctgtctgtacaaagaacctgacaaaaataatgtactcatttgaccttatatgataaatatgtgcttccattccatgttggtttgatggtactgttcatctaataaatacttatggagtattggacaaatgtcaggaactagattgggtattaagaatataaggaaaaaacaggatattgtcactgccagtgaaagactggctttataattggaaaggcaaacaattataggactttgtactaagagctttaaccttactatgccctggaattcttctaagtgatttaagtatattaacccaataattctcccaacaacttttcacatggttgctattattatcccccattttactaatagagaaaataaagcacagagaggttaagtgacttactaatttatttattaatacctctgaaactaggactcaaactcaggcagctgactccagagtccacatttacatccaccatggtataaaggagcagtccccaattttggcattggggaccagtttcatggaagacgatttttccatggaccagtggggaatgaacggggtggtttcggggtgattcaagcacactacatttatcatgcactttatttctattattattacattgtaacatatatacatatgttacaagtaactacatatgtacaagtaactacataactcactatcatgtagaatcagtgcgatccctgagcttattgtcctacaactagatggtcccatctgggggtgatgggagacaatgacagatcatcaggcattaaattctcatagggagcacacaacccagattcctcacatgcacagttcacaatagggttggccctcctggaagtatctaatgtcactgctgatctgacaagaggtggagctcaggtagtaatgtgagcgatgaagaggggctgtaaatacaaatgaagctttgctgcttacctgccactcacctcctgctgtgtggccttggtcctgagaggccacacaccagtactggtccatggcctgtagtttggggacccctgctataatcacctaaaataagagagtgaccctttcaggggaaccaggaaatatttctgagtaataataatagatgataaaaggccaggcatggtggctcatacctgtaatcccagcactttaggaggctgagtcaggtggatcgcttgagctcaggagttcaagaccagcctgggcaacatggtgaaaacccatctctacaaaaaatacaaaaatatctggctgtagtggagcacacctgtagtcccagctattttggaggctgatgcaggagaatcacttgagcccaggaagtcgaggctgcagtgagctgtgatcacgccactgaactccagcctgggtgacaagtgaaaccttgtctcaaaaaaaaaaaattgataaaagataggttgaatttatagtcaaagaaaagtatttcaaggcaaaacatgtagcatgtcctgaggcaacacagtttgttcaaggaaccttgatgaagtctgtaaaaaatggcatttaaagtatgtcagagaaatgaagaaaggcggggaaattacattaggaccagattggaaaaggcctcttatgctttgctgaagagtttgcactttatcctgcaaacaatagagagacagcaaaggtttccaaagcaaggaaagagaggtgaacagtaaggtggagcataggctggtggattctctccaaattatagaaaacgcaaaatgtagaaattaggtaggtttagagatgatgcatacatatcatattcagcattttgttttctaagacttatcctgaggactgacaaagagagtactggggagtgaagacagaaagaggaaacagaagacagaatggctgggaaggttgagtagtccccccttatctgtggattgctttccaaggtttcagttacctgtggtcaaccacagattgaaaatattacagtattttgagacagagagagacagagagatagaccatgttcatgtaacttttattacagtatattattataattgttctatcttattatggtaattgttgttactctctcactgtgcctaatttatacgttaaactttatcataggtatgtatatgtaggaaaaaaatagtatatctagggttcagtactatctaaggcttcaggcctccactggggaaattggaacgtaacccccatggagaaagggagattactgtacacagaaaaccattagcatgtttcatcaaatctaaggcaccatcgactgtagagcacattaattttaagaaatcctaagaaagaaaaatacttccagttaaacaccgtctgttattagatacattccaatttctcggagttaaaatgtagcagggaatgcatctcagaatctatgaaatattgtataataacttaggcaaaagtagaattgatcactggttccagccactgagtaaatgagaacataaattaattgcaaaaatacttattgagtgttgcaaaaatacttactgagtattacatggaaatataatggagatgttgagaataaatggcggttgtgattgaagggaagaaatgatcatgttttaagatatttagaaaatagaactattaggctttgttgtgctactgaatgcagatggtgagggagagacatttaagtgatgtctaagatggctgatgaggtaatgtctttaagaccaaaagggcaaaaagaagatcatgttgggctatgacatcaagtttggctttggacatgctgaggttgaaatataagtaggacttacatgtgggatccccagcaggcagttggaatattggccctagctcagaaaagaagatagaactagaggtattgattttggatgcatctaagtgatgtggtcaatgaaaccatggaagtggatgaagccacttacaaaataaaaagtctggctaagaagttatgttcacgtgaactaagggaaagcattagaaataaatgaaaggagacagattcaagacatactgtgaagatgtcatttctaggtcttgataactgatgatctttaggtattgagagaaaaatggtcccaataagagatacagagaagttaagaaatatagcagtttagttggagaagagtaaaaatttcagttctagatatgctatgttgaaagtgctgccaagacatcaagtgaaaatgacccaagaatagttgaaaatgtggtctatatttctggagatggggcaaatctagagatgtaaatttgcaaatcatctattcatagtgagaattggtgctgtggcataaaagattgccaagagaaaaaatataaagaaatagtaaaggtttcaagcatagaaccttagagtaagctatacttagcagaagtcatgtggtgcataatgaccttttgatcaatgacagactgcatttatgatagtggtccataaaattataagactgggccaggcgcagtggctcacacctggagtctcaacattttgggagttccaggcaggtggatcgtttgagcccaagagctcgagaccatcctaggcaatatagcaaaaacccatatctattttttaaaaaacacaaaaaatattagccaggtatggtgggtgcacctgtagtcccaggtactcaggatgctaaggcagaaggatcacttgagcccaggaggcaaaggttgtagtgagccaagattgtgccactgcaatccagcctgggcaacagagtgagatcctgtctcaaaaaagtgggggattataagactgtatttttactttaccttttctatgtttaaatacatttaaagtacaaatacttaccattgtgttacagttttgcctagagtattcagtacagtcacatgctaggtttgtagcctaggagaaaaaggctacaccatataacctagcagtgtaaaaggccataccatctagatttgtgtaagtacactctataatgtttgctcagtgacaaaatcacctaacaatgcatttttcagactgtattccatcgttgttaagtgatgcatgccttatgccaaataatactatttaataaaatactaaaactactactatataatggatgctgacatgtgtaagacattttacatctgatttaaaatacttataactgcataacagataatcaactgtctattttacaactgaagaacatctgaggtttagtaacattcccagggtcacagagctagtaagtgactgagtagggatttgagcctgaggctctttcttggaagccctcatgtttcatactgcacccagcctacacaaagcctatcctcctttaatttttatacattgctcttacttctttatagagtataatatcaaacccaaatgcttacagaagacacaagtaagtaacatatgagagaccctagctgggtctttccctaaggatatctggaattgtatgcttctgacactggcatgcttcttttaactatgaagacatattgttcgattccacacacaaagaaaaggttttcttgaaatatgtgatcttcttactctattctcatttttctgtattttgactgaaacatggaaacaagtatttctctaccataagaaagcaacaatgtaagatgatgttaagagcaccagatacttgaattcagttttgtgtacaataaggaatggtgagaactattgcaaaatggagagtaaaactccatctaaaaaggtggcaaacccccaaagctctgtgttgctcaaatttcagattttgtaagggaaggtggaaacttaaaatattaggtgaagcctcccattgataatgtgactcattattttaaatactatgcaagctaaagaaaaaatccctgtgggcaaaatgcacttcaaaagatgacaccacactgccttatattctcgaaatttaatatttccaattccttcaacggtttatgttgcttgatttacaaaactttatactctcctttgaacagagaccattctattcactgttcctcttaaaatatgacatctagagctaaacaaaatcatgcagcttctctctggccttctcagaattcagtgaaactgctactatttttgtgctgagcactatatgctaatgtaacctagtattgcattagctttttctttttttagcatttacaacattttactggtgcctaatgagttttagtccataaaaacccttagttattttttcacattaactgccgaggtaaatcttaactcatccaatacttacaaagaagcagcaattttgttttgaaattaaatgcaagactttacattttctctattaattttttatggtgtagatagagttgaataaactttattttatttatgtgggcccattattctagatttcaggcagagttttcaatcatctgtctctttccacagcttcaagtataaggatctacaattcattatatgtactgtgcacagatacaatgaatgttcctgagaaatctcatccaccaaggtgcacacaattttaaaaggttcaaatcagaattgatccataattagaatattacattagcctttaagaactatccccacagcaccctgcaaataaccacagcattatctgtatttgcctgccttatgtatatgcacccagagacgtcacactgagtgggacacctactgcacacagggtgtcatttcagtaatttcatctatttggctgcttctgctatcatccagaactccagccttaagtcctcttcagtgttcatggtaattaggaaattcctttctggcaactgtaaacatatgtttgatcatagagaacattctcttcctgttcctctgtttaaaagaactaacccataaacatcaatttatctggctcatgggggccttgcactccacatggcttcctttcagggaactgtgtaggctacagtatcaataatgaaagtagctcatgcatcctaaggggtcactatgtgccaagcactatgctgtgcactttatgtaagtcgtctcctatattccttgataacacggtctaaagaaggacttcacagccaaggaactaagatgtaaagaacttgagtagcctcacaaggtcagtaattgtcagggtcaattttccaaaaagcctgtctacactgaaaactctgctctttctattgccgttctcgttcctctgcaggtcagctgacccttcctttggtgtagtcaaataaattaccagttggacagcagcacccgccatcaccaatgaataccctgtgttctgtgttctaaagagctaatttggcaggcatgtatcaaaccctaaagcagagttccctcatagtccactactaagtctatactttttagcctttttaaatcaaggggagtatttttcaaacatttttctcattgtttgttaagtaggtgctttagagctcaacatacaccttcatttcttcaatcaggctgttggtaggatattgaatgagaaagaattctgggctgtgccattgttgtatgactttctatcttttttccaccatgacacagataattgacatacatatctgtatcatgttcacaatacccattgcactcctaattctgaagcttcttttccattaaaaaaataagatcacaagcataaaataaagtaagcatggtattatcgtagggacaacatcaaatcagttttactttttaaaggaagtaattaagaaatgttggtgctttaccatcggggataaattactggtgtcccaagacactactgcggaggaccacttagcttgaagcattcacagagaatttagtgggcatcttttctttaaaacttccattgttccaccaactattaattcatctaaactagattgccctctcattcttcatttttccatttgcttttacaaaaaatgttgcaagaagttgtgcggatgcctcactaaattaaaaagtatgtgagtacgaataaatatttattactttttcatccacatcaggctttgctgtcatgagatgagaataaagagaaagacctatgtccctttacctgccttagagcatgcccagaaaaaaacaatatagagagaaatccttagtaattgcttctctcagtggctgcaatctctgttgagcctcttgttttgtctttggaaatttaatgtttaattatttttaatatgtcaaaatattagtttctcaagagagaggctgtgcagtaacaggcatttggagatcattggttgctttgcaaagtggatagattagatttaaatttattttttaatgaatcaagaaatatccagcttttacatttaataaataagaaatggcaaatgaacaaagggaaatggtgatgtagacagaacccggcggatacctaaatttctgttgagggagatttatccctgtagtttaagactttgatataaagtaaaaggcaaatatctagagaggtaaccttttggctatcattggtcttttgtgaaggagttggacacaaattttgataagaccgtagaaagagaggaatcttatactggaatccctgtggaagtgagaggaaagcaataatagggttgttggttttttttcattatcttcaaaatttttgctgactagtgtcccattattgtttagaaacgtaatttttcttagacaagtatcagctaagctcatttaagagaagcttgctctgggtgacatttttgctgcatttatctttagaaacaatttttaactctgtttttctatgtcatttatggctgaaaattataattgaacagttagaaaaaatctctgttgattaattacatagcttatgtggtatttaaatagccaaatttattacatatttgtagcttgagagtattcttcacaaataaaagcttttttctgggctaggcaccatcccaaatcagatttagaacagtgttgcaaaggttttgttcactaaatgtattccaaaattataatgttctttaaggacggtatggttgctgattttatttgatggtttactgtgaagactcttcgattaaaatgtgtttcactgaaaatttattcttcaagcagacgccttagaaatttatcttgattgcaatggaagatggcaatttagaacaattatttatccttataataactcaagagcttttatcatcaagcacttgctatttgaagacctgactcccattgctaaataagtgaatattaatctgattgtttttagtccttataacataacttaatcttttgctaccctattgcatgaactgagtaaatattaaatgggagctgaattgtccaccttctccactgtttataaagatacatattaggtatgttacaatagaatgagtgctaaagcacattttcttttgaagaataatattctaggaaacttaaatttcattacttgctaaagatcacccatggaattcaattttttcttactttttctcattttgactacctgccttattgcacaaaaacatattactgtttacaagaaatcattatcctttattttcaaatggaaaaggcaaaccaaagacaataatcaaaattggatattatgtcagattcgtcaacttggaattctgagatttgattattcaaaacgtggaacagtacctataaaatttgtttttacctttgtaagccatctggaactcaagagccattagacctgcttttgcaaatcactgttttatacaaataaaacaatttttcagaaggcaatttagaattttgaaacacataccaattgtcagagtcagtctgtcaggttctgctcatcattaattttttaaaacatcaattatggtaaactctatcataattgcaatagaatacaattcaataatgaatataaacatttaatgcaatgcatagaatagaattcataagctgacaataatattggtctcttcatattctattcagggaagcccaagctctaaactgatatatacactgcagagactaggagacaaaggtaatattctgaagaagaatattttagggagaaaaaatgagaaaatgaatagccatctaggtcatttttagaccaaaattttatttaattttatttttatggtgtgatgcccaagtaatggttcaatagcatcacaaatagtcctaaaccctgggggataacatgctctccttctatttttagaaatgcaattgacatcaaaataggtataaaaatacctacctccctgggtcttgtgaggatcaaatgagatgatgtgtatgaaagactccagatgctatacaaatgttggttggattatacgggaagctttagagatgcctttgcacagtggaaggatccttggacttggtagttgaaaaaactcagttttgctagccatgttattttgagtaaatcatttaaatttaattcctctgtgtcatactttttacatgtaaaacgaggatataatttctaccacagtgctgttttgtaaatcacctcaaacaaaatgagatctataatgaaagtgctttataaacaatgaagcataatgctaatagtgtaacagattgttaatagagtacttattaaatatggcataagtaaaggaatgacatttacaacaaaataaatacaattgtttaagtgaaaaatctatgtagaaaggattgagaattgaactgagttcttctgttgaatacttaccatattgcgatctcagattccctatgaaaaggacaaagtcctgcccttgaaaatgttaggatttcaagaagacgtagggcatactttgggtatctacaagatataaaggaaataaacccaaaactaaaatttgcattataagccacttttatggttaaatctcattcctagcctgaataatactttttattgagaatcagttgtatagaaagcattgtcttatgtcctgatttctgggagaatgtgtgtgtttgtgtgtgcttgtgtgtagtggaaatggatttgaaaggtatactacaaaagaatgtaaatgtttacttctattccctcaagcttatatacttgagaaacataaaatttgataatacgaagaatcacagaataaatatcaaatgacttaccctagaatgtattactgaaacttattaagcctactatgtggaaaatggtctttaattatttttaccaaagaaacaagaaggtgaaatgtcagggactgaatatttgtggctatactttcccccaaaatctaataaattgcaattaaaacattaagaattaagaataattatgcttatagtgtaatacagcggtccccaacatttttggcaccaggggcttgtttcatggaagacaatttttccctgggggatgcagcgggctgggaatggggtggtttgggaatgaagctgttgcatgtcaggtcatcaggcattagattctcataaggagcgtaacaacctagatccctcacatgtgcagtctacaatagggttcactcaccacagggttcacaatcctatgagaatctaatgcctctgctgatctgacaagaggcagaactcaggcagtaatgctcattctccatctgccactcacctcctgctgtgcggtccagttcctaacaggccatggactggtacccatccctggcaggagtttggggacctctggtctaatacatatgtatgtacttaacttctttgtcttctagttattcctttagaaatgtaaagagacagggagcttaagagagacaactagatctggttagagccttatttgagtgaaagttgtcagattacctccctaagcctcagtttcctcatctgtgagggaagtcctaactcaatgggttgttgtaaagattcagcattataatcaacacaagtgaaccaaaaccgtgtcaggcaaatgcttgggtctcaaaaaagtgagagtttattaagtgtctcagtaatctttattcttaataaacccaccaagtgatagtttgatctggcaaagatgggacggcacacccagcactaaacttaactattctctttcacacagaatattgctagtttttactggtgacattttaattttaaatttacattttaaatttttctgatatagtcactgggaagacaaaggacagagtttgttacagtgagaaaataacacaattttctgaggtctttttcatgaaatgttttaaactggagctttgtctttggaaattcttgctcttggacatagttatcatgttgtttgaggttagcaaggatgtgattttgaggtcacaaccagacattgtttactgaatgtgtataagataaaatgagatgagagggtaattatctataggtttgccttaattagcagataacattttctaatttaacgaggcctcagtgataataatcaacagtcaagtttctaaatagctttcccatatctttgtggccattaattccctcatctttaagttttcgacattcttttcaaggcatctggaacacttgagcagcaattttccctgtttgcagcaatcaccagttgaatgcttttgtgaatgagaaattaaatgggttttcaacaatgtagatagttttaagtgagagtcccattgaaattatggatgaatcaagggacagcaggaagtctgtgattttctccatttgcaaatgtttttctaaaaaatgccatcctaagaacactttacagatattaacccattaattccagtgcctcatttttttgaagtaattcttattctttctttatggctccaaaaattcacagaagaatagttagcaaagcagcagtcaactatccacaccaaattttataaactgcattaaatgtactactattcactggaaaactcttataaaatatatacatgcatgacttacaaaagtataaattataaatggtatgaaaaatgcttcaaaatctagaaagaatgtaagaacttaggcagggaaaaaagaaatatatacaatcttatttagcgatctgcttattatcacatgaatttgtgagcagaatgatctagagaaggcctatgacatgtagtgaggcaaacaacattttaaaaactcctctggaagaagatggaatcaatgaagtttcaaattcacctgcaaaagttacaagcagatttgaactatgtgaccaaatctagctgcacctagatttgaaaggacaccatttggatttgccatatgcgcttctgagaaggagagaggtatgagtagagctttttttttaacttttaaatttaggggtacaagtgcatgtttgtttcataggtaaacttgtgttatgtgggtttgttgtacagattatttcatcattcaggtattaatcctggtacccattagttatttttcctgatcctctccctccttcacctacctggctccaaaaggccccaggatgtgttgttcccctctatgtgtccatgtgtcctcatcgtttagcccctatttagaagtgagaacatgtggtattcggttttctgttcctgtattagtttgctaaggttaatggccttcagctccatccatgtctctgcaaaggacatgatctcattcttttttatggctacatagtattccgtggtgtatatgtaccacattttctttagccagtctatcattgatgggcatttaggttgattccatatctttgctattgtgaatagggctgcaatgaacatacacatgcatgagtctttataatagaatgatttctattcctttgagtatatacccagtaatgggattgctgggtcaaatggtagttctgtctttaggtctttgaggcattgccacactgtcttctacaatggctgaactaatttacactcccaccaacaatgtaaaatcattcctttttctccacaaccttgccagcatccattattttttgactttttgatactagccattctaactggtgttaggtagtatctcactgtggttttgatttgcatttctctaatgatcagtaatgtcgaactttttttatatgatttttggccacatgtatgtcttcttttgaaaagggtctgttcttgacctttgcccacttttttatgggattgtttgtggggttttttgtacatttgtttaagttccttatggatgctggatattagacctttgttagatgcatagtttgcaaaaacttcctcccattctgtagattgtctgtttactctgttgatagtttcttttgctgtgcagaagctctttagtttaattaggtcctatttgtcaatttttacatttgttgcaattgcttttggtatcttcatcatgaaatctttgcccatacctatgtcctgaatggtattgcctaggttgtcttccagagtttttatagtttgaggttttacacttaagactttaatctattttatgttgattttatatatggcaggggtccagcttcaatctttttcatatgcctagccaattatcccagcaccattgattgaatagggagtcctttccccattgcttgtttttgtcaggtttgttgaagatcagagagttgtaggtgtgcagttttatttccggattctctattctgttccattggtctatgtgtctcttttggtaccaataccatgctgtttggattactgtagccctacaatatagtttgaagttgggtagtgtgacgcctccagctttgttcttttgcttagggttgcattggctatttggggtctttatttggttccacatgaattttaaaatagttttctctagttctgtaaagaatgtcaagagtagtttaataggaatagcattgaatctacgaattactttggatagtatagccattttcatgatattgattcttcctctccatgagcatggaatgtttttccatttgtttgtgtcatctctgatttctttgagcagtggtttgcagttctccttgtagagatctttcacctccctagttagctgtattcctaggtattttattctttatgtggcaagagtagaaatatttttaaggaagatgattcttgctcctactaaataactatagaagaggaagaatcatttggctttcacatgacttgtgtattataaataaaaaagttctttcaaattaattccatttactatgttttatatattccttccataattcacttattctattcagtaaaggcttagtctgccaaaaccactgcatgattttccaaaggaggtacacagtaaaaaaaaaatgattagaaccataagttctggagttggaccacatgggtttagatcttggctatactccttgctagctgtgtaacatggatgaactagttaatctctccaaacctcagtctcctcagctctcctattattaataaaatcggtttaataataatgtattcctccttattttaatgagaggattaaatgatagcatgttgagaaagcacttacacagtatctggcatattataaatgtccaataagtactagttattgttagaatttctggatttaaagagatcacttattttttaaaggtatcttgattgttactactatatcatgcaaatctttatctcttttaattatttatttaatgacagaaaaatactgtaaaaactgaaaaattcaaaattaattttccaagtgcctaagtaatttctaaatagagatataaacacatttaagttcacaataataattgcatttcattggagttttacaactactgcttggttctaaatgctttgaactagacagttaaacttctcatattttaaatttttttccaaacataaaatgcatacattgaataacctaactttaggtatactgagacttcattttataatgaacagttacatgaagagtgcctgctcccaaaaaaaggagttataatgcttcaattttaagtggtaagacatttactgggacacagagtaaaattatagtgaaaaatgtgaagatgctatctgaatagtgataagataattttattgtctatttaaagacaggccttggcaattggaaaatattagttaaatcttttttgagctttttgctgttattgttgtttttattatgttactagttttgctttctttcttctatcttataatattttccctaaagaatggggttagttatgtggggcaatctaatatgatggtatttataatgctctaaattaaatttttgagctaagaaaatcagtcacaacacttgagatttgtcaattttctagtgaattatagttatctgtaaacagttttgattatgaaacttctatgaaatctctcattattttgtaacttctttcccttatttattttacagactaagccattttctcttaagcctatgttagcagcatctccccttggaaatactatgatcatttgataatactgggtttcaaactctagatgcctttctcacattggcttcatagttcaattccataagtttgtgtcaagatactactacatgtaattcaggttactagagttcctgctctcaaaaaaaaaaaaaaaaaaaaaaaaaaaaaaaaaaaaagggagtttggcctgtccagaaataaaataatgtggcagaaaaggtatataaaacctcttgagattttagggaactgattaatagcatctctaccttttcacatcagagtcctgaaccaactaagaggtagaacaaagtatcaagctgctacagatcaggatagtagctttttgcattatgggcttaaatgtgtatccccaatttggttccttgaattgagcttacaattcagatcagcaatgctcccctgcaagttccctgtaagctcactatgcatctgatagagcagcatgcagcctcttaggaggtaggcagatggacagtaagaaccctaaatgtcctggactaagcgtgcttaatttcttcccccaaatttgtcagttaggccaagcatcctccccactgccccacctgggcaagatggatgaaggaaaggatcccaaaagatgtaaatgttgctccttttttcccctttagtgcatgcagtggaaattccccatcactcggttggaatatgaagagtaaaaataagtgttcccatcctaaaagagacaacatgaatttcaattcaaagaagaaagattccagatggttggaatgatcaggaaataattcagagagaagatagtatctgagaaaggcttaaaagaggaatacaaattaaacaggcaagatgaaagaaaagggctaccataaggagccttgtaaaacgtccagaagaaataactagaagaatttccaggcttcaaaaaggacccagttaacattggagtgaatttttaatgaatttagtcagtacgatttgagactttctttattaatatttaggaggcaaggataaggcagacatcataaagtgtttacagttagcaagtgccgtaatgtatatttaacttaatgtggcattctatgaaagtagtgtatcattacaatagatgttgtggagttcaggctctgttgctggacaaatgaaaccagtatctgtgtcagtctaggaggagtaaagaagggaaaataatgaacagatttatggggaaaagcagaagacagacgtctataatgaaagagaagttttggaaaatggattaatgcccagagataaaacccacactataattatgaaaatcattagaattttaacaaaaggaattttgagggccaaatagcagagggtcatcactggatgctgaaatcactaaggatgcttctaaaaatgttggcacaatgtggtgtaagctagtggagaaagatggatacccatcacagaagttgttggtgacattgatgaagaattaaatagcataaatacagaaaaaataagtggcttcagaacatgctgttggttaataatctggaagtggtattggctgataaataatatggtgacgtattctcctgtccttatagaaaaaataggctagaaggcatcagggagaaatcgggtttcaattaataaaaagtgtaacgagccttgaaaaagatttgagaatttattacaatgtgcaataaaatgtagctagtcagtaacatatgatttatgagacactagcaaggaaatgggccagagtatatatgtggcctgggaaacaagagagatctaggtaagaaaagggagttgggaactatcaatagcaaggattaagaaaatgggttgagagagaagctccaggaaactgttgacagtacagaaggtgtcataatttaatcacttcagtcctttggaatggtattgccaagtcactttgggatgttaaaaaattatattccttcaacactttataattaggaacaggaattggcatcatcctattggagcttgctgctaacaacgtgggagtttttagagacagatacaaggtcttgccaacacattctaatgtagtcacaatgccatccagtggttactttggttactttacaggtactttccattgctctttaagaatatattttattttatagttaatattcatcaaagtttcagaaagcttgtatggaaagtgttttattatatcttcaaaaatggcatagcagggatttgatttgctatgtacttctaagctaatggagttatatccagcttgttttctatatgtgttatgctctgggaaacatgatttagcctgtcctctatcaaaattaatgcaataaggaaccatgaaataatgggacttacactgtattcaattttagttctaatagaaacacaatggaaaataacatctgcgacataggcctggttgatcagaggaaagtaatggacatttgttgctgtgattttattggtgctatgggttttttccttcacggtatgctcatcagtatagggataatgtaataaatacttttgacttcactcgtatttagtctcagtttgtctgtaaggtcataatgagcaaacttaaatgggaaacattaatttggcagctgacaacataaaataaatctagctgccattagcaaggacccttcttaaaatttttataaaagcacagctttcaagtttattgcacatctctttaaaaatgtatttcaaagtaacttcagagacatctatttggcacactcaaacttttggtgatgaaattcccttttgccactaaaattcattatttgaatctccatggtaaattagctttatgagttagctattgtaattatttttctgtgaagcaaaggcaggagtagagacaatttcatcatcttatcatcatttgtatgtggaatcactaaagagtttacccatgtggaaccatgaaagtccctgatttacccctctatcagtaggcataaacatatctaaaccacccaagaaactgtacattaatattgcttctaagacctgggggttggggggtagcatccccacagtcaacaatgttaaagtgatgaaacattttaaataattttaatgttaaaataattggagccatttcttgtttgattattttcacactattggtccttaaactgtttaaatttggttcagaaagtacagagcgggccgggtgtggagggtcacacctgtaatcccagcactttggaaggccgaggagggtggatcacctgatgttcagagttcaaaaccagcctggccaacatggtgaaacctcatctctactaaaaatacaaaattagccaggtatggtggtgcatgcctggaatcccagctacttgggaggctgaggcaggagaatcacttgaacctgggaggctgaggtttcagtgagccaagatcactccattcactccagcctgggcaacaagagcgaaattctgtctcaaaaaaaaaaaaaaataccaaagtgatttggaaaagaaagtgatattgatgtaaatgatggcagtgtctgcagattttcaggggtgtaggagcaagagatctaatgttacccagaccgagtggcaaaactgaagataatgaccacaatagaaacacttcacagttcacaagagttatggtgttttatcttcactcatgtagctaaatactccatgttgatattcatttgtcaatactaaattaagctgagtaattcttttaactaaacactgatactctacaacctgcttcgtacagtacatttattgggggctttgttcttgttgttgagttctatatttttttaactttacatttgaaaaagttttagacttacaaaaaaagttgaaatagtacaatgaacacacatatacctttgcttacaccaaatggtaacctctttgccacatttgctttgactatcaatttattttttttggagtaaactagataaaaataagttgaagacacttcaacctataaccctgtaaaccttagggtttacaaccctacgtagtttacaatactactacatacttcagtagtatctcctaagaacaaaaatactttcctgtataaccacaatgtcaatcacacatccaaaaattgaacattcgtccaataatattatccaatataatctctaaatttaaattcccccaattctccaaaatttcactgataactccattgtaaaagcatatttctttttttttttatgtttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattcaccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtatacagtcccaccaacagtgtaaaagtgttcctatttctccacatcctctccagcacctgttgttccctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtagtttgcgaaaattttctcccatgttgtaggttgcctgttcactctgatggtagtttcttttgctgtgcagaagctctttagtttaattagatcccatttgtcaattttggcttttgttgccattgctgtaaaagcatatttctattcttatcattaatattctcttcccaggataccttctacccagtgtttttagcatagttggcccttgcctgaatcacttattatattgactattacaaaaaggtgattttctaattctatcatttcctttacattttgagatttttttattctgtgaagactgttctcttccttttacttaatagtatcactcagccacatagattcctttttatttcaatttttttgtagtccatcaccattatttttctttttcatgctcgtattgtctgaaatttagctgatgagagccaccagaaaccacccctgtgtctttctgacatgtctccaacagatttggggcatgttcttacttacaaaataaggtattctaggcccactttgtaccttgcctgttccagacatttgttttttgttttgttttgttttgttttttgtttttttcctatgggcaatgatatttggaaacctgcatatgctcatttttactgcaatattatttttctaggctcatttggtggacagggctatatttttcttaataatgagtacatagttatacctccaagtcaaatccaataccatagaatgtttcctcacttttctccatttcatatgtttatatcacatctcccactgtcaaaacagtaatttgtttatttatttatatttatttatttatttttgagatggaatttcgctcttatagcccaggctggagtgcgatggcgtgatctcggctcactgcaatctcctcagcctcctgagtagctgggatttcatgcatgcgccaccacacccagatatagatatagatatatctatatagatatagatatagatatagatatagatatagatatatagatatagatatatctatatagatatagatatagatatatagatatagatatagatatatagatatagatatagatatatagatatagatatagatatatagatatagatatagatatatagatatagatatatagatatagatatagatatagatatatagatatagatatagatatatagatatatagatatagatatagatatatagatatagatatagatatatagatatagatatagatatatagatatagatatagatatatagatatagatatagatatagatatatagatatagatatagatatatagatacagatttagatatatctatatagatatagatatagatatagatatatcgatatgtctatatcgatatagatatagatatagatatagatatatcgatatagatatccatatagatatagatatagatatatctatatagatatatccatatagatatagatataatctatatagatatagatatagagatatagatatatctatatagatatagatatagatatatctatatagatatagatatagatatagagatatagatatagatttagatatatagatatggatatagatatagattttttttaatagagacgggatttctccatgtgggtcaggctggtctcaaactcccgacctcaggtgatcagcccacttccgcctcccaaagtattgggattacaggcgggagccaccatgcctggctgaaaacagtagtttctaacgtccttgatctatttgccatttgctctagcctaagtttcagatttttaattattcatttttgtccttggacaatgtaccactaagggtgtctcacttaacaatgtatattgaaactaactttacacttgaaaaagttttagacttacagattatagagatacactttattcttttttatggctccatagttcttcattttatggatctatcagaatttactcaaccaatccctataatttgatatttgggattttccccaatattatgctataatgatgtactttgtgcatgttattttatattcttcaagacgtatcttcagggtgaatttctagaagtgggattgcaaagagaagagttactaaagataaatacttttgtcagatattgccaaatttccctctattagaaattgtaccattttgcatttccaccattgtccttcctaaaataaccaaaccattatttctttgaaaatatgaacaatattaattaactaatattaaaaaataaagagcttttctagaacaagcataagaattccttacacactatcctcacttcctgattccaaactcaaatttagattttataggtagaatatgccactgcagaagcagagaagactataattctagacaagcctcaacatatgtaatcatttaaagctttagtattggtattagtccattctcacattgttataaagaagtatctgagactggtaatttattttcttttttttttttaaaaaaaggagttttaattggctcggggttctgcaggctgtacagatagcataatgctggcatcttcttagcttctgaggaggcctcaggaaacttataatcatggctgaagtggaaggaggagcaggcgtctcacatggcaggagcaggagcaagagagagtgaagggggaggtgccacacacttttaaatgagcagatctcaagaaaatgaactcactatcatgaggacagtatcaagagaatggtgctaaaccattcatgagaaatcacccctatgatccaatcacctcccagcaggccccacctccaacgttgggtgatatggtttggctgtgtcccccagcccaatctcatcttgaactgtagttcccataatccctatatttcatgggagggacccagtgggagataactgaatcatgggggcagttacctccatgctgtcctcatgatagcgagtgagttctctcgagagctgatggttttataaggtgattttcccctcttcactctgcattctccttgctgccgccacatgaagaaggacgtatatgcgtcctctctgccatgattgtaagtttcctgaggcctcccagccctgcagaactgcgagtcaattacacctctttcctttagaaattacccagtcttgggtatgtctttattaacactgtgagaatggactaatccatcgtccattgtaatccattgtaaactaatccacgtttacaattgaacgtgagatttggatgaggacacaggttcaaatgatatcagtatttatgattgcatttttcttgagctaattaaaaatattaaataaaacaaagtcattcataacatagaaatttggagtggaaagaaatcttagggatttacttttatggatcatattagcagaaggtgaagtactgacaatataaaaatgattgaatgcatatcacattgtttcttagagtatggatcaatacatatagcatttttgccactttctactcaaaatacaatcttctctcccttttttttcttccagggcccccactcttctccatatcaaccgtatacctttctagatgtctaatatatttaaatagttcctgagaccctatgatctgatttctcagtttccattcccaagtagctaagtgtggcagaccaggtcatgtgactggaaccactgtggattctcctcatgagacaccaatgggctttcactgctactcagtactcctgctgctccaggcttcaaatgtctgaaattcccacaatgcccctaatcccttctctttcagttgataaccttagtttttagttcacatgaagaccaacaacatcccattgtgttcctatcaattctatcatcccttttccagaacatctttattttcactcttttttctctttctcctagacaaccccacccctacctcatcctccatgctcttcctctggagcactataagtcatctccgttttaatttataatgttttaaatctttctcacttctggtaacttctctttgtctacacacatgtataggtctgtaacattctaaagacagcttttcaccatgttaccctgagttattactttgtctttgtcctttcaactgcaaaattgtgcactgttttaaaatcacagctttttactcacttgtcaagcccttgtaatccagcttccacttcataatgctgttctcttaaaagtttctagtgacctctaaactctaatttcaatagtcttttactggtcttcatcctccttaaactcactttaatgtttggtactactgattggtctttttttaactccctttctgtgattttttgggacactttggtgtcatggttttcttcctaaatgctcttattctctcttgttcattagtttgtcccaactcctaaaattaagcatttcctgaaacatcttcataaagtctacttgagtaattgaccagatgaacaacaagttgaggaccatccatgagaatatacctcctggactgtgaaaatagcataatgcatcctggggactcaatcaacaaagcctgagagtaaaaggagaaaaaactatagatatgggtaggtccagatgatatgcgtatagttcaagaactttattttttagaccaacacatattgcagttaattgcatcaatagtttttaactgactgaaagcagagatctgaactataatttaaaagcataaatgtttacccttcttctagcatctctgctgaaaagattttctttcaatctgataacctaaagcaaattgcataatattagtgtgtctaaactgtgcttagttacttctcattagaaatcagttctgttacttctgttacttctcattagaaatcagttctgtttccccatttttaaaggcctaacaattttaaaaagttaaatattgtgtacagataataatattgttatagcttcatttgatgtaggtcaaattctgatgcaaactggtccttgtaataatcgttcagagtaagaaccaaatgtgttatattctttttaattaagaatttaagaaatatttcatcatacattcattgcctaagtcagcaaatgtttattgtgcactgactatgtggaattcacttttctgagcattagagattcaagctagacaaacttttgtcccctggagcatgcacattccatctgaatgaattaaactggctgagatattatggtatatgtagcttacacatgcagcaccactcacttcgggaagagacaagtcttctgcagtgagtggtgctgcataggatgtaccagcttttagtgaacacagtaagttgcgcagacaggaagatatttgtcttctgtagagaggaactggttcatctttgccagtggttctcaaccagggatgatactgcccccaggggacatgggcaatatctggagatatttttaattgccacaactcagggaaaagggtgctactggcatttagtaatgctgctaaacatcccacaatgcacaggagagctacccccaaccaccaaagaattatgtagtccaaaatgtcaacagtgtcaaggccaagaaacccttctctaggctaaagggtctatgtggcttaattactgggttctttcttagaagaacatacaccatgctgttcccacagcccctctcctccctcttaccgtatagatggtcctttcaagctaatttttctggctgttttttgttccatgggtaaacagagaatgttcaggttagatatgtaccttctatttgtttttcaagctgttctcaagggtcaatcaatgcttactaaagttttcgagcaagcactaaggtagtgagttctgtgcctgctgggcataattacaggaaacaactttgtttttaaaatctcataacaagaagcacaagcacaatccacaaattacaattcctttgcagtgtgtttgtacccttagcagctcacagcagggccacatcatcgtctccgccagccaccatttttctagctaccttcctaaaatatcagaaacaacaaacttcccagggtgaggaaacatcctgtagttttgcccacatggatcagtatttttcccattctgtcattatgttgctatgaagtagacaataaattattatgaaaatatgaatagaaagaggaagtgagtcatgtaaatcattattagtattctatttcacgtgatggaaaactcacagggatcttggtgttagtccagaattcactcatgttttccctttattttaaatgctgaaaaaaacataggttgtaatgttatcattgtacttgtagaactatatgactagatatgaactaagttacttggcaacagttgagctccaaatggaacttatgcctttattagttatgtaacattagatacctcacttaacctttcaagggctcaatttggtaatatgttaaataaataaattgagctagtatctggcatgagaatcctgggtttgaatttggcatcatcagtttctggccatgtgaccatcagcaagccacccactgtgcagagagattataatgagatgagattagcatgggcattacaaagatttttgccattgctgttgtcaccaacagataattatcttgcatgtgtcttctatagcacaactgaaaatcactgtaaactatattaagagataatatccagcattcagaatatctaagatggtcagaattaggtaggttttaaaactcttatgtttcagctctttccaagtcaaatatgaataactataatccacatctaggagtagaagtaaaagaatggaaatctaatttgcaccccagtggtttgtgacatcatctttattaacatgcacgctctgagtattttagattcactgggaaactgttgatatttagaaagggaatatttctctttaaactggtaaagcttaagcatctcctctgaaaattcttctatcccaggatctctttcctgacataaaactgcatgagctgtgttcttaccgcaagagcatcttcattagcaaacagaaatgtcacctagcaaaaggaagtatcaagaagccggctctctccactatgaattgccatcttggtctgtactactgatcctcaggagcactagttatgctcagaaattgacctaagacattatttacagattctgtgaatttctaattacctttgttcacaagaagtcaatcatcagtgcttatgaagagtcacctatttgaatgacaaataactaagtgctggagatttattaaaatgaaattaaatgctacttaaattatctttcacctatccatttgcatttctatttttccgactgtttttctagcagttctattgagcctggtaaggtcttcacctccatcaggcacttttagggttgaatgcacattggagtgatctagtgtgagattttacagaacaactattccacctttccaatatcccttctgtgttagatttctccagagtacacagataataagtggccacattatatcttgttatataagtttgcactgcagaaggaatggtctgagtcttcaaggagctgacatctttattagagacaaaagacaaatatatgttaaaaaaagagtagcccattcaaaaaaagaaatcagtccattacagcaaatcttcattatatcagctaactactagcagtatggactgaaaatatggatcagtagtatgtatatagaagtgacttgaaaatatccataattacataccagttccactgaaccaagtaatgtatcatgtaatgattattttatagcaaagttaactatacaggctttttctataaaatatgtcctatatttccactaatgtccattagaaaatgagagatactctccattttttaaatcttcaacatttttggccaaaaaaatatttaaatgcaatcctgcagcatgttaagaatttaactgttttactttctgacattttaattctcaaaaatagttcatttggtgtcatagcattttttatatctttctttgttcaagaagctgcttctgtcaccttttcccctgacaccaaaggattttctttatattcaaggatcccctcaaatttacatcttctaaaactttcctctcatctttctttgcatgtgattttctggtatcttctggattttacttatttcataagtataaaatttttatgagtaatatgacataaagttcaattactttatcaattctagacattcaaattcctcttatatattctacctcacttgcatgatacctatgttagtttgtattttatttatatttgttgcacaaagccattactttgtaaaaagtattcttatactatactggaaaaagtgtagaaaacctgggttctagtcttacattgcttgacattttctttcatcaatattagaatgggaatattgtacttgattgtgttcctttgcccataactttttaattgtgtgtgttttttatattcatgggcatttcaatttattatcctccccaggtctagaaagcaaattgaacttttgaaactttttctttgagagaaaggaagtaattttattcatgatatccatttcagttagtaaaaatgtctttaagcagctaagtggctccccaaagattaaatgtccaataagtgaaaaaatcggaagtagactcctggccccctggtttcccacatcaaagactagctgccagatacatttcctcctaccagatttctcttgaaattgtaatttgtcatcttctgagtagtagacaatgaaggcctaagatttattttccttgcaagtgaataattagtgaatgtcaatttcatgtttttttcaatctgtgtgaaagtcaaaaatagtcacgttaattatacttagcaggcacttttctgtgataatacaccaattcctggagatgacaaatgtaaataatatttactccttaaaaggtaatctaatctggtattatttataagttcatttaacattgtcttccttatagataacttcaatagtgttttactaattagatataagaaagacagtcccctcatctaaacattattttatttacacttgcttttaggtttttattgtttctttattttcttctacacccccttacagcacaaggtatctcaaacctcaagcagctaccatctggcttgttttatataactctctcagcccattcaagtggcaatacaccagcgaagaataaaaagatatatattggatggagcccaagaactgcacccaaaatagctttttaaaagtcattgagcataacagtgggaataataggaaggtcttaagcggcagctgctcagagagcactggaataattctctcatcatcttgccacaggtatcgtccagaaagcaacgctcctagcacctccactttctttttcactttggtttttatgtctatctttagtttttatgtctatcactcaaattgcaacagctgacaagcacctgggatttaattcctgccggatttcatacattcacattaattttggtaatttcccaattgtaacagtgagaaccttccccaatttgggtgagcagctttaatatttcattgcatattcatgtatcacctcacgttatttttagtttctaaaagagatagcagacgaggcttcataaaagattagtaggagccctagaaatagctttatcactattccagtatatttcttttttcttttcctgagagggcagaaaaggattcccttcaaagaaggcatatttggtagtgaacaaaagggaaccttcccaagaccactagcaatctcgctgatatgttggaatgtctaattttgattctctcaagacagcctaccacaatgcccctgttcagctattgtagggcacaagctaatctttacattctgtttccttcctcccaattcttctcatttgaattatttaaggaatatgtcatgtttcattatttctacatttctttcactgaactatcaagacttgggaaagaaacacgtctttttaaaaaacacacacatgtacagcacaggttattccttttccatttcaaataatttattcgcattatattggtgtcttgtaaatttcatatttattgtgctgctttttaaaataattttttaaagtgaaatttcctattccagttccctttttcatccagagatttttataagatcatatagcatgtaatacagtaaaaaactcaacataccagaatatatttttagaatagagacattctacaaatggcaggagattttttccattttatgccttatgaaaaatggatttggaacttataaaaaatgtatctggaacatctgagtgcaagatttttgattggattttagaattcagatctatgatttaaaagcaatttcttcctttctgaaagtgtccatgtcaaattgatttttaaggagaaagaaatggtgtaatttggattttgaacccttttctcaggacttagattgttttcatttatcttgacttcctttatctttattgcatcctcatggagttggaaaagcatgtgttttcacaacttttttttacaagggttgaccacaggcaaagccataaataaggctttattctttgttccatttcacctttctagcttcacatctattcaatgccaatgtggctttctagctaatactctttttttctatcttgagggaaaagtcttaatattttgtagcatcactccaaaaaataatttgcttttttccccccacaaagagtaaggagagaaaatagttaacacaaatgaattaatcactaatggctgactttcaagtaaaaatccaatgaatgtggagtagttgtctaggagatgtaactggaaatttttcaagtccttgaaaatgcatagaagaatacagagtcccactttattattcttataaaaaccaaagatctgagtatcaaatcactaacctatttttttttatcttgatgctcaagctctgaaagtagctctttctcagtcaggcttctaacttctatgatggttgcatcaactttaatgttctaatttttagcacagctaatggagtaaactgtaactgagtaaaaagatgactagaccactatctagctttctgacttttggaagcaaccatccctttctgaatgttatttgcctcctctaaaattaggaggctcaagctatttcttaaaaaagagttctgcaataagcttcttgggtttgaattcagattctatcactttactagctctgtggtcttgtacaaactatttagtctgtctacactttaatttccttactgtaacatggagatcattgcagtatctactatagaaggaattctatcaaatgatgttggcctagttgactttcaataacttttagctattgtttgattcagaggtatgttcaagtcattatagctatgtaaaacaattaaaataactgaaaaatgtgaacaattcccaaatatttgtataatagctgacattttattaagtgtttattatatgagaaacactaagttcttgatttgtatatttcaattattcctctcagtaacacagtatagaagatataattatccctggtttacccatgaaaaaattaacctaggaaaagcatggtgactcacacctgtaatcccagcactttgggaagccaaggcaggcagatcacctgaggtcaagagtttgagactagcctggctaacatgacaaaacctcgtctctactaaaaatacaaaaattagccagacatggtggttcattcctgtagacccagttactctggaggctgaggaaggagaatcacttgaacccaggaggcggaggttgcagtgagctgagatcgtgccactgcactccagcctgggtgacagaacaagactgtgtctcaaaaaaataaatataaataacttaaataagcacacagtcacacaagtgaaaaagtgctggaagtggcatataaaggggagcgtgttttcccccagagttcactcttttaatcactggactgtattttgccttccactctggtggaagacctctgccttcagtctagatgactaatgcataattaactgcagcactacatcctgaagaaaatcaacctgtccatgtttcttgaatcatttttacaattaatatctgatttatatttcttcttttccgaacttgccagagaattttagaacatgatgcatatatatttttcaagcatgcaaatccataaagtcaaagagagtttttgaaccacagcttgttactcccctaccttctttcctgtcaaaatcacctgtgaagaatcaactttctcagaaagctcagcaacttattgagatttggcctggaattcacataaaactagataaaattagtgctaaaaggcctataagagcaccataaaataattgacatcaaaacacccacacacacacatacattttcatttcaaatgtaagaagccagagctctgaccccattgctttccatagctggcgaaaagtatgacttttgaaatcgatacattgcaatctccatgttaccatcctagtgcagtactccacagcaccggcgccaggaagaaacatcagtgtttcattctccagattaatgatctcctttcagagaaatgactttcagctattttagactatatgcccttcatttgagaagcagtttgtattcattcacttacagtcaatattcactaatatcatggattgatggagttaaaaagcttttcattagttctgttagcaaggctaatttttatagcatttgatcattttacttctagttgcccctctttttttcagaactttgtgtcccccaatcattcttttgatagagtaatatattacatgttttgtatctacaaagatgtgtccatgtccccaataatgagagcagctactcacaaaacaaggttcctgtttcttgaactaattatgcacagaaatttctacctctcacttaccaatgagataattaaaatgtgagtcttggagcagagaggattagaggtttagatgcttgtataatacatatattactggctagtaatttgtactgaaaaaaacataaatataaatatatatatatgtataaactctttgctccatttctcatgtatcttattatttgtttatttttgcagatgttattattcctaaattcaaattggtcacaggttcattcaagaaaaacactataccaacgtaactacataccaattataaaaataaggaatgtcttgatgaaacatagatatggggatagaatagatattcctgatctctaagtgtacatcaacagtagggttctttcctcattaagtttaacttaccaagaacatgtgtaaaaactctattttgctgttcaaagacattcacatgaaatttttttagtgaagtagcagatccaagtacatgaagagccttgggaataaaaataggcaaagccttataataatgattcctgctaatagaaatatttataattacactatgacatcctgtttttagttgctatgcaattaacattttctcttttcttctacttcctcttacacttatacacatgaggatatgtgggtttcattatgccaggatgactaggtagagacatttgttgatattttaagaattttaagacatttctagacttcaaaaatgcatggttagttgtttcttttttattgtcaaaaacttgtagtggacattgctatgcttcagggacttcacacatacataacatctcctttaatcctcatgtaacctctgaggacttgctggtctagtatggaatatgggacatatacctgaataaccacaacttaagacacaaaatggtgacggccatgagcaaggtacagagatcagtagccataaccgtgcagaagaaaaatgttgcttctacctgaaaaaaataaaaaaggttcctttaagtggtgacattaggagctgacctgaggggaaaacaatggtacttttaatatcaatccacccctataacttccccttaactttagatgtgtatcattagcattattcttgtgttaaaacattagggggatgctttggcaagaacctgaaatgaagacaagcgtgcaagtaaaaaggaaagagattgaaggtctaagaatgtcagaaatacctagcaaggactaggagtgagaaggaacaggagtgtgtgttttagtgaaaagagatcacataggatgaaaggaaccaaaatctattcctaaggagttaaaaataaaaggatgcagagtaggaaaatcattgtttgattctcctttgatagaattaccagttgatatcattaagacagtctagtttatttgttgcctgaattgacctatgcagatgccaaaggagaccttttgtcttcaggatgggtagggataaagtgagaagagtttaatttctgaccccatgtacaggacattggaggctcagatgctcattactcggggaatactgatgaggatgaaacaagaagtgcatcatctactgagggtctggaagtttactatcgttaatatctacaatgtggagggtggggaaaggatgcaaaggaggaagagacacttgttttgaaggtgaccaagatgacctttaccctatagctaagctgaatgaccttgctggtaggtgaagtattttgcgaaaccattctggctcacttaggggccagccttgtggattgtcattattcatagaaagacacagtgtctgctcccaacattgacctcacagtatgagagttgagtaatatgaatgaattatttattacttattcaaattttaagactcactggcctctaatagaaccaaaataagaaatttttttcttccttcttttccaataagttgatacctctatctatgcttctcacaaatggattctctacaatcaagtgattcctttcaatactgtggactcacaaactggctaattatacctgaattaagggcagttccattcaggtgattctacatttcattttacacaatgccatagccaggaatgacccaaaacaatttcttaatagcctgaaagagttccttaactttccaacaaacttcaggaaaaacacataggataattaaataaatccaggaaacaattttttaaacattttctttatactagggttgagctagacactacctaactctcaaggagtttacagtatgactttttgaagccttattttttacaaaaatgaaatagatgtataaataataaatataatgctaggcaataagacataagagatgtactagggaaataaataaattttgactgggctggctcagagaagaagaaaacagttgacttagaacttaaaccattacaaggattaggatagtaaataattaagtgggagtggaatttgggtagaaagtttgccaggactgaggaaaattgagctcctatcaatatggtgagttaattaatagagttaaaattcaggtgtgtaacccaataatttactttcatttcctggcttatcattacttatttccatactttcattttttactattattaagattcatcaaagctgggtattgtgcctcaaaccagtaatcccagctattcaagaggctgtggcaaaagaatcgttcatgcccagcagttcaaggctgcagtgagctatgatcatgccactgcactccagcctgggtagtgagaaccccatctctaagatccatcaagtcagcatggccaaaatatcttttgttcaatacatgaaaaatggatgaagctaacattaaatatcattcttatatatttcttcatcaaattccacattttttatttttaaaatgattcactttgtattgttttattttttcttacttcttaggtatttctaaatcccaatatgctctgataaataattatcatagagcatatgattttaagcagagatgctaattggctttaaaaaatacagactcatgattgtaatcatctaactgttgttgaaccccaaatttcaaattcctgctaagcactgcaactcgtataaaattattcagaaaagcagtgttttatgcagagtgagcctctgaggaaaaaattatctatagtctaaataacttttgcaaataggcctactataaaatttggtaggctgatttttcctgtctctcagtaaatctagtataacattgaaaaagatcaccacacttggtttgaagtctaaatgaaataataggcttgatttaagagccatattgtatgaaaaatataattgttttttactatttttttcctgagtgggtatgattggtgtcacctatgtttaataatgtaactactgcagtgggtctcaaagacaagccacatcagattcacctggagggcttgttaaactcagttgcaaaattctacactcagaaagtctgaagtggggcttaataattttgttattattattattattattattgtagagacgggtctcactatgttgcccaggctagtcttgaactcctgtcctcaagcaatccccctgcctcgacctcccaaaattagaattacagacatgaaaggatttttatttttaatgagtaaccagtgatgccaacgctgctggtccaggggacccactttgagaaccactgtgtacacacacacacttgaaacacataaatatatatatcttaaattaatttgtgatcatgaagggtatgtgtgtgtgtgtttaaatgcctgtgtgattgtacatcattcaaccagctacattttttaatcattagtcatttcttattatgtggcagtgaatataaccacttctaacctatagaactgttttgatgttcaaaaccagttctcagctgctgggaatgccttaaacgctaaggtcaaattgtcaatagaatcctgcctgcgtagacttaataccagtaagatagatctaaaattggcatttcaataagctattttgctaaactttaataacacaaattctgttaaccttgaagccctgattaaaacacaaataagcgagaaaatccctattgttaactgagcccattttgcatatttattgctacatcttttaatttgtaaggccatggcagactgtataatgaaatctgctctctagttgctaggtctttctttttgtcttttccacattatattacacgtaggtgctggatgtcagtgtagtagcagcttacctacatttggagaaaatataaaaacctttgaaaaatgtttgctatcattctgtcattcctttcttaactctttttcctatatttgtccatcatctgttttcagagtccaaaaattttaactagttttttcactccaccaaaatgaaaattctaactatatttatttagctatttattttttaaagaaatgctgcattttgttgggttgagtggtatatagagtctaccaggtgctttgattaattcagagttatcctttgcacaatcatatatttgaaaaaagagaggtaaccctgaaaaaaaaaaaaaaaaagagaatacagtatgaatgagctggggttggagagtttgagaataccgaagttcagaaacatggggactatttggcacccaagaaaataaccacatagtcatcatcaggttttgggactgcttatggggaggaaagaggatgcccaaagtagtttaatgaaacactgaaagtaatgatttaggaacagattaaaagatgccagattcatcacttcatcacatgatctgcctttctttgcagtctaacttgggataaactaaggaagaaagtatgacaatcaaattacctgcttttcctgtttttataaaattatgtaaaattatagaagacaaagttaaaactacatgtcgcatttcaactactgtatctatggatttcttactgagaactgtctccagtgacacaaataattttaaattgcatgcattgtttatatttaaagactacaaattctctttatttcttcattcaacaaatatttattatgcagcttctgtgtgccaagtgttagctgaaggaaatatagttgcgaacagacatctcttgcccagccaggtagttaagacatactaagaaacactaatagcaataaaatgtacatggagctatgtacatttctaattctgttgttgttgttgttgttgttgttgttgttgttgttgagatggaacctccctctgtcaccaggctggagtgcagtgtcacgatctcggctcactgcaacctccacctcccgggttcaagtcattctcctgcctcagcctcccaagtagctgggactacaggcacctgccaccatgcccagcaaatttttgtgtttttactagagatggggtttcaccatgttggccaggatggtctcgatttcttgacctcgtgatccgccctcctcagcctcccaaagtactgagattacaggcatgagccatcgcacccggctgtacatttctaattctatatctgggtactcctctcaaactcgaagaaccttaatttggaatttaatttcaattatatggaggaaaaggaattagtccaacctctataccttttcttttagtaacaactacagagcagaaatgtgtccctttaacctttgaaggggctattttccctttcaacacaacggaagaaagcttcagatcagaactaattgttctgtgattgattgatagtttccctcttgttgctacatacagcccaatgacatgcattgtacacacaacaggaggtaagagagtcaatcaattagggaaacaattagttccagtttctacaattcatttgatgttgtagatgaaattgcctgaaaatattaagagcattaaagatcagtggtgaaagctaagtaaatacatttatattcaaattttagaggcagatgcttagttgatgctgctcttctgcagataggcgatgttaatgcaataacaattacagtttggcagcaattaataaatggactgtcaaaatcagtcaagttgtgttcatggttttggaaggctgctgattttagctttgacaagatgtggctgaagtgttgctgaaaaactcaaagtgattaattaatttagaagatataattctgtgactccccttctatgggtagtagttggaaatgggggaacccaaacattcaatgcaacctgatgccttctttggggtccacatttaattagtatttatgtctagtaaatgcaatgtgtaggaatattctaagatttatgagattgatgaagttgtaaccaagaaaatatgacgcaacttggagtaatataattgatgagatcttcaagtcatacggaattctagatttagagcttttgttgcgatattagggtacaaaattcagggtggggaggaaattaggatggactaagagtgatgggctagctctaagtgagctcaaagctatgtctcatgcagagcaatgtgagagacaggtccctctcctcctccgggtaagaaagcaaaaagaaagttaataaaaataatcaagaacatttcatccaaaacagtagaaaagagaaaatgcttaagaattttactatatttcctcaaaagcaaaatataggaacaagtttaaagccataattccatcaaattttgagtttatatgttagcctattcttaataatgatcaaagctgcttaaacccagaaagtaaatcctgatcagtttcacattatcttttagtttgttcagcaaaagaataaagagaatactgatgttaacatgtgtatgtctgtagtatttaaaatccaacacactctggcagaaatgttctagagtgactcaaatttgatccctcagagaaaaagtatattttttaacaaggtaacactgttactttgatgaataaatttttttctaaaaaactctggatacaactaagacagctaagaaacatggaaagcaaataaaacatcactatcacccagaaaaaataagataatactaatagagaaaattaattctaaatattaaatccatttctagaccaaaacagaaaagaattcacattaccttattcaggtttttctaacctttcaataaaaatcttgtagaaatttgttataaaatttcattttgtaatttaatattaggaattaattaggagggaaaacaaattgatattctcagctccttatctttggcgttttagtacttacattgtctttcgtgttctaattaattttactaatccctttagctaatgaataagtaaatgaggaccaggggaaaaattcatcaattgcaagaaaagtgtagaaaattattaattcagaagtaacccataacaaccacagtgaacttgtcagtattgctttgctctcttgctaatattctaatttctgttttattattcttcatagagcaaaatgtttcacagttaatcttaacagtacttttgtttctaagccttctaaaaggcattgatttgggaatagccaaatatttgaatataaattgattttatgcaatacacagaaaacaagtattttattgatataagtggtttctttatttgtagaattacacttaaaattattttgaagcagcatgaactctctctggacggttttggaatttcatgcccaaatcaacttgaacattacttttatatgagctttttgtcttctgcagtagcataaatgcctatggatggaagtgtcaggggagtagagatggagataaaagcttcaggaaacaagatgtaagtgtgaaaatgacagaatgttcatgtgggaagaaattgctataaagcttttctttccttcattcctcttcctaaaagaaatacttaaattttaggacttcagtcattttctttcaatctggttgataatagcaggagactaaggcctactttatatattaagacagaaaatgctcagacattacagagacaggcatgaagaaggggaagcccgcatgaatttttggaatgacaaaccttctgtgctgatattctgatgtcagttgacattctgatattgattttcagacttccttcactgaggaagtagttataatctttaaccagcatggccaagaaagaaatctcaagggcagtagagacttttgctgttgtctaagttctttttatcctctttaatgccataccattcttacctctttggaaggctgtttgtcattcacaaccaattcaattcaattcagtgtctgatgatggacttctacaaagtgcatcttaatcagcagatttccacagagacttttcctctctctaacaccctctgcaaaatgctggctgaaatttttacttgttaccatgaataacagcatgattttgcagctacatgttcccctctttcaaaattgaatgctctatatccgtttttccctaccagctgccttccctctctccactgtcagcattttgtgatgaaaaagattcagttacaatatgtgccccatattgtgtaggctttattttcactcaggctttgagtcaggcctccattctcaccatagaaatgccctatcacctctccaaacaccaattctctctaaaattaaatttattctgctataacatgcaaaacctagaaatgcatccaaagcctgcttctgacaccagagaaaaatgaaaaatcacgagcaaattcacctaagtttactcacatttatgttttactcccttataacagagtaatgcaaaattaggtttatatcaatataaatacgtatcataagcactatcaaattttatactgtggtagggattgagacattgtgctgagtattgcaaatacaaatgttaataaaatcctatcccaaaactcagggagctcagagctgattgatgaaatagatacataagaagataatcatgatataattctagaaatgcattaattcctaaaagtcttgatcctttccctttcccaatataatggtgaggaactttgtttaagaaaatatgtttaagaataggtagcataaatttttttttattagaattataaagagggcttctcttcctggtgacatcttaaccacaagagattatttatgcttcctaccaaaagctactgaaatggtagaatagaagagagatgaaaagggtgaaggacataaaattctgtgcaacaagaaagtaccttaacaaatcagaaattctgaaccgtttccaagacatagaaagcattttataataattgataaagataccagatctgagaaaactgcaacccagaagtgcttggaagaaatgtgctgcagagagaggagccattttccccagctggcccttgatagtctaacaaattgccaaaggatttctgcttggagggtaattacagtggagtaatttattaaaggagaattgcctcctcacagctggacaactggctccagttcacatagaggtacttagagccactatgagggctctctgagtaatgtggacagggtgtaggagcaaacaagaagcaaagcacagtcctctgaaactcaaaagggtatgaaagagtaagaatagcccctctgccagacagaaaatgctgtccgctcccagaaaaattcctcctttaccttgaaaaatgagggaactcctagcttatctactggtacctgcccaggcacttagaaggaaagtctgtgtcaccatgtgtaatactctctcagtcaacactttcattcagagaagaagtaactggggaaagagatttgcccagtttagacaaaatctataccagtcataagattaatcaatattagattccaacatagagtttctagcttcagagtccatgctgttatccagataataactgaaccaatctacataattcagaaacataatctgtccaccctccctgtcatatatatcttgattaaaggggattttttgtaagccagataaatatctaattggtgaatcatcaacctgtacaaatagtgaaatggtaaggaaatgtattttggaatcagagggttatcacatgggtcagcccatcatttcatggagccatcctttgatcatttcccagctgtttccaattcccagagctttttacttccttcattgttgatgccatggagcctctaaaaggcttatagtaacgttcctaggatctgtagtggaacacccatgctaggcaagggtgatttccccatacgtattttttggaagttggggcttgtaaatagttgactaccttgactacctctaagtgtcatgcaaagctgagccagagccaatgagagattctagccagtttcacaaataatcctgaataatttatttggcagcagctatgattttatttaaaagttgataaatctgaaaatatctttagatcctattctataaagaaaggcaaacaggcttcatcaagaaattgacaaaaatactttcagttctgtgtaagtcaaatcgatgttgctataaggccaaaggatagtgaagtagggacgcaaaaagttagccatattccaggatctgaccttcaaaattataggctcaaaaatttgtttaaagtcatctttcggtgtgactgacactacccaattcacaaggggctaatatataagccagaattttaataattgtttagtactgcgtatctaaatacaaacatgttttcttccaacgatgcatcatagtttataactagactgatgaaataaacttggagtcctagtcatcaacaatcttgagctacacaataggaaaaggtgcagatcttccatatatctgttgctttgcagtaaggtagaaatgacttctacttaagaatcttaaaaaattataatagggcttttgataataaaagacatccaacaacttttaaagtggaagtttggcacactcagtataagcactttagatcatgttttagttttcttttaatgtcataatatcaaattattgatcagtaagtatgaaaaaagtctaaagaaatgagccaactgcctgtagaatgacttcatatcagtgaaattatagtatctataattactgaataaaacatgaaaaggcaatttagctccatgtattgctcttgtcagtaagccagcatgcctgtttatcatgtaaataggatagtagttacagatcatgctccaaatcagaaactatattctttctaaactctttatttgaagatctgagatgcaaactgtggtatattcatcagtcttattaagccactcagatggcaatggcattaagtccaggcattggccaaaatgaaaataaaagttaaagagccagagataatgaccttttattacagttacttacttcacaatgttcaatgtcatgttccaatgtgagatggtgactcaatggtattttataggaaatctgttcttaaccccgctttcttaaagtggtgtgttctgggtttgtcaagacgaaggaaagatgtgaaaattcgccatggacatatccctaactttattaaagcgtgacttgttgaagaaacagaaaataaattgtttcttactaagaaacaaaagcaaagaagaaagagaaggagtcagggaagaagcaaaagaaaaggaactcactaagaaacacatggagattatgccatgtaagaatcacaatagggcacctgcctttcaaatattctttccagtcctccaagtcccccggatttatttgtagagtactcctagtagatcaaggtgtacttgtccactgcttcctcacttgcagactttgatcaatgatggacacactaaaaggtagaacattcaattggaatgcaatatataaaactgaacccttacctaaacgtttcaaatcttttaaagcagcttaaaccaatcgcaaaactaattttcttataattcacatcaattcaattcatatttatccagctccacaggatgcagggtgctgaacttcaccataatttacagaatgtagggaagacacaaccctgttttgaataggaaaaaaatgtaatgaaaatctcttagacctattgggaatcaaaagctaggagtcagaggcacatgtaggtaaagagtattagcaacaaggcaagttagcttcgcctagtagataataagcctatggaaaaaaaaatttttttattgtgaaaatgagattgttaagtatttgtgtatgctcgtttttggcagatgtaatacaaactgaatcaaaccgtaagggaaatgtattattttccattacaagaagtcccaaggtatggttgtcgtaggttgattaacacagctgctcaacggcattgtgaggttatggttactttcagtttatagctcgctgtccatagagtatctatctgccttccctttcaccagattctctcatacttacgacatggctgcaagcagttccaggtaccacaggcaaacacatcaccacccagcaaaggagatactgcttcctctgtacgtctttttaaaggttagaaaaacatttccagaaatcacccaacagaattcctcttatattgctacacttccaaattgactcatatgcccttgcctaaaccaaccatcggcaaaaagaataggatttccatgatcaacatatagactaataagattttcttatgaaacagggataaggtaatctccccaaagcagtacttgtcagaaaaaaaaagtggggttttatcttaaattgaaaggaaggaatagctgttaggtaaaaaaccaacacactgttaggtaaacggccaacaatcttgcttgttattttttcgtagattgtagatactgttcattcttgtctcatgtccccaaattaattcattggcacacaacagaaggtagaatttggggagaagtctcctgtaattatttatactagagtatattttggattttaaccatctgcgtacatggctgtatccccagccattcaaatagtgaatgaattacttgagaattattcaaagcacctagtataatgttggacacattgtagacacacagtttattcattcgatcaacatttatctattcatttattagtaaggcagacttccatggactcagagctggcctgtttcaatttaaatcctggctccaccacttactagctgtgcaaactttggcaaattctctcatctataatagagagacactgtaataatattgcctgactcatgaggtttattttgtgagcattatatgagcttagatgtttaaagcacttataataatgtctaggtaatagtatagcttaataaatgttagatatttttatttattgatatattatttctaactggtaggttgcaacattttccatcatcctatttacctcagtctgaactgtgtatagatggattttaaagttttgcttcactgtgtgacaaaacaatgactgtttgaacacagtgtgataaaagagggctgtgagctgcaagctcagattttctgtcaagtgcctgcagctcagaaacagcaagagttcagagttgagtttcagcaaagcaacggagaaaggaaattccaaattatttatctgtaacttctataaaaaacactgagagccgattggcttgcttcaactaagctatatctcttcataactaccaaaagcatctagtaccatcttactatacaaaagttagagatcacttcaattaatattctatacaatgagtacagtcactaaaaaaagctatgtcaaattgatccatggaagatttcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcccgagttcacgccattctcctgcctcagcctcccgagtagctgggactacaggcgcccaccaccacgactggctaattttttgtaattttaagagatggggtttcaccgtgttagccaggatggtctcaatctcctgacctcgtgatctgcccgcctcggcctcccaaagtgctaggattacaggcgtgagccaccgcacccggcctcctgttgcaacattttttaaaacactgtaaaatacacctgaagtttttataatgcatttgaaaaaactcatatcttttcttgattatgaacctgccattcctactaaaatcttgggaggctttttagagccagaaaaattctacattattcagtggcacttttaaaataaatatggtttttgaaactgcaatgatattttatttatagagaaatgaatgcgtaataagtggattatcagcaaaacaatgttaaacttgtgaattcattaatgaatacgtttttagttacaattctgatgtaccatatttttaagattcacatccctattgtaggtggaaaatgttcaggtttgtataaaaccttctgattttctgtatatcactttagtaattcagtacttgaattttctcttggatatgttttgccagtttgtttccattcttttattctcaataatataggtccaaaggggaaaataacatagcaatgaatatagttttcacttggctcatggatttatttttattttggctagttcttctgaaattcatgttgactacaattgctaaatataattgtaattgatcttctgagaacgagaaacacagtttgtttaaattttttttaagttttccctttccaatacattatttataaacaatactcatattttctcctcattctttaggaaatacgtatttcatgtactctaagagaccattaactacaagatgcaccattattttatatagcactaaggaagcatgttgaaaacagtttcaaaaatggtttcatataatttgaattttattttgtattaaaagattatttagacttatttagacagatttcattttgtcactcttgtgcacacaaaaaaaacaaaaataaaagcaaaataaattggttaatgaatttctaaaatttctaaatctgttctcaatactcagatttgataatgctctttttttcagataccatttctgcaaatattgctttactgttgcctccaaaatcttccaaattgcttgactctcattctgctagttttgatggtaaagccaatattaaaaggtttcagacgacaacccagatgcagatcccttctttaagtcacctttgagtgatttgttgactggaacatcagcaggaataataactgtgttgagcgtacgttgagcaaataacaactgggcctggcagacagtgatagtaagataccacagattttaagaaaaatccccatttcaaagatgtaaaaaatgtgaaaaaaaatattgtgaaagaatgtattcagttgagtgtttaatccatcactcaaccatcagtctccatggcattttccttagcttccatgatgggatcccacatcactcaatgctctcagttctaacagtcttccatgtgcagttaggaatgcacagtgaagagttactgacaaaattcattacttctggctataaattcaaatgatccagaaactaacaagactagtgactccacacagtaggttttgtttctcataatactttcttgattacaaggtgcagatacttagatcatcatcaagtgggatactatgtagtgaaactcagatcgaggtgaaaaccaggccaacagaagtggagtaactgcaaggatgacattggacagtgatcacagatgtgagccctgggatcagatagccatactggaatcctggcttcaccacttattaactctgtgacaatgagcatgtttatttttttctctatgccttagtttcttcaaagtttttcatagtttaaattcctagggaatgattcttattgcctaactcaccttttcatgccaaacagtgtcattggcctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcgtccatcaacccatcacctaggtattaagtccctcatgcattagctgtttgtcctgatgctctccctgccccaccaacaagccccggtgtgttgttcccctccctgtgtccatgtgtactcattgttcagctcccacttatgagtgagaacatgcaatgaaaaacaaagtttaaaaaaagaaaaaagatatagagatgttaaactagttgggccagcttggaaacaaatctagaaaaaaatgacactttttgacacaggatgttattatgatttttaaacaatgaaaattaggattagatgggaaaatagctaaattcttaatataaccagtctccttccatctttaagaacgacggctcctaagcttttgctcaacttcaagagacagggatgggagggaatgaacactggagaatctagcaaactacataagaaaaaacaagaaagaattctcattaacaatatgaaatttgcaagttggtaagtcagttttccaacctctggaagtaggattacctagctacttaaacagtttaacccctggtttttaacacaaacatttgccttttaagctatttgttcattttgagaaacttacagctgcatctctctgcacgtatcctttttgggcccaaatttcctaattcctggtcctatttgctacttcttcttcatgctttcccacctgcttcctggaaatcagagtcatgttcccaattatctaacaatgtcaagaagataactatgagttgtaatttaccactattggtttcaggagatgacattgtgggggcatatttgagtttccataatgggaggaagggtcagcaagcagaaactcgtgggctgctttaatggtgtgaattgatgtcttattctcctattctccaactgcacacaaagcataaagctcactaaattctcattacttacatcaagtctttagtacatggtaagtgagacctaactaaaaatgattcttgttctcccattagggaaaaaaataatcaaagaaagaaaagaaaaagttaagaccaaggaagggttataagaggaaatggagactgaagcatttcgatcagaatgagaagagaggcagacaggagagagggatacgagaaggaaagccaatagggcttaggaagctgcggagaatttctgaagaaggaagagagaagacatatagtagggggaaaagagatatttaaaggggattcttaggaaaggcagctggtgagcatgcaatatttccttctgcttacattcttccaaagacatcttcagcataacacctctacacacctcttcaatgtttgtattgtgggatttgtgacattgcggaagaatgtttgttctcttcttaaagtaaacctaagaaggcccagttatattcaatttgcaaaagcactatgagaaatacttcctggaaggcatactctttaaaaaaaaatctccctacacctctgaggaaatttttgtgacttgttgaatgggtaaaatctggaggtaactagatccattttggaaaaaatggaagaatccaggcacctgggtgttttaggttagccaaactgctgtgcttccagttgttgtaaggtctgaaaaacaacctttcttcagtagctgtttctttggaactactgccataagtcagctctcatccatagtgacagggctgttcaatctcttgcttcccacttacttccctcaagagaaattatgtttgaactagacagaagatacacctcaagcctgacattcaaacatctgcaaacttatggaggattttgatatgctgctaggctttacttaactgcctaaggatctttggatttggaaagaatttaaatgaaagctttgacagtggttcattttttttccaaaaatatttcagagtaggtgttataggtcagattccctgggaacctgctctcaatcagaggtagtttactaggaaatgttctccatgtaagaaactgaaggaagcagatgtgcagaaggggagatgcttgctgaactgatatgccattacaacaggctttagctgatcctgcagtgtccttcagagatgaactaaatcgaggccagcatccaccactcattgtgtgaaggccattcctgggtaagggggtttaaccttcagcaaggcagctgcttttggtcaagggcaatttctctggagtgactccctggctgtgagcaatcagcaggcagcactgcctgaagctgggggaagaggctgaaatccttattcttgaaagccccagggcatgggaagaactgaatagacctggccctcacttacggattctacctatacccacagcagatcaaggaaaacttggatggaataaaatcactacattctgccctccacctcaaaatatactctaacaccttccataatatctcccagcttctttttaataattattccaagagttagtttcaatatgggacttttctgcattagaagactttttttagtaatattttttcgacctcctcctgtatgtgctttaattttgcatgctattgttataaaatacaatacttaaatagagatggaaataatgctttgtctaaaaatcatgatgctattgcagtatagtagactatcttactatgtaatctgagaaatctatattaatttgtagatctagagataggtataattaaagtcctactaagaagaataatttctaagaggacagagggaagttgtcatagcaatcaaaatcctgattttcctcattttataccacaaaactataaactttttttcatatctcatttttttttcatttttcgtaacttattggtgtacaggtggtatttagttacatgagtaagttccttagtggtgatttgtgagattttgatgcacccatagcccaagcagtatacattgcaccatatttgtagtcttttatctctcacccctctcccacttttcccaagtccccaaagtttgttgaatcattcttatgcctttacatcctcatagcttagctcccacatatcagtgagaacatacaatgtttggttttccattcctgagttacttcacttagaataatagtttctaatctcatccaggttgctgcaagtgccgtttattcattccttttcatggctgagtagtattccattgcataaatataccgcagtttctttatccactcattgattgatggacatttgggttggttccatgattttgcaattgcgaattgtgctgctataaacatgcatgtgcaagtatctttttcatataatgacttattttcctctggaaaggtacccagtaatgagattgctggatcaaattctagttctaacaaaagtataaattttaatgataccttcatatcttttctacattgtattttagccagtggccattttacatattggttaaatatgtagctgcatcattcattcttgagatttagcttctgaattacattttaaagttttttttttttttttgaaaatctgacattaggaaattaaacctcttctgcaagatccagttttctccagaataaaagttttaaagattttttttctttttgtaatttaaaataattcaggtttacaatattttgagaatgtagacatataggggaaaagtgggtattcttccacaaggctaacactttgtaatgcatctttccagcctcttctctgcaaaagatttcttaaagaaaaactggacactttatatactgtctcataatttgtgtttttacctaacactcccatgtatttccaggtttatagatggctaccttttagatactttttataacatcattttatagatcattataattaagaggtctctctgttggataatttctggcacttctaatattgtaaataatgttactacaaacatccttatattaaattgcttttatatccatttaagattaattttttattgagaatttctagaagaaaaatgaccctttcttttttttattattattatactttaagttttagggtacatgtgcacattgtgcaggttagttacatatgtatacatgtgccatgctggtgcgctgcacccactaactcatcatctagcattaggtatatctcccaatgctatcccttccccctccccccaccccacaacagtccccagagtgtgatattccccttcctgtgtccatgtgatctcattgttcaattcccacctaggagtgagaatatgcggtgtttggttttttgttcttgtgatagtttactgagaatgatgatttccaatttcatccatgtccctacaaaggacatgaactcatcattttttatggctgcatagtattccatggtgtatatgtgcctttctaaactttttgatgtgttctgttagtttggtatctataaagtatcctcctaatctagtctccttcctaattgcccagtttcttgtaccctcaccttcactatctatatttagccagatttataaatgaatatgttatcccactgttattttaatttgcagttctttatttgtgaagttaaattttttaagattttgcttttagtttttgtcaggaggtagaggagtttgtatttctttctttgaaaattgtttgtgctgctatttacaatagcaaaggcttggaaccaaccaaaatacccatcaatgatagagtggataaagaaaatgtggcacatatacaccatggaatactatgcagctataaaaaagaatgagttcatgtcctttgcagggacatggatgaagctggaagccatcattctcagcaaactaacacaggaacagaaaaccaaacaccgcatgttctcactcataagtgggagttgaacaatgagaacacatggatgcagggaggggaacatcacacacccggacctttcaggggtgggaggcaaggggagggagagcattaggacaaatacctaatgcatgtggtgcttaaaaccaccacagcacatgtatacctatgtaacaaacctgcacattctgcacatatatcccagaacttaaagtaaaatgaaaaaaaaaaaaagaaaattgcctgtgctggactttcttttagaagataatttaattttctattcaataatatttttcttgataatttaattgtctattcaataatatttttcttggtatatttcaggatgctgaattccactttaacaaactaaatgactgtgtctctaaaattaagtactatgtttcctttcagtaagatgacttgtgtcttccatttactggcaaatagattcaaaagaaaatcataaatacttcttcagtactgatttaattgtttaatgatgcttaaatgttattagtagagtagaccagtagaaggaaccttggatcaggctaaatctgtgtaggaccaatcacttaatcctgggaaagccacactccagttacttctgtaaaataagattgagttacttttcagggttgtaataggaattgagaattttctccttaaatatcaacaacagtattttggcacaaagtaggtgcctaataaatggaatcattagtattagccccttttggtgttattttatattaatatgtcctttattttagtggtttttcaaactgcaggtatcaaatcatgagtggattgtgaaactaatgtacacaactttgagatacaactagaattttttagtgataaagaatagagtagaattgaatttatccaagtatttcacagaagtgtttttatgcgaaacttctcttcagtatataatatctaggcagacagagtgtatatactggatgacaatgtaaaataacctcttaactatgggttgtatccaaaaactcctccaaaaaacaggattatattggatacttgtctcatagtttccaagtcttttgatactatagtggctaagacaccttggttcaaatcccaactccattaattactactatatgactttaactgcctggcttttactgtataacctcctatgacttactttcctcacctatgaaatgggtgataattattaacgagaataatatgaaatattatatgctttaatatgtgtaaaccacttagcgggtgctcaataactgttagcttattttttaaagactgagtagaatatctttttttctgaataagcaaactatgtacataaaagaatataaagtcatcaggctgggcgcctgatggctcatgcctgtaatcccagcactttgggaggccgaagcgggcggatcacttgaggtcaggagtttgagaccagcctggccaacatggtgaaactccgtctctactgaaaatacaaaaattagtcaggtgtgttggtgggtgcctgtaatcctgactactcaggaggctgaggcagaattgcttgaagccaagagatggaagttgcagtgagcagaaattgcaccactgcactccagcctgggctacagagcgatactgtgtctcaaaaaaataaaaaacaaaaaatgaagtcatcacattagccaggactgaataatcagctaattttttcatccacaaaatgatgcctcctgataagcattttatttccataaatatgaattttcaagaaccaagtaactattcttaggtttgctatttacaaacaatattatctctcaagatatgaaggaataaaaataaaacactaggcaatcccttagtctttgtcagtatattagatcctcaattacccacaacatttttgtattttatgatttttttaaatttcacagtggtatgcactaagtaaaaagaactttgtctatatttcttacaatctttttttgattaaaaaataagaattaacagggatgatatcattggctggtaagagttaaaagcttatagctcttacttttctgatgaacaccttccaagggtattttatgtctatagaggattggtttggaaattatagaaacattctttgcttcccttaaaaaaaagctgggtaactttaagaacattttctaaatgttgaccctgtttagcaaaagtcttattgttcctatagtcttttatgtctttcaaactatatgtagaaattttttatgtacaattataagctggagtaaaatgaaaactatttagcaactcaagaagtgaaggaggatccagctatcagtacacacaaaggctagaaacaactgtgtaatcacttgaaagtaggagctgaacatcagtctgaatgaccagcaacaatatcccacctctacaactggacaaaaattaagcagaaacatagttgagcaatatacctttaatgtaatgatggagctattgtacttagctattttcatttaactcaatcatttcctttaaattctacagtaagccataagtcctcaaatatcttcaactatcctgtacagagataagtaataatgtgtgtcacatctggtgtttctcacagcaaaggaaaaattaattttttgaatacgtgcctgtaataatgtgtgtatatgtgtgtgtgtgtgtgtgtgtgtgtgtgtgtgtgtgtgtacaattttagtctggctgactcaatgaaatacagaagttaggacatcattaatatcaacagttttacccaagttgtatcaacagagcaaacaaaacttcaaagttttccagggagatgagctcctaaactgaacaaaatcagataatcagaaaaagcttctgggacgtgacttgagttggaaacaaaaaatttccacattctggacaattctgggaggccaagtgctattagagatgtgtggataaatcaattgatcaatcaattgattgatccactggtagtctgttccattgatccactgatctctggaacaaactaatatgccagtggatcaattgaacaatggagcaatggaacaaattaatatgccagacactatgctaatttttttgcataaattatttcatactcataaaaaccttacagatttggtctgattatcctcattttacaaaagaagaaactgaaaaacgaagaagatctgagccgatatctgtccaattctaccctttaggattatattggtagctagtaatggaaaattaaaaacttaaaaaagagaacaaggccaggtgcggtggctcacacctgtaatccaaatacttgagaaggctgaaaccagtaggatcatgcgagcccaggagctcaaggctgcaatgagctatgatctcgccactgctctccagcctaacaacagagcaagaccctatctcataaaagagagagagagaaatagtcaattataaaataaaaattcgtatctatgtatatgtgttagcctcagccatgatctcctggaagtagatccaaaatctctggattttgattaagattttaataagaatcttatgcatctgagattattctattttcaattgtactttcactaaatatgtaactatgcatgaccaactcacaaatcgtttgcatttctttcttttttttttttttttttttttttttttttgagacagagtttcgctcttgtagcccaggctggagtgcagtagcacaatcttggctcactgcaacctctgcctcccgggttcaagctattctcctgcctcagcctcccgactatctgggattacaggtgcctgccaccacacctgactaatttttatattttagtagagatgaggtttcttcatgttggccaggctggtctcgaactcctgacctcaagtgatccgcctgcctcggcctcccaaagtgctgggattacaggagtgggccaccacgcccagactaaatttcatttttaaaaaaatcttgtttgctggttatctccacgtctttgcaaattaaaaggtttttataagttcgtctactttcctgttaagaacgtgaagtgaatcctgtccaggcctctttacttatctatttctgccccaaatcatgcccattctttcctcagaaagcctgaaatcttaagttctgcaggaaaattacaaagtctggaatatttttagaatggagaatattcgttcatttctactcccttagaataccttccttacatttgtaccttcacgtgttctaagaaaaatccaggaagggcaggttttagttcttcatatttcagaaggtggataaattaggatgtcaaatgccctgttaaagtttatttaactagtgaagaggatgagaactgatgtcttctgaattcacagctgtttgtattgattactttattaattattttggcatattttggaggtaaacaaatacttaaaataattgaatacattaataaaataaaatattctaattaaataagctaaataaagtaaaatatctaaacttataagttatgtttcattagcagcaccttgatatatatagtcaaccatgccacatttatagtgacttaaataattacccagcaagacaagtaaattattgatcagagtattgtttacaataaatgtgaaaaaagtgactggggtgaaaacttaccatcaataaataagattcaagaaccaattactgtaatatattcataacatcttagagtatcaatattatgaataatattacttataaccatttttaaagtcactagcattttgagtacatgttatcatttatcaacatttccaatacaaatattttatctctttcttccttttagaaaatacaaaatatttaaagtataaagcatgtatttcatcaagaattgtttcatacacgttttggtaagatatgggttaaaagttaaatctacacagcaaataattggctgtataaataactaatagatttgacagtatacatagtattgctggaatagaatgctattcagtaactatgtctggtcttaccttctggggaagaactcttcactcgctgtggttccataaatatttcatttaccaacacaaagcaatatgctaatgatggactatttacccagtgagcaggtgccacctctgatgttgtttcatctctgggatacctttgatgtgggagcagttaagccattttgaattgttctgtctttgcttccctcccctcacagcttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccatgtgagtattctatattagtacttgagtaaaaataagtggttgaaaaataccccatccattggaaagaaagtagaactccgtttgatatactataaatttacatttaatttattactatgggaatgatagtatcccaatataaaatgaaatattcttggaaatggaatattcttcttgtctttaaatatacttcataaatgaaaatccagtttacaaaaaaaaaaaagtctgcagcttgtatttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaattttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataagacacttgggttgattccatgtcttggctattgtgaaaatttctgcaacaaacatgggagtgcagatatctgtttgtcatattgatttcatttctttggatacataccgggtagtaggattgctggatcatatggtagttctagttttaatttttaaagaaatctccatactgttttccatagtggttgtagtaatttacattcccaccaacagtgtgcaagggttcccttttctccacatcctcgccaacacttatatttgattttttgataatagccattctaacaggtttgaggtggtatttcattgtggctttaatttgcattgccttgataattagtggtattaagcattttttcatatttctgttgaccatttaaatgtcttcttttgagaaatgtctagtcaggtcgtttgcccttcttttgattggtttatttgttttcttgctgtttgaggtccttatatattttggacattaaccccttatcagatgtatagtttgcaaatattttctccccttctgtagattgcccctttattttgttgattgtttcctctcctgtgcagaagctatttagtttgatataatcccattcgtctatttgcttttattacctgtgctttttgggtcatatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtctgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggtattagttcttcaaatgtttcatagagattagcaatgaagatataaggtcttcacttatgggagattttttattactgattcaatcttttgttcattactgatctattaagatactctatttcttcataattcaaccttggtaggttgtatgtatcaaggaacgtatccatgttttcttggttatccaatttgttggtatataattgttcataagagtcccatgagcctttgcatttctattgtatcagttgcaatatctccttttttgtttcttattttatttatttgagtcttctctcttttttctcttagctaggcttgctaaaggtttgtcaattttgtttaactttcaaaaatgcagttttgttgatcttttctgttgtttctgtagtctctatttcatttctttctgctctgatttttgttgtttccttcctttactaaatttgagcttagtttgtctttgtttttctaatttcttgaggttcaacattaggctatttatttaagatttttcttcctttgatggaatagacatttatttctataaaattccctcttagaactgcttttgctgtattgcataggttttgctatattgtgttttctttttcatttgtcttaagaaattttttgtcttcaagaaatgtttgtttcctttttcatttcttcagtgacccattatttattcaagagtatgttgtttaatttccatgtatttgtgcattttttctaaagtcccttctgtttttgatttctagttttatatcatggtcagaaaaaaataacttgatatagttttaatcttcttaagtttattaagacttattttgtggcctcacatacgatctattctgaggaatgtttcatgtgcagttgagaagaatgtgtattctgtagctgttggacagaataatctgtatgtctgttgggctgattagatgcagattgtagtttaggtgatgtttccctactgatttcctgtctggatgatctgtccattactgaaaatggggtgttaagtcattattattgtattacagttgatctctcccttcaggtctattaatatttgctttacatatttaggtgctccaatgttaggtgcatatatgtttgcaattattatattctcttgctgaattttgaccatttttatcattatataatgacctttttatttctttttgcaacttttgcttttattttatttgatctgatacacatatatagttattcctgctctcttttggtttccatttgcattatatatcttttttcattcctttattctgtatgtccttacagatgaactgtagacagcatgtagctggatctttttaaaatccattcagtcattctatgccttttgattggagaatttaacctatttacatttaaagtaattatcaatacttactactgccatattattaattgttttgtagttattctgtacattgtttatttctctcttttctcccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaattgttttgccttttagccttcatactgaatttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattccactctctcctggcctataaaatttctgttgagaagttggctgctggatgtattggaacttccttatatattatttgcttcttttctcttgctgctctcaggatcctcttttttgtctttgatccttgacaacttgagtatatgtcttggggtagtcttatttggaatgaatttaattggagacctttgatttttctgtatctggatacttacatctttctccaggtttaagaaattttctgctactatttatttatttactttttttttcttttttcttttttttgatggagttttgcttgttacctagactgaggtgcagtggcacgatcttgcctcactgcaacctccacctcccaggttcaagcaattctcctgcctcagcctcccaagtagctaggattacaggtgtccaccaccatgcccagctaattttttgtatttttagtagagacagggtttcaccatgttggcccagctggtctcgaactcctgacctcgggtgatccacccaccttggcatcctaaagtgctgggattccaggcgtgagccactgcacctggcctactttaaataagctccccactctttgtctctgtcttcttttttatctcctatggcttgattgtttgctctgttgatgctgtcccataaatcccatgagctttcttcatttcctctcattcttttttcttctctgactatttttaaataggctgtcttcaaaatcaaagattctttcttctgtttgaccagttctgctgttaataccctctactgcattttttttctttcattatatttttcttgactccacttttcatttcattcattgtatttcttagctccaagaatacttttttattatttaaacctctattaaatgtcttattctggtctcatattattttctcattttgttttcttgaagttcactgagcttccttagttatttggaattatttgtcaggcattttatacctctccatttatttacagtcagtcacttgcaccttagttttttcctttggtgatttgtttccctgattcttcttgatctttatgatcatgtatcaatgtctgtgcatttgaagaaataggcacttacttcagtcttcacagtcttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaaatggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagtataggtcttgaatataaggccgtggtagtctgcctggtactgagttttactgtgcagttgcaatgctaggctccaaagcaaagtcctgtgctcgcttccctctctttcccccaagttgacagtatctctttctgcacctgtgctgcctggggctagggaaagagtgatgcaggtgttgtagaactgtccttcctatctcttcaatgcattttttcttagtattatgctactaccagttactgtgagctttcatgtggtttccttagctcttgtgaagttattttcatgcatggatagctgttcaaacttatgattttgtgggagatggtatctggagagtcctactcctccatcttactctgcctcagtccagttgcatataatttgaatcttaaactacaacttagtcttttttcttcaagtatgaatacttactatgtactaggcactttcccaaatgctgagaacaaatatttagcactcacagagcttatattctagtgaagaaaagaagttagaaattaataaagaggaaaatatatattaataaatgatgtaaggaaaaatataatagtgtaaatgtaatagggaaggggaaaagcataaaaggttgttattttggggatgaccagggctggtttccttcataaggagatctgaaggaagtggaggagaagctatcacaaaacctggcaaatagaaccaaggcccttaggtaagaatctacctggaagagcaagaagcccagtgtgccttaagtagattgaacgaggtggagactggcagaagataaatttgaatgtagcagaagccatgtcatgtggggccttgtcaattgttctaaagaacttagattttacactgagtgaaataaaatgcctttttgagcagaggtgtcccatgatctgacgggtggtttttttgttttgtttcattttttatttatttattttttattattattattattattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgcctgccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctctgaaggcaatatgttgggtctgtttatgctcatgcctagcacatatgaggcactaaatacatatttgatgaatgagtggattaatgacaaccaatttaacttgtatcctgagccattcctcttagactttgaggccttaatatgctgacaaatttaagcatcttactaaatcatacattttaaatttccaacacttatgaaagcatcattttaatgcttgactgtgtcataaacgttgaaaatgtaattgtttctttggtcacaactcctccatcttttagcctttctcactcagagccagctattactttattttttcctccctattcattagtaggaaagcaatcagctggaaaaaaattatctatgaaactctcctttcttttgcttctcttgggtaatctcatctttttccttcccaaaccattgtcttagtcctgtgtccctctattgggcactggaaatcagaccagataaacaatctgcttgtccatggagatttgcctttgaccagcaacctgaaataacagaatgtcaaagaatctgagtaccacccctaaaaaatattatgttgctagcactctccttgatttaacaggaagaaaaaagtaaggtaactaaaaccttaaagtggtatggtaaatcaatgttagaaaacactgcatcataaataaaagccatgccatttatttaaagtggtatgttaaatcaatgttagaaaacacagcatcataaataaaagccatgccatttattaaaagtgtgtaatagtatgtattttacactttcattttaatccgtcataatttttcctgcctatataattgacatttctaataggatttatatgcaggaggcaatactaaacaaaaataaaacacatccttaaaatcaaattcctttaggactataagatatataaaggttatcacttttgacttggcataacatactgtgatgctaatgacgggtaacaaattagaatattaattgatttcagtctctgaactaaatcttggctatctggcagatgtgttttttgcaaaattgatagcaaacagctttactctgtcacttgaaattcccacttgtaagaagaggggtgtcacaatggcaaggagtgtgcatgtcattagttgggtaatctgcacagtccagcatgaaacatattcaaaccaaattgcctgatgatatcatccaggccttaatttttttaaattaaggcttaaattttttttaaaaaaaggagaaggaaatggtaaacgcttagcatttttatctttcaattcattcttcacactgttatctaaatgaagcagacaaggttttttagaattttttttattttgcaactttgattttaatatgactagggccatggttggtctgtaaagcatgaactcatgtcatctgaatagctgtgattaaggctttgatattcatgagcttcttgaagtagagtgcacctttctttaagcacagtagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtcgttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccattttttttttttttggtcctataattttactttctctctccttcattccctttagcctacacacatgctcaagattcacatatctgataatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaatattcagttgctcagatatttctgcattattatcactattggccttcatctactgaaaactcttgacttccaggaccactctcctttcttcctcttctttcctccccttctccttcactgactggtccttcttttgttatgatcttttctcccattaggtgttagaggtccttgttttctggggtttctcttttaatcctattccatgtttattctacatgctctttttgggcagtttcattcacctagccattcaaataaaaaaatctcactattattcttgactccttgagcgatttcaccacatattctgtacctgcattcaagttatgtgaactaccttgaacgtctctcaaaaccagccagcacttcactacaccactgtctcccctcatgattttctctcttcctggattccccttccccagtaccctaatacattgttggggttttttttgccattcaagagccagttcaagtgtcaccacttggatgagaggttccctcatttcccaaggcagaaatatatgagtcttctccaacctttcagagttcttcattcaaatctctcactgttttggttacctggggttttctgcctttctcactgaaatgtaaattagccaaaggcaggaccattttcttacacatcttcgtatcccccacatcttgaaagtgtctgacaccaaaggcattaatcaaatccagatctcttctcggcactgtgttgggatgaggaacaacagcaaagctgtccttccaatacatggggcagcctaaacggggaggaggagctgtttcctttgagactaggttaattactgctacaaacaactatttagatatcaaattacaaaaattaacattaaagcaaacagtgcggttcttgtgccatgctcggagaaactgtgatctagaaagcagtagttttcaaacctttttagccaaggattgctttgttcaaatgcagtattacatagatacttaaatgtataaggtcttattttatttcatcatcttctttagtttataattttagtttaattttgactcaaaatatagaaagtgtgtctgtgtgtgtactaccgtgtacgtgtgttttaagagttaccattaaaaacaatcctatggcagaaagttcacctaaagcagtagggttttttttattttttatttttttattttttttagacagagttttgctttgtcgcccaggctggagtgcagtggcacaatcccggctcactacaacttccgcttcccgggttcaagcgattctcctgccttagtctcccaagtagctgggatttcaggcgctcaccaccatgcctggctaattttttgtatttttagtagagacggggtttcatcatattggccaggctggtctcaaactcctgacctcgggtgatccacccgcctcagcctcccaaaatgctagaattacaggcgtgagccaccacgcccagccaagcagtagttcttaatagagatggcactgctcctacaacacagtgtaaatattttgggggtcattttcagtatattaaaaactgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaaatcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctattcaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcaggaattactttgctgaaacaccatacgaatatactttaaaatagctttaacatctattttgtttttaccacgtagcaaaccacagactacattttcactaagcaaagcctgactacaaaaacaaatctacaaagatgacagaataagagaagctgggagactgctgtttctcctcactcatgactatgtagatctcttattgcattgctgatctgtcaggtttgtgctagtttctattaaattgagtaaagaatttagaagcagaaaccagagggaatgtatgagatataccattatatttttagtgcttggctttatttttgtttgttttgattttcctttataagaatactgtaataaagggatttgtacttgatatcttctgagtccacgtgtctccccagcctgtcttttgagtgaacctaggtaactttgaaataaagattaagaaaatattggcccattgaaagatttcctcactaagcaacactttcattgacactgctaccctggagaaatttcaaaaccacttgaaccctctccttttttctcttctctttcaagctgttttcacacatacaagtttttcttaaaaaaaaaagataatagtagacaacgaataatagaaatatatttgaactgataaatatgccattttctgaaagtagtttatatctgtccataaaaactcagaaaagagccaggatcttgggacaataaactataattgatttagtcatattgttcaatgccttgaaggtaaaatgttattttaatgtaaaaatataaaaaattaattatttaatgtaaaatgtaaaaaatttatttttgtaaggatttggatcagattattttaaatcagttaactattgcagtggatttaaaacactgctgttataatcacgcaaatattactacctaaattatttgttatacttcagtagcccaaaagtggtagcaatttatccataatgctgtcttaatcactcacagattcttagccaatattagcaactaaccgaggttcaggagaacattgtttgctatggtgagcatctatgaaatgaggtcatttgtagtatgagctgcaaagttggtcttcccaagttcaaaattctgactctaccattactagtgtgtgaccttgggcaaatgatataatttctctgtaaaataaagacaataatagtactttacctctgggaaggtgtgagcagtaaagtattcgtgtatataaagtgcttaaaacaatgtctggaatataatggtcacattcaaattccataagcttccactgcatatgtatagagcacctactatgtgcaagactgtatatgccataggaaggagttaaatcaaagcacataatttttctggacctcaacagcattacaactcagaacttttctgcgagaaggacttctaaattaaaatgtcttagcaggacagcgatggctctttatgatatggctcttgcatatgctctagcctcctcttcaactgttcgccctcacacagtttgctccagcacgacagttactaaatgtattatccatagtttttctttcttccaggtctttatacaaattgtctcctctgcctgaaattccttacttgccatagcttgtctacctagactccttctagttagccttcagaactctatttttctttaaagcttttccttttttctggtaccaacttcctaacccactattcctcagcaattctccctccataacaagtttatactttgcatatgtttataaattttacttttattattttgtatttacttgaggccaaggacacactgtcttttcatctttgtgtctccagttccagcacaaaatctggctcataggtaggcagaattattattctcctttagctcaaaggccctcatatcaagttatcaagaaagacttccaaagagctcttacgggaaaagggtgagaggacataataatcaaaggcgacattcactgtgaagctgaaccgaaggtaggcgaccttccagaaccattctgccatgccctctaccccactctactttacaatacatctttgctttttctctctccttttatttcttttctccctttcctcgacctttctttaacattatcatcttctgttccctttctttcctccttgcccctgctgatttaaaatgttcattgtttatttttttctctacctgtctcgtggcagccccatctaattcagagtcaagatgcaagcagccaccaaattggtcctccagctaaacagtgtcctcacccccaagcatgtttattccaagtggagatcagggactcggtgatagcttcatctttttgttttaaaaataacgaattgtattgaaatgtccagaaaataagattagttcattttacatgatgattgttatctaacatagcccagtttcctgtgttttcactgagacagttcaaaagaaacctggatacactgttacagtggcttttcctccagtgggtacttgtgtgaggtttgctttgctgagtagctgtttatacgaaacttgtgtaggtttctgtgtttcaccctatcaggcacacaaagcacagcagttcctcttttcagctacattgtcgatatcaccacaaccgtggatatcatttgaagtggtgcttccacgtggcctggacagccatcttctgcccacagtgattggaactgttctgtcatctcacctttctacagctgctgtcattcatccacctttcttttccggatctgctaatgtggctctaatgcgatttacctggctgctttccaggccctcatcagtagtgaatctgttttgctattttgcattaagtagtcttaagcaccagtgctactgacgtgaaaggcaaggtacttccataaaagcttgaatgtaataatctaacagttgagccctgcataattttaccagtgctgcaattacaggaaaacatataggcagtttcccaaagtcagttgtgctgctgttatcttccattggagattgatgccgccttgcctctactctggattacttgatttggccattcccttaggcagggatagttggatccgtatgtacaaggcaccccacacaatgtatcttactgtttattgaaaatctcgtctcccttggcttctgatactcaattctctaattctctttctttccttctaacattctttctctctctctgtctcctccaattgcctacaggtgggtactctccaagcctctgcctctggcatttttctacctctatgatttatttataatttcaggatttccaatactatatgtaaatcacactcaaaactcagtcctcaaacttgatatctctgttgaactctcctcttttgttaaattaactttattgaagaatggtttacatacaataagatgcacccattgaaaatgtatagttctatgcttttagtcatatacaagcaatgtaatcaccacccccaaaaattgcttctagttcctttctagcaatcgctgccctgctacctctagttatgggcagttattaatctgcttttctgttattacaaattagttataactgttccagcatttcactaaaatggaaccatgcacgtattctgtgtctgatttctttcacttagcacaatgtttttgcaattcatcttgcatgtttcagtagtccatttctttttattgctgagtagcatttcattgaatggatatccatgagttgcttatccatgtatttcttgatagacatttaggttatttctagtttggggctttttctttctttctttctttctttctttttttttttttttttgagatgaagtcttgctgtgtcaccaggctggagtgcagtggcgcaatcttggctcactgcaacctccgccttctgggttcaagcaattctcctgtctcagcctcctgagtagctgggactacaggcacatgccaccatgcccagctaatttttgtatttttagtagagatggggtttcaccatgttggctaggatggtctctttctcttggcttcgtgatccacccaccttggcctcccaaaatgctgggattacaggcgtgagccactgcgcccagcctagtttggggctcttaagaataaagttgcagtaaatatttttgggcaactctttaagaggacatatatttattatgttttcgtttctcttaggaagtgcctaagtatagaattactatgtctggtagtacagaagtatatttgtcttactttataaaaaagaactgccaatctgttttctaaagtggttttattatttatatctccacaggtgatatatgagagttctagttgctctacatccttgctaacacttggaattgtctagtctttttcattttagttactctagtatgtgtatagaatatatcattgtggttttaatgtgcaattccctggtaactcacaatggattgtagacctaaatgtaaaagttaaaactgtaaaacttctagaagaaaatatagacaataatttcatgaccttgatatagacaaagattttcttaacaggtcaccagaatcattaagtataaaagaaaaacttgataagttaggatttttcaaggagtcaagccttctgctttgtaaatataccattaagaaaataccaaaaacggctagtcacagaatgggagagaatattcatttcatatatagatataaatatatatgtaattaatatataaatatatataatgattatatataatgacatagaagtcatttccataatatatatattttaaaacttcttacaattcaatacaaatatgagcaaaatatttttaatagacactaaatcaaagaagatatgaatggctaagttcatgtaaacatgttcagcattcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtttgagccctcatctatattgtaagagtctcttaggaggtgttcccacaacgattttccatttatggccagcccattgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgctagctcttctataaagctcctgctgaataccagtattactcatttaatatacttttcatcttccaccaagtggtattactataagctcatatcttccttactagatttttaagaaaactgtagaggttgacccattcctacatagtgccaactacatgttatatgccctacaaggagaaaacagtcaacaaatgtttgtgtcatggataaacagcttgatgatgggatataaaatagaataagccatcattcttacaatctgataagagaaatagaatatgcatggaaacaataacaacgtagcatgtgatgcataataaaacttgtgagagacgtgtagaggagtcatcatagggtaatttggaattaggttagagaggtccatcaatatcaggctgaggttagactttatttaatagttaaagatgagccaggaaccattcaagatattcaaacacagaagtaacataattacagttttgtatcaatctggcagcagtgtgtgggtagaatggattgtgacgggggaacctggaaggagagaaaggcaggacagagagaactgaaggaacactagcgtgagataatgaaagactaaattgctagcaaaagcgcagatgtgacagactctgtgaacatgctgttgacaggtgctgtgtctgggtctgaaggtgtgtagaaaagagaaaatgaaatataatttcagagaagctgggtaaccattccagggttatgccctgtagggattggacaatacgagaaagagttgggcattagaaattgagatttctttgaccacatacaagtttaggttgcattaaataaagtggatatatgttattagtaagactacacagagggggaaaaaagacagaaatccagtgataaattcctaaaatacaaaactcatggaagagtaaagaagttgatgaagagataaatgagctgtcaaagactattgggtaaagtagaacagcagtgtgtcatggaagctaaattaagagagagtttcagagaaacaatagtcatttccatgtgaaagaatgttttttaaagtactgcttaaagtttggaagaaacaaacaatagggaggctctgagcctactccagctccagaagctgcccgttgaaaattttaagttaaaaaaaagaaataaaaatgattaaagcaggcaatctacccttatagtgttttcagtctaatggggcagaagtagcagacttcatcctcatcatcaccattcccatcattttccgagtgcttagtacaggccatcatctgtatattgaattataattttgctaaccctatacacttatgatcccaattttatagaggagtagaaagtctcaaagatgttatgcagaatacattttagtacagggtttaataaagtacatattaaagtgagatacaagtgagctaagatcaaaggaaatacaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatactacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttcattagagagctggaatcagaagccaagttgcagggtgcaggatgagaagttaagaagtgaggaaacagagtgagaatgtgaaagcggtgagcgtgaactgttctcttccataagaggacaagtagaattacagctcatgcacttaacaagatgcagggcaattgggtatgtgctgcggtagtgaaaagaaggagatgaaaataaataggttttcattaccaaaggcagagctaactctcctgcctacttccaaatgctaccacatatccacacccttgatgtcattactaatccctcatatatttgcagcagaagttgcttgtgaacctgggacagaaatgttgatggcaatccaactgataatcttgaatgtgagaaatccttttggatatattcatatggctaatttgctttgactataaagtgttgctgagacctcattaacaaatttgcgatatttcccctgcttctttgatcagagtctccctgtccttggaattctccataagcctcatgcatatagcacttgccaattttatttgtatgttctagttatttgccttattcttccaaattatcctatattctgtggtggcagaaattgatattttgtatgtactgctcctatacagcaggcactaaataattacttttggtttgaaataattttagatactatgtttccctattataaatatgtgtaaaaaattgacttgtagagatatcttagttttctattgctgcataaaagtttaccacaagctattcctctgcagaactaatagccctagtataaccatgagaaaaatatcagacaaatcccaatttagagacattttgaaaatacttgaccagtacttctcaaaactgtcaaggtcatcaagaataaagaaagtctgagaaactgtcacaaccaagagaagccaacggacacatgacaactaaatgtaatgtggtgtcctggaacagaaaaactcagaaaatctgaataaagtatggactttagttaacaataatgcatttacattggtccattcattctaataaatgtgccatattaatgtagaggttaataataggggaaactaggtatgaggtatatgagaaatctctgtacagtcttaacgtttctgtaaatctaaacctattctaaaaaaagtttgttaaaaacatttgctacaatattagtggcttaaaacaacacaacgtttattatctcacagtttacatgaattagaaatccaagcccagcctaacagggtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaattgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaaatttaaaggatttgaactgaaaagcatccttcttattctcattttcttctctccttctttttggtgtcattccattatagccactaaaatagtgtatttttgcagggttagcagcagcatggttattatagtggtgatatcttccagtgcagattctttagagtctgagcattgtttaaaaagaaaatgaaagctatatcagttcactattaattattctcagtctagtgaatccttcaaaggttatattttggtgatggtgatcagttcatatcaacaggttcaggaatgtctatttccaatctatgaaaacaacatagattccaggttggagacacggttccaattctaaacttttgcttaaaataaaaaaatgattaggaagaagtagagtttctgtgcttaatttgatctcagttgtacaacttgaaattatgagctagtatacatgggattggttattagaaattgctagcttgacacattcattttttaaaaagtaattatatattgcaaggtgttgatattgtcttttataagaaatatgcatctaaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgaacaacagagtgaaaccctgtctcaaaacaaaaacaaaaacaaatggtaagtaaaattctgagattctagaaaaaagcgattcgtttactgaggaatgatttgcactggcaactttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtccagcctacactgactttgaatgtgtttcccaaaacataaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcgtccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcaatgactttaccatctctgcccaggatcattgtcacccaccgctcctgaaggagagaatgtcccttaacaagaagagggttatagagcggcttgggaagctagacttcatctacttatcatcttctcttgggctagttatgtctactttggattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggcaggattcaaaacttagccaaaactaagttcttgaaccaaccaggttgtctgctactacatactgcctcctcctcccaaaatgccagtggaagactgtgtgttatatttaatatgtaacttgtattgcacgtgtatataacttctatgtaactttacattgaaaattgtaccttgctgcttttttcctaaaatggtgtattagtcatttttatactgctatgaagaaatacccaagactgggtaatttataaagaaaaggagatttaatggactcacagtaccatatggctggagaagcctcacaatcatggcagaagatgaaggaggagaagaggcacatcttacatggcagcaggcaagagagcatgtgcaggggaactgccctttataaaaccatcagatcttgtgagacttatacactatcatgagaacagcaggggaaaaaccagcccccatgattcaattacctcccatcgggtccctcccacaacatgtggggattatgggagctacaattcaagatgagatttgagtggggacacagtcgaaccatatcaaatagtctccaaaatgttcccattttatcgttttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaaactaaagtcactccagagtggcagagttgtcactttaaagataggccttaatgtaatgttaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggaaggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaataccttcatcactatcattggctttgcacatgccatactctcatttactttacaatttgctaaacctttttctctctctttggaaatcttgatcctcaagaactttccacatgatttctttcatagttcttttgcattctttttctccttagaaactttcattttttctacattggcacaggaaacatcaatatttgatcataaagctaaagtgatagcctggcacagtggctcacgcctgtaatcccagcactttgggaggccaaggtgggaggatcacttgaggtcaggagttcgagaccagcctggccaacatggtaaaatctgtctctactaaaaatacaaaaattagccagtcatggtggtggcgcctgtagtcccagctactcaggaggctgaggcagaagaattgcttgaacccaggaggcagaggttgcagtgagccaggatcacgccactgcactccagcctggacgacagagagagaccctgtctcaaaaaaagaagaaaaaaaaaaaaaaagctaaagtgctccatggttatattaaccttccccgctaagtttccacacatctcagtttagtacatgttgagctagtgaagctgggattctagtttgacttttgaacggcttttttttaactgagatttctatctttagtttctttttctatgtggcaataatggaatgagaactttaaaagttactcaaaaacttcatctgatgaagtaggtagctgtcttggcaagtaaatgcaattcctgaaaattttttccactggaatgatagctattatggctacaagataaggtatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaagaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatcccttaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccatagtatgagataaatgtttagcatccaaatataaagtacttttaatatcaatttaaagcagagcatttcttttattttaaaaaatagggagttattaaagatttttactagtattttaatcataagattaaaatattttatggaaattatgcaaaagtcttaatgaagaacagaatctgaagaccagtagacatgttagtggtcaattccaaaagacgaggcaatgtgcataaaagatattgttctctttttcaatgtagtacttattttcgcctctactcttttattcacgttgcctctctttcacccatcagcttcgcatgtgtgaattttacacatttttcatgatacccctttcataagtccattccagttcttctcttctttctctggatttccacttttttttaacttttgcctctgtcttagtccattcctgccgctataacaaaatatgtgcgactggataatttttaaagaacatgcatttattgctcacagttttggaggctggaaagtccaagatcaaggtaccaacaggttcagtgtctggataggggcctggtccttgcttctaagatggtgccttgaacactgtctcctcacacggtggcaggtggaagagcaaaggggcaaatactgtgtgaagcctcttttataaggcattaatcccattcacaagggaggagccctcatgacttaatcacttcttaaataccttgacttttaaaattaccacactggtgatgaagtttcaacatatgaattttgggggacacattcagacaataatggcctctgaggcaattatcgttaattctatctggaatcatagtcatttatctcttatctcaattattatgattttctggaaaattaaggggatgccttgatttctttttatcacccttgtccagcccagtggctggaacataagggttcagtataaggttgacagagcattcagttattgggggtgttagatggatagagtgatagaagtaaagatgtacagttgctgagaagtcaaagaataaaagcaacagattcaaaggataaaggtttttttaatctagaaattttaaatttgtttccaattccaagtgtcatagaggttgggaaaaataaagataattacatttagtgatgagtttatcacctgtgactttacagtgtatggtttttatagagcagatattaaaattttagggagggtattcaaaagtcaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggcctagaattaacataccactgctgggatatatagagtataatgcaaagtaacacaagcaaagtcagtgatacacaattcttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccatttaaatcttccttaggatgccccacattaaagtaggtgaactaatcacataacattggtgcaaaccaatgagatttctgaaaaaaatattttaagtgaatcctccattaatggagagttgagaagattatttttagatccaaaagacaggatttaatagtaagtgagatgaatgagatggataaagggtacagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggggaggaatttggcagtggataggatgtaaatgagtaccaaagaagatggagaaggctaactttactgaagactaaaatgagagtcaagaggaaatggtatgttcaacaaaatgcaaataggcaagaaaggcttgcttctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaggcatatggctattccggcttagagttgttgaagggcaaccactatgcaaattattccctcttctctttacctctttctttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcttgagccaccgcgcccggccctctttacctctttctatatcttccatctgaagagttggaagtgtgagtggtgagaaatcacatgcatccagaggagacagactctaaaggacatacacaactctatggaaggactagactagcagcccaatcaggtagttaaagaaagaccaaaagttattggtttttctttagggagatggcatcaaagcattttgagccagaagttagtgctaagtacctgcaggaaggatgtagaaacaagggtcttgtcatttgcagataaccaagcaggtaatgtggcagccaatagcagcagcccagccttggtgatgactttactcctatcaatgaaccaacaagagaaggttaggtcaccattcctggagaaatggaatttaaaatttttcatgttaacagcagtttaggagaatgaagcctgttttagaaattagagtagaatgtaaagtatcaaagttttgaaccccaacatcagaagtgaatctccaaatcagaataaggcaaattaagaaagctagaactccttaaagtccccagaccaaataaaaaaaaaatagggttgggtctggaacctgtaatatgatcattatcattaatatagtgattattaagcactttacttgaatcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcactctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattaccctgattaacaatgaggaagcattatttttccagagaggaatttgagtgcttttaccaaacaatggatatgaacctggagggaaaaaaaaaatcaattaaaactccaaaatccaaattcaggaaaattaaatgaggaaatctccccagaaaataaatagaacttgctcagataagagaaaatggaaatttgagtcaaaataagcctccttagtcatcaaatctagatactccctcacccagtcaacaagcgcaggtagcaaaatagtcttcccataaagagtaagttggtggatgaagttgcacttctatggataaccacactctgtagtcatcgcctgaatgcattgtctgaggtttataacttctatttatagaagttcagcactcaccaagtgaagagctctgggctatagatacttgcttccttccatggacagtaaaaagtgtgttcaatcttgacttaaccccaagtgagtagaactcaggctgttagtgattgaggcctcaggcttggtaatttataaaatatactttgcttttctgttttatggaggaaaacctgcttacttccatgctttggaaaaactgattcaaaacgtgtctaatatgctgacttcaactaagtgtatagtaactgataaatatctcctaatggagttttatttttttttccaataacagtgttatggtagttgaatatatgtttttcttaacaagatagatgattgatagatagatagatagatagatagataatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgaatggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcatttaactttctcagataaagtcaagtaatggagaaggaagttccagagctagttgacaggttgagccagtaattctgagccttctctgaatcattaaagaacagctgtggcagctccaaacatcatattcccacatagcaatacaatcaggaagtggaatggtggggagcaaaggcaaaaaggatcttttcccctagtgctctctcttttatcagggaggaaaatattttctgaaagtctcctccaggtttccattatatcttactgttagtgctaaatcttatatccaaccctagaccaatcaatgacaaaaagaaaaaaactataagcttgccacattttatcatgtttcactgtattgcactttaaagataccgcagatttttttacaaattgaagatttttagtaaatctgtgtcaagcaaatcaatgccattttccccaaagctacgctcactctgtctctctcatgtcacattttggtaattcttgaaatttttaaatctttttcattattattgtatctgttatggtgatcggtgatctttgatgttactattgtaattgggggcaccaagaactatgcccatatgagacagtaaacgtaatccataaatgtggtgtatgttctaactgttccaccaaaagccattgcccagtctctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagcaaagttgtgaacgtaaaggaaaagttcttgaaggaaaagtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtgctgatggagaagctgccacaagttttccagaagactgatgaaggtggccacactaaacaacatgtcttccacgtaaataaagcagccttgcattggaagaagactttcataggactttcatagctagagagaagtcaatgcctggtttcaaagtttcaaaggacaggctgactcttagtagggatgaatgcagctggttgaagccagtgctcatttaccattccaaaaattttacagcccttaagaatgatgacacagctactcttcctatgttctataaatggaacaacaaagctggatggcagcatatctgtttacagcatggtttattgaatattttaagcccattgttgagacctgctgctcagccaaaaaaaagattattttcaaaatattactgcccattgacaatacacacagtcacccaagagctctgatgaagacgcaggaggagattgatgttgttttcatgcttgttaacacaacatcctttctgaagcccatggattaagaagtaattttaactttcaagccttattatttgagaaatacattttgtaagactgtaactgctgtatatagttattcttctaatgcagctgaggaaagtaaactgaaaatcttctagaaagtattcatcattctagatgccattaagaacattcatgattcataggaggtcaaaatatcaacattaacaggagtttggaagaagttgattccaatccttatggatgactttgagaggttcagaacttcagtggagaagttaaatgcagatgtgataatggcaagagaactagaattagaagtggagcctgaagatgtaactgaattgctgcaatctcatgataaaacattaacagataaagaattgcttcttatggatgagcaaagaaagtggttccttgagatggcatttactcctggtgaagatactatgaacattattgaaatgacaacaaaggatttggattactacataaacttatttgataaagcagtggcagggtttgagcagattaactctgccttcaaaagaagtttggctgtgggtaaaatgttatcaaacagtatcacaggctgcagagaaagctttcatgaaaggaagagttggttgatgcagcaaacttcatagttatcttattttaagaaattgccacagccaccccaaactttagcaaccaccaccctaattagtcagcatccatcagccttcaacacagaagcaagaccctgcacctgcaaaagattatgacttgctgaaggctcagatgatcgtcagcatttttttagctataaagtgtttttaagttaatatatgtacattgatttttagacctaatgctattatatacttaacaggctacagtatagtgtaaacagaacttttatatgcactgtgaaaccaaaaattcatgtgactcactttattgcaatattcattttattgtggtggtttggaaccaagcctgcaatatctgtaagttatgcctgtacaaaactgacttaatttggtcataatccatctcacacatctgggaaaggaacctactattcttgagtaaattaatccctgcataataccagaacaattcagcactctcttagcaaaaagtaaggaagaagaatgtctatgtaaccaggaacgtttttcataagagtaatggccttctacaagactctgtggaattgaaagatttcttaaaatgaggtgcccttgtgtttgcagtatatgcagttttgtctcaggagagagttttgggtctactgagaagaaactgaggtatactgataagtttcactgcttgtgtattgtagtggataatgtggatttctaaatagatttgctctgccacattattagacagatgcctaataatttaatgtacattaaagtatgttaatagggagaatgtgtaatcataaattaattaccaagattatgattatcccaattttaaacagtgcttgaattaaaatatatccctagaatacaaaatgaatagtggcttacgtgttctaaggtgagagataagggctctgcaaccacttgtggctttggaaaatgacatattttgcagtttgaaagcatggatttcagttaaacattaaaagcagatgactgccatgactatctgtaacatgatcatgcaggacaatgagagaaacggcaaaagaaattctgcctttcggcacatattttctctactaatatttgcaatgccaattttcaacagcacaggtgtatttaattgcctctgaatattgcaatgcaaacccattcaatgttgaaaacaggagcccaaaaaggaatctcaggctttgttggcctgcagaatcttgtagctccagattgattttaatatatccagggaattttttttctttgtcattgcgctttctttagaagggcatttaaattatcaaaccattaccttatcaagcacaaatgtgatgccaattcttgtgatttctgagttatatgtgctaaaaattacatgagttctattgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtacttacacaatatgagaatattatattttacgcagggtatacccatgattcatctttaaattaacttcaggaaatctcaaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgggaaaatagtcaacctgtatccttctcataccataaatcagcatgtttgatcactggaagcttcattttgatgattagcagtcatgtattgaggctaaatgatatgtttgtcgcacagctaatattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacccccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagaatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaaactgagagttcttccaaggatagagtgtgtaaatgctgacctacattaaatacaagtgacatggatttctgggcatgtgggacgccttggtaatttgagtgacaaatcacgtatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaagcactagattttgtgtagaggttaccccttaggaagagagaaaaggatgcaatcaaaggtagtcatatgtggccttagtagtacccatacttttttatttcttcactgagtgtgggtaaataaataattttttacttgacttaattttaataatatttgaaagaattaaagaagtccatgaggtaatgtgaaaacttgtaatgaaaaaggctgaatacaaaattgtatatgctgggatgacaactctaaatgtttgtgtggagatggggacaagaagaaatagaaagagttaacttgctaagatggcagaattatgagaaatttggacagaaattgatgagaaaagtgatttgaggttttggtgatgaagaaagggagaatataacctaaggaagattaaagatttcacataaaactaggaaatgtttagcataaatcagtttcaccaatttgaacctggtcttcctctctgtcctctcccttgtactcaccaaatcattttacaatcttccaataaggaaaaatacttcctttggtatgaatgtctagaattaatatttatagttctacaaaaaaattcagagctcttaacctaaaacaagtgaaagtacaatcattgtttttaaatgttacaaatacaatacctgacattaaattgtatttcctctatattgcatattctgaatttaaaactgtctaacacctttaagcttaaagcttaaattaggcatgtaaaacaagataatgacaaaagaaaagaaggccggatgtggtggctcatgcctataatcccagcactttaggaagcaaagactggagaatgcttgagcccaggagttcaagatcagcctgggcaacatatggagaccccatctctataaaaaaataaaaatattagccaggcattgtgtcatgcacctgtggtcccagctactcaggaggctgaggcaggaggatctcttgagcctggaaggtaggggctagagtgagctatgattgtgtcactgacctccagcctggatggaagagtgagtccctgtcacaaacagaaacaaaaaaactcatatttattttcagaagggacttgattatgtggagccatatggggcaaagtgcaaatataccttagaactactttaaaatacctattattttttctataagtatccacagccagaaagagcaaaacttgctgagtatgattggcaaaaagattttcttttgttttgattccaccgttccttatttttcaggccttgaataaagtcaaatacagaactcttatgaaaaaattcagtgtagaacctataatttagctgcgattgttctcttggttttattttattttgatcaatttcagtcaggttcccttgatttctctgaaactggagagtattgtattctaaacgaatgacttgtctttgctagttgaagtaaataagcaattagagcaaaaggctgtttcattgaacttcaaagaaaattgtttttaagattctgttgttgttctgtggcccctaataatgcagacggtctttatacaacagaaatctgtcagagaagaaatttttattggtagctaactttacacacacacaaacacatgcacacacaacttcagaagcagaagcacaaggtacttcctcagagaaccacaaatatcatcaaagtcttattttgacataatgctactttaacaagaaattcagatttatggaatgaaaattgctgtagtaacaagtattttgaaatccaccctaatacccagaaagtgacagcaaatcccagtgcttcagtaactctgagccagttaaactgtaggacaaaattctgttgtgttctagtatcactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgcagattcttcaaacagaaataatagctttagttagtgtactttagagccataagtttaaaacccagcaggagaatataaatgatggccaggcaagaaaaacaaaactccctgccaaccttcactgcctacaaaacttaatgatctatgccacatctactatttgtaaaattctttcagaaagtatccattcttaacattaagaaatgtctaccttccttcctccaatattttcaatctctctgccacactatgtttatattctctcagaattctagtggatcccattgtctaagacttaaaagctgttattttatactggattaactttaatcatctgtatttcttccaaattgtagagattgcattggtccaattttcttttccttcaatttttaagagaagcaaatcaaaccaagtctttaaaggaagcacagcaagtctcagataattttattgtttgggcctaattattttaaatgttaccaaggaatatctttaggttaaaaaaattaaattttagaacagaatttgatatatatttcttattatttaaaatgggaaagggcattagcatttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactgttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattcttccctctgttgatttccctacaaaacaaataggcaaaaaagcagctcacaaaaaagatagagtacatagaaaagagaaaaccgaggcataagacagcactgtgtgcttcaagaaagtcctggagcaaagcttggagcacagggttcaggtgagaactgaagttatattagcataaacatatggtcgcttactgccccctctgcaatgtccagaatgcattcctaattttcattccatttgtctccaatgcgtgataggacttcaaagagtcatgattaaagaaattgttcagtgcaattagtcaccacttacaagtcagtgagctcgcattctggggtgagtgctaagctttttcaataggagatagcacactccattcacttctttgttgttctttcttaagatccttcttctggtgattttttttttttttttatgtccagagttctactattttctttctttctgcctaataatacttaatttaaaataaatacatcttttcagaaataataatttcatccttagtgaaaacatttacccatatctgcccactatattttgtgttttatattctttcatttaaaagtattaagatgaacttcaattataaaatcttacattgcttgaaagacatttgcctaaatatgttatgtgtctactgtagtttttcaaaaaattttgatttaagaagccacaagtatattaaaataattctatttcttccaggaaatggctggatttagtgatcctgtaaggttaaaaacattataatatttgtatagtgaccaggctcttgatttagatggttacatataagcaaaatactgaatgaagacaaaaaacacagctatcccttttattaagtttcatagcttttaatcccctaaggaaatcctttagctatttcactattttactaaatcatattaaaatgcaaatttccactaatattacaattctagtcaaaaccaccaaaagaaaacatgggctcttaagcttttttttttttaagtatgagcacagacagcagaaaataaagctttcctgtaagtgaatatggcatctacatttgaattatgtacacagtaaaggactaaaaattgtgtggtcctaagtaagtttaaattctattgtctttgattgatttgaaatagaattatcagagattggattaataaaaagagcttgacagttcaaagaagtaagcttgtgattgggctatgattttttccaaggattttttgggcagtcatattattttctgtaccttaaatttaccatctatgaataaagataatattgactgcatgaaataataagcccagcaactttttttttttttttgagatggagtctcctgtgtcacccaagctggagtgcagtggtgtgctctctgctcactgcaagctccacctctcaggttcatgccattctcctgcctcagcctctcgagtagctgggactactggcgcccaccaccacacctggctaattttttgtatttttagcagagacggtaaactattcagtggaaacgtgataaagttgtttctcaatgaaaaatgatcattataatgtaaatgtgcatgtaactagttattgaataataaaagttgaactcaaggtagctttttcagtcacttcaaatacttggccaattttgaaggaaaaaagaaagcagcacccaaaagtctattgttgttgatgcactatagaattgagagtgtgttcaagcaaaatctagcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgttagctactttagctattctacaatatggtgtttaggatcaaaccagttgaggtcatgtgaaagggtctcagaaagtgaaaaaaactataaatgaaagaattagacaatactgcaagtgctgcatgcaagaagagtaaaactattagcattactaatacaatgttaagagaatcttttcaagaggatctgctatgcaaaaattatttagaaaaactaattgacagaaaacaattgagtctttctgtcatttccatagtctatccagaataaagagtaatgaacacgtgcatacgttttctaaataatctggaaaagttgatattttttaagtgtaccacttagatttaataaggagtccagtggagccatgcttacactataggtaaacaatatttgaagaaagctttctctgcctctgattatatttttatttattcaataaacattttctaaagacttagcatgtacttaactgacatttcatggaaggcaaaggaaaggaagaaagcagtatccctcttcaggtagcctcccccatgttagaaagacaagtcacaaagctactagaaaacaaagattgatatatgataatacaaaacaaaaggagtgaatacatgcagatgtgaaacaaaataaagggcttatatatggtattactcaggtagacatttggaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagttgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacgccctgttcttctccacccaagcatagcagccatgcaattctgctgtcaatgcaatcaaatctttccaagttacagagaattctaaaaacgtcctcacttgtttctagaatcttaaaagaaaggtagtggaggaaaaaaaatccttccaaaaaacaagtaataaggcatttttgtttacttattgcttatagctgttggccttaaattataaaatatcagggaatatatctgcccctttagctgataatcttttatcataattgaatttaatctcaataacattaaattgcttagaaaagaaacaaagtagatattaagatattgaattattcagaagctatcaacaggggccatgttcaattcttggaatgaatttctttttctcaggcatctttgccaaagttggaaaacaggttaacaaaattgttaaccaaattgaaagtgtcaaaataaagccaaatacaaattgggtcagaatccaagagctgcctattgtgaagtcttctaacgtaaaagttgaaaagaaagttagcttccttgacaaaagaaaaaaaagactaagaggttatgtgtttttagttttgaacttagaaatcagaactcaagaaagacatactgaaaatttcataggatgaatggatttccctttaaccacaatattgtgttgtccacagcatgaatgaaaactgttacaaacttccaaaggcttcagatgattagcctgtgaattgccttcacctctgccaacttacctggcatcctttacgtttaccagcgcacttctccctggagcctgcagacagcaagctcctgggctgactgtggaggcttatctaaatcctctgaaagttgtgctggggtttatctctgcctgaagacccatcattttgcatgtcaaatgtcagacattccaatactgtgaagatatagatggctttgccttatcatttaaagcagactaatattattataggcattttataaaattaattatttgaccaatacatgtgcagataaaacgtccttcattcaactaacttccatcatcaagactaatcattgcctgcagtgagaaacatcagtaaccttaataagttattcagtagggactgtgaatttgttcaacagcacaggaagtacagaaatcagatcaaagggtagaggatctggtaaaaatttatcgaagcatagattgtgactttgtgtatatcaaaacaatatgatatactttactaaagttttgatgtattgacagttgagtttatgggcaaagagaggcagatttacgattctattaaatgttaaggatttttaaaaaatcatcgaaaaaattgtattcatttgacatgtaaaataagtttgccgtgactatatagcagaatcaaaatccattaaccatggattaatcattaaccctttaatttggaattaagatgatatgtggtatttttcacagtatttcatatatgttagtcaaatctgcccaagcagactgtaaactaataaattatttcaaacttgttcaaatggatgagtgaatgaatgagtgaatgaatgaatgaatgagtctctcttctagattactgttaaccacaatttatctgccctaaaaagtcacaggtaactgacccaagtcaatggcttggagcatttttacagtatttttgcacagacatatattccagtttcctctttgtcaggaacacaaattgaaaagagaaatagagctatgtgggaggagaatgtgacatgtattcttaaggagacaattctgaaggctatttggagaaggctacatgaatttactacaaggaaacatcttttcatctactatgatagaaaaatctaatgcagattttgataagtctgtatcatattgaaagctctgtttaacagagtaatcactggctgacaaattagattaaaaggagtctgaaaaccaaaggaaagaaaggaaggaaagagaaaggatgaaagagaggcaggtaggaaaagaaacggtgtcttccaaatactattttcaccgtggagcaagaagggctttggagcatacctcagaacgtagctcctccatgaagtcgtttttgaattccaggccccttttatcttgcccttctcttttttttttttttattgaatatcaataaatttattgaatgccagattctgggctcaatgttttcatacatttgttcgcttaatccttacagcaatcctgtgaggcaggtagtgttctcttaatttacaggtagaaaactgtgaaacagagaatttttttattgtaaataaagtccctctccatgagctttatatatatatcttgcccttctctaaccagctacctataaatcctttctgctccactgaattttgtgcttaactgtattgcctcctatctctagttttattttctgggagttagtctttctaagctcctagggaaagggaaccatcctttctgtgttctctgttctctcactccacctctgcataagttctctcactccacccctgtatagtttaaacacacagcagattgtcagtaggaaagaaatgaacggttaaatgatctgatgcaggaatacgtttttcctttggccttggtgtgtcttgccttgatgctctgagaaacaggtttttaatttggagtccagttgtcttccagacctggagaacaataatctgcactcgggtaccacatattaccaactgtatgaaaaagtacacacacacacacacacaatgcacacacggatatatgcagtttcccatgaagagtccacaacttttatcatattttaaactggacatatgattcaaaaaaggtttagaactatcattctaaaggaaaaaagatacttcagtaccctggggccaagaattggtagtctttgaagccattttaggctataatgagaaattcttcatttggacctctgattgatttaatcttaaattatgttctatgagactttacatactttttcaaatatgcatttaatgttctgtctccagaggtggctaatgagtgtattaatgcacatatttccagaacttttttccatttgtattgtataatttagaaaaagcttgtttttatttttgctgatttttgaaaaatgattatccttgtgtgtttttgaaaattattcataaacagccccaaaagcaagactttgaaaaagattttttgtgctagttaacagcagaataattatttccatattatattctgcaccttgcatctacttataatgatctagaaagatgatggattattttgagtaaaactagaaattggcaaaaagcatcagtaaatataagaatgaagaaacatgtagattattcataaaatgaataatgcacacattagtgcagtggtgaagcattcataagacaaaatagagatatgttgaaggtagaaaatgcttgaagttactgctgaatttttgtggtgaccatagcaatggtattacctgtattgtcttgaggctcttggctgaaatatctgggactgttacaaatgtacaagcttatatttttccagggatgaaaatatagctcatcctgtgaaaaagatatggatttaaggttgtttcttaatatgataaatgccaatggaactaataatacaaatctgcccttaaaagtgaaaccaaggcagaaatacaaaagacaatgaattatgccgtagattaaaccaagatcccagtgagtaaatctaccaaagttttccagcctaggggacagaaatagctgactatgaatgggaatgaggatgaagagaatcagtgctaaggaaaagccccttgagatagtggcgtacttcaaagactgtccgctctacttctacttgagcttaagaacatggctatgtgggtttccttcaagtcatctaatatttattgagcactgactcaggcattttagggactgcaaaaaagatccattgggaaataaatgcgtagaaccgcatagagcctgcctccccttagccatagggcacattgtataaattagaaaaggggctcctccccaattgttcattcagtaggtgtgagattcaatgaatgtctgatgaacaggcctcagatttggaagcatgaacttgacatgcacagctgctagtctataataccaaagattttcctttttaaaatgtatactctgcaacacccttgctcttggtgaagatttcatctttgttttcacaatgctcaattaaagagaaagatatttggagcatttacttttaaaatatatatatgtcaggactccttaagtaaataattttttaaaaaatttatttagtgccaaaactccctggaagaagaaataatgacgtttttccatccgagagttatatttttattgtagaaagaatatttgttagttggcttcacaatagttgtatccctgaagcactaaatttgtatacaggagcctattaggccatgtagatttcatttgaaaaatgtaccgtattatgttctaagagctgagtttagcaaatatgagaaattgagttcttttagtaaaataaataagactgagattttaacacctgggaaataaataataagcttcatgattgcacaaaccatccttagcactgtatcccaatcctgagaaaaatgccttgcacatagtagatgctcaataaatatttttctttgcacaatttttaactgctcaatttatgcctacttgtcatgaaaaaacaggctttcttgataaaggaagatctttttttcaacaaaagacttgctaatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattgaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaacgggtaaaatggacagaggagataattgatgggaaaagagatcagatgggagataatatcaggtctacaccttataaatagacataaaagaagagtaaaacacattgaaggagaaatggcaaagcttaccaaccagttggatttgggagtatgtatttccccatttttccaatggggtaggaaacgacagaagcaccgacagagccatggagctgttttggagaactggtttgggaaggagataaaggatgcacaaagcattctatagactttgggaatacactcctggagtatagaatagggagtagaatagagtaactgaacgagtagtgaggcatgggaaagcatgtgctcaacaatgagtgaatgggaagataaccaaggggctgagaaccaccttaagtagcaaccacattcaagccttgagaatagaaagggaaggagaggggaaaaatgtagagatgtagcagaacatgctggtagggaacagtaacatgaaaataaaagcagaagaaaattttaagaaggattatgtgatcaagattttctaataccacagacagtgttgtttgggtttgaccaaaaaaagctattcattatcttttggagaatcctgagtacaatgttagagtcttgagactggttgcagaatgaatagatagaaagggtagataagaagaaaagacagttttttacccccaagatagcggattggagcctttgttagtgtgcctcagccacttggagagagcaaaatagtgtgtgttaccttttttctttctttttttttttttttgacaatatctcgctctgttactcaggctgcagtgcagtggcacaatcatagctcatggcaggctcaaactcctgggcttaagtgatcctatcacctcagctcctacatagctgggaccacaggtatgcacaacatccagctatttttttttattattttttgtagagctaaggtctcatgttgcctagatcttgaactcctggactcaggtgatcctcctgcctcagcctcccaaagtactggcattatagttatgagccaccatgcctggccacacattgtgaacttttatccaagaaggaaaagagaaacttaacagaaaaagtgaaagaaacttcactttcaaaggagcagtaggcagtgaggcagaaaactgtgagtctccaaagggcaaaagagggagagaccatcaccatgattctcatttccactgcagagcctggcaattcaggccacaggggagcgccttaaccctacccagcactgaagctgattttgtgagcagcgaggaggatatgaggagcggcatcaggacacactttgcaggcactcctagaccccagtgaaacagaaggaagacattcctgatcctaactcgtaaaatcctccaaaagttggcaagttaaactcagccagcgcttagaggttgccagaaactcccaactgtggtggggcgtgatggctcacgcctgtaatcccagcactttggaaggccgatgctggcagatcacgaggtcaagagatggagaccatcctggccaacatggtgaaaccccgtctctactaaaaatacagaaattagctggccgtggtggcacgcactggtagtcccagctactcgggaggctgaggcaggaggatcgcttgaacccaggaggcagaggttgcagtgagccgagatggtgccactgcactccagcctggcgacaaagcaagactccgtctgaaaaaataaataaataagaaagaaagaaactcccaaatgagattcgtgatctaatctcaagtggggatgaaccccgaaggccagagctaagcacaagtgggaagtgtgctcttgccacaggtgcgggagctggacacctctgctttgcgggtcaatccaggaagggtgtggcctgagagccattgtttgtgtcttgagtgggaagtcttgcatcctgggtcagttttgtattctgagcatgaactgcctgagattccgctggcagttacagctttcttctgctgaagtctgcaggtgtgagacacaccatgtcaggggcatgagagctgagtgggtctcactgtggtctgctgcccctctcttcctgtgcagactgttttgtgcagcagaaatggttccactcctctctggaacattaccccagtggccaggaaacttcctttcaacctccgctgctttgcatctgcacttgggcagccgcagcgcaaacttggctcacccaacccccacacagcttcacctcctttatatgccttggtagcagacaatggatagggacttttgagagttcgatggccccacccatctcctgggatatctgagtactcttcctgggtaacctaggccatgcataaatcccacagccacagctggctccctcctgaaagtgtcacctcctggcaggaggtcaactggcacagccaattacaacatctgctgacacaacatagtactcatagtgaacatgctcactgtagctggcaattgagaaagccaccacactaaggctatttataaccaaggaaatcttagagagatacatcacttccctgtcacccccatcagagctggtgcttgcacctgccactgggagaccagaggacagatcagccttgtccagctccacccaccaccagcatgggttgtggcagccccaccaggtggctagatccagaggagcaggagaattcacagtcttctgaccctaagggactgccactcctaggggaaaagggagtgcaccacaccaagggagcaccccacaggacaaaagaaaccagagagtttttctctattccagaactttctgcttgtgggcaaagaacagctgcatctctttaagcagaggcacaggcagagtgctgggctcagtggaggaagactatggctctgcacagcagtcaagcagcccctgtgctcatgaagagatttggagaagggtacttcttgtctcccttggccattgctgcaggcacacccaggaattctcctgtgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagccgcctctatcagagctgggacttttgcccactattgggttttgcatttacccagctgcttcagccacaggcagttcttacccttaggtggcttctactggcctgaaggctgaactgttcaacccagtgaaaaaatactgagggtgtggggagggaagtacacatgactggggaatgaggtaagcttcatgagacctctgccaccctagccccacaggagacagtaaacctgcttacacatccagtacatagctactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctttaaaaaacaaaacaaaaaaaacagaattagtggggcgcaatgactcatgcctgtaattccagcactttgagaggccaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcctggtgacagagcaagactccatcaaaaaaaaaaaaacaaaaaaaccagaacttctagaaataaaagacttgcttagggaattacacaacgcagttgaaaattttaacagtaaactagaccaagcagatgaaagaaattaagagcttgaagatgaggcttttaagttaacccaatcagacaaaaataacaaaaacaaaaagaaataaagtctccaagaaatgtggcattacataaaatgtcaaaacctaacaatccagaagaagaaggaaaaatgatgaaggaaggagaagaagaagaaggaagaaggaggaggaggaggaggaagaggaggaggaggagggagaaggaggagaaaaggaagaggaagaggaagaagaaggagaaggggacaacaataaaatgtttagaaacctatttgagaggacaattgaggaaatattccctggtcttgctggaatattagacatctagacacaaaaagctcaaagaactcctgggagatacattacaaaaaggatatcaccacagtatataattatcaggttatataaaatcaatgtgaaggaaagaattctaagagtagtgagacaaaataacttataaaagaaataacatataaaggaaatcaaataacttataaaggaaaacctattagactaacagcagacttctcagcagaaaccttctaaaccagaaggccttggggtcttgtctttagtcttctaaacagaagaactatcagccaagaattttgtatcctgcaaaactaaatttcataaataaaggtgaagtaaagtcattcccagacaaacaaatgctgacagaatttgtcacaattagactacctctacaagaaatgctcaaaggaatggtaaacatcaaagcaaaaggttgatattcaccagtataaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataaatttttagagatttaaatcctaccaagtatcttctcagaccacagcagaataaaactaaaaatcaattttaggaggagctctcaaaactataaaaaacacatggaaatttaaaacctgcttctgaatgatctttgggtcaatgatgaaattaagacagaaatttttaaaaatttttgaaaggaattataacagtaacacaatgtatcaaaatctctgggatacagcaagagcagagctaagagggaagtttacaatgcttaatgcctacacaaaaaagacagaaacatcacaattgacaagctaatgtcatgcctcaaggaactagaaaaacaagaacaaaccaaacccaaacctagcagaagaaaagaaataataaagagcagaactaaatgaaattgaaaccaacaaatacaaggatcaatgaaacaaaaagttggttatttgaaaagataaataaaatcgatagaccaatagctagattaaccaaaaaaagaagaaagagaatttaaataagctcaatcagaaatgaaaatgaagacattacaacagatactacagaaatgtaaagtattattcaagattactctgaacacctctaagcaaacaaactagaaaatctagaggaaatagataaattcctaaaaacatatagcccccccaagcctgaatcaggaagaaatagaactcttgaacagaccaataacaagtcttgaaattgaattaatactaaaaaaaaaaaaaaaacctcacaacaaagaaaagcccagaactagatgaattcatagccaaattctaccagtcataaaactgacatcaatcctaccgaaactactccagtggatcaagaaggagagaatcctccctaactcattctacaaagccagtatcaccctaataaccaagccagaaaaggacacagccgaataggaaatgtccctgatgaacatagatgcaaaaattctcaacaaaatactagaaaaccaaatccaacagcacatgaaaaaattaattcaccgcaatcaagtgggtttcattccagggatgctaggagggataaatatatgcaagtcaataaacatgattcaccacataagcagaattaaaaataaaaaccatatgatcgtatcaatagatgtagaaaaatcattcaataaaatctagcatctcttcctggtaaaaattctccacaaactaggaatagaaggaaaaggaacataactcaaaataataaaagccagatacatcaaacccatagccaacatcatactgaatgagggcaaagtagaatgtgttccccctaagaaccagaacaagacaagggctcccagttttaccacttccattcaacatagtactggaggtcttagccagaacaatcaggcaaaataaagaaataaagagcatccacattggaaaagaggatgtcaaactgtctctgttggctgttgatataaatgtatacatagaaaaccccaaagactcctagatttgataaatgaatttaatgaagtctcagggtacaaaatcaaggtacgtaaatcagtaccactgctatatgccaataatgatcaagctgagaatcaaatcgagaactcaatcccatttataatagctgcaaaaaacataaaatacctaaaaatatgcttaactaaggagatgaaagatctctacaaggagaactacaaaacactgataaaagaaatcatagatgacacaaacaaatggaaaagcatcccatgttcatggattaaaagaatcaatattgtgaaaatgaccatactatccaaagcaatcttcggactcaatataattactgtcaaagtatcaacatcatttttcacagaattagaaaaaaaaacactaaaattcatatggaaccaaaaaagagcctgaatagcctaagcaatcctaaacaaaaataacaaatctggcaatatcacattacctgacttaaaattatactacaaggctctagcaaccaaaacagcatggttgtaaaataaaagtaatataaaagtagacatatagaccaatgaaacagaatatacccagaaataaagccacgtctctacagccaactgatcttcaacaaagccgatgagaacatacactggggaatcgatatcctattcaacaaatggtgctgggaaaattggatagccaaatacagaagaatgaaactggatccctatctctgaccatatacaaaaaaaattaacacaacttggattaaagacttaaatgtaagacccaaaaccataaagattctaaaagaaaacctagggaaaaaaactcttctcaacattggtgtaggtaaaagatttatgaccaagaccccaaaagcaaatgtaataaaaacaaaaataaataaataggacttaaattaaaaaacttctgtacagctaaataaataatcaacagagtaaatagacaacctatagaatgggagaaaatattcacaaactatacatccaacaaacggctaatatccaagatccacagggacctcaaatcagcaagaaaaaaagataataatcccataaaaagtgggaatatgtgaagagagatttttcaaaagaagccatacaagtggccaacaaacatatgaaaaaaatgctccacatcactaatcatcagagaaataaaaattaaaaccaaaatgagataccaccttacagtcagaatggccattaataaaaagtaaaaaaaaaaaaaatagatactggcatggatgctgtgaaaatggaactcttactcactgttgatgtattaggtaaattagtacaacttctatgcagaacagtatggagagttctcaaagaactaaaaacagttctaccatttgatccagcaatcccactaatggatatctacccaaagaaaaagaagccattatatcaaaaagacacctgcacttatatgtttattgcagcacaattcacaaacgcagaggtatggaatcaacctaagtgctcatcaatggatgagtggataaagaaaatgtcagatacggatatagagatatagatagatatagatagatagatcatggaatactactcagttataataaaagaacaaaataatgtctttttgcagcaacttggttagaattggaggctattatcctaagtgaagtaactcagaaacagaaaaccaaaaactgcatattctcacttataagtgaaagctaagctatgggtatgcatgggcatatagaatggtataatgaacactggagactcaaaagtgggaaggggatgagagattaaatattacctattggatacaatgtacaccattcaggtgatgggtacactaaaagcccagacgttactactatacaattcatccatttaaccaaacccctagagctactaaaataaataaataaatgaaaagacagcagaaaatacatgactagcccacatgaatattactaatgtatagttacctatatacagcatatattacaaatctcttgaggtcttctttgtatcacttgagttcctattgttgctataatgaattattccaagtttactgtcataaaagccacacacatttattattttcccattctggaggtcagaaatctgaaattggtttcactgagctgaaatcaaggcgtcagcagggccaattctctcttgaaggtgtaggggagaatccatttccctgccttttccagcttcaagaggcacctgcattccttggctcatggtccctttctttatctacaaaaccagcaacagagactcttcaaatctccctctctctcttggactctgacatttctgcctgcctctttcacttataaaaactctggtaattgcattgagtctacactcagataattcaggataatttccccatctcaagatccttaatctaatcacacttgcaaagtccctcttaccaggcagggtaaggtattcacagcttccagaaaataggatgtggtcatcttggaggggccattatcatgtctaccacaaggtattaattaaaacatcagaagcagttttaaattaatttgccttgtacttaattattatgtatcaatttacctttgggtcagataatatatgtgagattgattcattaactagaaaatgaaaataaaatttttaatagagtttttatactagtcaattattttctgctgaaaggcctttaagttgaatgttaaaattgttattataaacttccatgtaatggtagttgggtagcaataacaataaactgatagttttctgcctgtagcagtattttgatgagactatttttgactgaaactcttattttgtatttaaaaaatcactgcattttatgctgttatttgcttcactgaattatttaatttaatatgttctattaaagagactttaaagctagatacaaattttttctccgtatacatttttaatattcacatttttaacctaacgacctaaagataaatttgaatttctcaaactattcaacctatagtttttcctctgtaaaactgcagtgatactgaacaaaactgctgcaaagaataaataagataatgtatctataactgtagccaaattgctgggccataacaggtaggtaggtcttcaataaacttttagcctgatccaaaatatattccacaagatttgctgaccaatattgaaacatgtttctacaaatactgcagatgaataatactgtgggtgttgtttcttagtaaacttgccaaattttaaatatttggttactctacacaattaaataaaattttaacatgagcatccaagtaactctatttactaaaaatggctgtttctttacatgatatatgactaatgagtgaagctatcctatagctatacaaaatgataacgttaagcattttttattttgtctatctaaaggtgccaatacattgtgaagaaaattctgttaatttcattatatttaatacagcatattccaacttaaagttattcagaagatcaactgaaggcaaatctaaaagacagcagtgctttaagaaataaaagtcataaaacaaaagtttttcagtggttataaattactttcaagttgcattatttcaaatttcttcctgtaatctcatgttcctagctctttaactccctttgattaaatgatgttcctttgctttcactattttctttttgtgaacttgtcaaatcatctttgtcttgtcttgtacaatttaagagacttttatgtagctctctgagcgactatcaccacacaagtccaactgggagaataatttatgaggttcaaaatgaagggtcattatgaatgctgtctttcccgcaatgaatacatacactctcttgttcatgcatgacaggattttaactaaatcaatggagatagatgcttttaaatgaagtattatgaatgatatcattggttacataaaataatttactttttatgtaatctttaccttgtttaataaatttagagaactggaagaaaacttctttaggtgtgggtttatctgtaactgtcacataagtatttctttggtagaaaacacaatttcaaaagttgtagttttatgtccttaggttaacatctagtatccagtcataagccagaatattatgcatagtaagtattctgcacaatgatactaaatgcagaggaaaagcaaagagagtagattttctcaattttgaagagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactcagaaagatctatggggtacctaccaatttatttccactttagagatgaggaaagtgaggcagagagaggttagatgacttgcccaagatcacacagctagtaaatggtgaagccaggatttaaactcaatggctgaactccaaagcttggctctgaatgagtgaagagatgtgttcctagaaatctagcttggagagtcaagaaaagtaatagggaggagatgacatttgacatatctggaagggcaaagtgggaaagaaaggaaacaatacactcaagggagacaacaacatggataaagtactgaggaatggtgtacctgcagcataacaggtgctcaaaaatgcaaatgaaaaaaatgaatatctttatagcccatgagttaaaaggttttccacatctaagtgttgtatgactagtgctctctgtgtgtttctttcagtgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggtaatgtattctttctacatttcttcttattttgtttaaaaaagataaacaaatgtattattttatgccatataattacagaaataaacaacttctggacccatatcgtttttgagatgctttgcaaacctttcagtcattgttcaagatcccaaagcataatggaagcatttggcagggttttccaatctcctgagcatatagaacagaaaagggcatccatgatcatcaggcccatcttgatgggtttggcatatgagaatgatgcctgaatattttgattacatctgtttaaccagtcttcattgcgtttagagttagaaaaatcagataaaaagtgcctgagtgttttgcatttgggcaggggatctttctaatttctactgttcatagtcactgttaaataactgagttttacggctgttcatcaaactggatgaaagctgcttttcctacatgtccatccagctgaaaaattaattctcaagaataatgagttacatgggagaagggagagaaatatgagccagttctaaagaacacgacaggatagaatttttgccttatgaaaaagttttctttcttatttcttataagacaaaattctcatttcaatttaataaggacaattacaaccataacactggttataaaatccatctggctgggttatctttccaagcccaaaaaagctatttggatgttctttatgttgctatctgtttttggctaaattaattggacaacttggttcaagataatgtttactattattaatgataattattaaatgcctcttcatttttgaaataatatccatgttgaatatctctaaagaatatttaattcatattttaaaattaaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacactatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcaggacttgataaagatttctttaaacaacttattgggagattaagtgtggaaataacctcctagatggacatggactgaataatatgtatgttaattttatcaatattgtgaaaacaataatttgacaatagatcactatctttttcataattatcataaaatttgaatgtggtttccctgtgttctagaactaattaaaattactgaataatgttaagtgataacgatagcatttcttcctaggacaataaatctataatatttgtgggatttgttctgtatgatgtaaaattataatttacagcatagtggtggtgtttattacccctgttatgacctggataaatgaccaagatctcaaatatagagaattaatgggggttaatttttcattgatgatctattttttggatggggagagacagagaaaatgattcaaacaaagaaatattaagaagtcagtgatagtttatactaatctgttattgcaaattatttagaatttcaaccactcaaaaagatgttttcagttattttaggtagagcactttgtctacataggacattagctaggtctcaatttttgtaagttatgaacaattaaattcacagaataaggtacaatttggacagatgaatatacactccagggataaacgtttatataaccatagcttatgctactttttgaagcagacaaaagtagctaatcatgggttccatcattttatgaagaggaaggctaaaaaagcaaaatagaatgtgcagattttaagaggatgtttcatcacatgatgatcgccagatcacccaaaattcaaaacagcatgaatacaaattaaaattattattaaataattatattttcaaaatatcttcagcagaatgttgaagtgaacatggggaagaaaataaagatggcttatgcccttctcgtttaaaaacaagacagatgtgagaggcattttagatataatttcttaatcttaagaaatatctatatataggctctatatacaagatataaaggctctaggacaatcaatacatttttaccattttaattcatatcaaattcacagaaattccaatttcaatattcatggctacatgtctctatagtaaggttttgcaaccaaggaagatttttttaaatattctgcaatgactacaaaaagtatagacatttatgttgcataagatatatatttatgtgttcttttgtatgtgttaaaattggagaacactaaccagacagagggaaaatattcacatgtaaagtcataggtctggaaaggtcatttctccacggttttcactaatgtgtgtggatattttaatttttatttcttccttctatgtccttatctgtgttgtgtctcatgactgttctggactgtcccttgcggtaggtttcctctgctacttagacatccctagtcaacgctcagatacatttagtggcctggcacctggggctccacagctgagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgcttaagctcagcctttgggacaggaatagacttaatcacttcagtgatgaacagtagcactgagaaattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgacaacagctcaattctgtttatatgaccttcccacctgaatgagttctattaaactgtgatacagctgagtctcagttttttagaatcaaattggagttaaccgggtgaagccaaattagaaaatcttgtaatttcaaggactgagggtgccattttgaagcaccactgaagatccctgagtaagtgggtggattgaacagagaatctccttcctgagaatgctgaacacagcaaagaaaaaagaccatgtagtcttggatgtgggggtagcagagtggaggaactgcggtctgatgactgatgcctatctacagcctggttatacttcttgcatttgagttctatgagaattcttagattcaatttgagagctaagaagagttaagattcctttactttatcagagatataaaacagtctaccactggcttatccattttgatttctgtgagattctacagtaatacatgcatgcatacacatatacaaaaatagcaatgaaaatgctataacctaaaaccaggagacaataattgtgatatataacacaacaatgaagttgaaatcatcaaaatacaaagagcctttgcaaatcaataagaaaaaggcaaacaacacatagacaaattagcaaaggatatgtacaggcagtccccagaagaaaaaatacaaatggttaatgtaaaagtttgtaatcttttcaacctcaggaaaatgtaattttgtatttttttaattttgaataatgactgtgtatagatttctaattaattattctaattacttaaagcagtaagaattacacatccctagaaacaaaacttcatgtacttataacctttgatatttttagcaaaatgtttgcatattagaaaaacacattatatattttgattttttaaaaagaagagcatttgaatgaaacttatgagttagtgagctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggtatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaacaatgttacattttttgcttgcaatattctgaggggcttcttccatcgcttccattttgcttgctgattggggaaagaaattccgtgcacaaaaggaatttaaaaaatatgtaagcagcaaatgtgaatgtgtgtcagacaaacagatttccagcatcttagtgcttgcttcgaacagcttggaagtgtaactacaggcccagttcaatttgagttttgatgaaaactctgaaattcacatgtgatcctttctctatacataggccctcaaggatgatgatgctgaaactggattgacagatggagaagaaaaagaagaacccaaagaagaggagaaactgggaaaacttcagtattcactggattatgatttccaaaataaccaggtctgaagtggagaaatgtcttctaattccattacattttctgaaattaccaagtagaaattgcagcaagatacctcttaaaatattttgtttgctgtgaggggaaaatgcaattatcaaagctatggatgaaataatttctaagaacaggcagtcccctacttgctaatttaacttctggtaattagaattcacagtattcaaccgattacatctacttgtggcactttcagcaggcagacagaatacaaattaacttgaagcagtcggtctgcttctgagagcttctagccacagtctcaccttctcagcttcctcagcctgagctgcagcaaccttccttggactttacagatttagaactagacagggctaggggccttttgagttgggccgctattctagccaaatttttgaaaaataatataatgatttgataagggatcgaagatgaaaaattaattcttgtccattaaatttaaaagcaggatggccttatatgatactaggtgaaactcctagtgctaatgagacagcaattctaaaagagtgagaaaaccagagacttacttctagtgcctaggaatattgcccaaaaagtgacaaggaactaaaggaggtaacaaaacggacatttttgcttcaatttctcaagaagtcatgaaatgtcacctagatgaatgataatattggctaccttttattgactgcctgtcaataaaatagagattgctgaaagacaactgttaaaaatcgcttttcatttgaagacattccaggatccacaacgttgatgaaaatgttcctcaccttctgaattgttaaagaaatgtgaaagctggataagaattaggggaacaggctaagttagagaccaggtttttaaaaatctgtaagacaggcagggtgcagtggctcaggcctgtaatcccagcactttgggaggccaaggcaggcatatcacgaggtcaggagatcaagaccatcctggctaacacggtgaaaccctgtctctacaaaaaatacaaaaaaaaaaaaaaaaaattagctgggcgtggtgacaggcgcctgtagtcccagctactcaggaggctgaggcaggagaatggtgtgaacccgggaggcagagcttgcagtgagccgagatcgtgccactgcactccagcctgggcgacagagcgagactccatctcaaaaaataaaataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtaatgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagcatcaggatttggttaggagcaaaacctcttatttatatattctaggaaagatcaaggacaacttatattggtcttaatatataacatattttccaaaaatttaatctggctttctatatgcatccagtatttttttcatcatattgaccattcatattttccagtggaaatctagtggtgtctcattctgattagtcataattttgaagctttcaagttagctttaattattaatactataagtatcattttataaagtagtatttttaagaaaataaataataacactgagaatttttttactaaaatatagtgagagtacatttactgttcccttttcagcaaacatcaaatctaaaaagttatttcattctgagaaactgatgaatttttaaaatattacacattggtttttcccaaatgttctcagttaatttgatttataaagtgattcctaagaagcaggaagttaaagtctgaaaaacttcataaagtttggatcaaatatatgtttaccaaaactaaaagacaaccctaaaatattctaattaagacgctttcatggtacagagaaatgtgatatttatctcttaggcagaagtcagaacaaggttgtaaaaagtaacctcattctttattaacaaaatatccaaaaactctaaattataaatcatctagtttctaaagagtttaagccatctctctagcattttttctgctcaaaagaaaattggttataaaaagtgaggatgaggaagtagaatcttacttattcgcattactacataaaggtaaataccaaatacctacttagcaaacaaagagacagactgtttcctttactaatcatgtctttataatccgatgcctattttagctgttttttgaccatctgtctgtgttttgtttacctacaatctagcactcttattgccactgttgtatcatgattccacaaaaaaaaaaaaagatattgaagcattaaaatagaaacaacataatcattcaggttattgggccatgttaaaagttgagccacctagccaaaatgcacttaagtacacggtgggtcacaattaaaatggttatgcattttttttaagagggggaattgcttttttactctactagctaaaaaggcatgaactcagatttttcaggctgagatgtaaaaacctatggtgttactgcatttacaaaatagcatataccttgaataacagtaagagtctgctttgttacctatatggatctaaatcagtctgttgacacaaaatctctaatggcagagtatctatgatagtctactcacacctctttttttcttcgcaaaaatattaaccataccataataccttaatattcataatgaggcttaagaatgcatcagtaagaaaacagacttaaagaaatgtaatagttctgtggtgtttggaaaaaataaaaaacacagttactcaccattaaaaaacctcacctctaatctcccttgctttctatgaagctgaaattacatttcttttactccgtgtcctatatttaaacacagaatctcatagataataatcattctactgtaagttaaaataaatgtagtctgcacaccagtgaaggtcaaatataatagaaactagaagatcttattttttatctcaaaatgctacccaatttctaagaaatttctactcagctagcctgaggctttgataaagaataaaagtttcccactttgtaattacaaacttgtgattgcttaacaatgcattttcacttacaaatcatgctctggaaagaaaaacaatgcacaagagcttttagcaactggaaagttatttgattacaactcttttgcaaaaatgaactccatatttaactgcaatcagcaaccttttaaaagcctcttttgtgcttaaaaccaggcttcccagagcctgcatcagtcataattgggtttctgaagtctacatagctcagttcatttgccttctgtgttcagattcataagagaatcagagttttattaaaaataaataggaagagggagaaatcccaatatgcagcattgtgaacaaatcgatcttttccaaaatgtccactgatatttatgtatgctgtattctgtcatttatttcagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtatttgttaacatttatttataacctttcctttgttgttttacttaaaagactgatctcatcctgacacatacatagacatgcacatgaatgcttgttcaggcactcacaataattccagtcagaatatgcaaaattcttatcttcactacagtcaacattcgatattgcctttcagcgtgttcagagtaggattcggttcagtcatttcagaatggaatggactagaacatgactaggatgtcatagtcacatctaaaaagtgagatccctccctgaaataaagccaaaggaatgaaatcattatttttctgaatttcaaagtttgtgaaaataagtacatctgttacaatcccaggattaagtaagctgtgtcccaatgcttaaatggtacaaatagacatgactcttgtaacaaaattgtgtgtgtagagggcaatttgagcacttcaaagtcattcttcttaactaatcaataaaaggaatatgaacatattttttattgcatttctagccttcttcctttactctaggttctgccctgatgttcttcatcttgttgaggcacctcagttgacaaacaacagagagattccagccatataatatctcatcaggaaaacatgtcctgcaggtctccaggatcttcgtggatcttggcttgaaatcattcattaaaaacaattcttttggtggatatctttaacgtgcgaaaaaaactttttaatgcattacttagaacaatatgtttctgaaaaatgaaatatctgtgaatatgccagcaggctaattcaaaatcaccacgtccatcagccaggcttagcatatgccttgtgttggcaaacattctgggatgaaataaattgaaaatgagggcatgagtcattttctcaaaccttgttttcaattatgtaaaggggaagtgtctttctattcactctaaaatttctgagttttcaagacaaaggtccctcatgtattgtcagtaatcttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacctacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatggatttaaatcacttaacaggaactcaacatgccccaaattaattcatcttcttttcccccaaaacagttatctgaaggagctactaatcattcaaacaataaatatttttaagtgcttcttctgtgctaggtgttttacatatattcattcatccctaaaatagccccatgaagcagccattattacagtattatcacaatttaatagatgaataaacttatgtttaatcacgtgccccaggccctttagttggaaagtccaaatctggtacaaggtctgtctgaccccaagtccaggtttttgactgttgctctttgagtacaatcactagaaagtctagagagattttagatatacaataacattttcaagggtttatccttactctaaaaaattttgtttctttctttgagagtcagctctttggaagggtttattttccattccttctaaaatggaaaaaggatgatgcttactttttaatcatatcattttaataaaataatcaggttccaaacagatggtaaataaatgacagaaaagaaaaactctttggaaaactaaaatttcttgtatgtagatggcccaatattcttccttttcttccctccttaatatacagagttaattgagaaatgtttgctgaagcataagacaaccatttacactgataaaataataggaagtgtatgaaaattgatcaaacctttaagacaagtctaaacaatttcttaattaggtatttctacccagttactgaagtgtagcttacttggattgcactgctttcactgaatattaaaaatgtcactaataaacatcccaacccatagcatctgtcccagatatatttgaacagctggagaattcatcagttcttggccttttgccaccactcatcctaaggcatgtcatacccaagaatgaacttcaaaacccatattataatgcacctcttatattcaaaacatcaatttcctagtcagttcttgtcaatcagcaaattattttagggagtaggtgaggcacttgtgaatatcatttcaatcctttcagactcctagcatagcctttaataaatcattgctccattgaactgtggcatttaaatgccttgaaagagttaatggagcatttgaaataagttatttgcccctcagtaagttacaccctgacaatacaacttaaaacaacaataacaacaaaatattctacaagaaaaacttacttatagtcaaatgcaattggcttgtttattgttttattaatcttaaggctttatagtataactaacagcaggatccattattaataatgctaacagcttctagaactttgagataaggcaataaatcactaaaatttcccattttctctcaagtaattttagcctcaagcagtttgtcaaaagtctgaatttaaaaaataaccaaaaacaaaattatctccctgttctgtttatgcaacgtaaatattaaattaagcaccatgaacaagtaacatgttttaagcatttttgtgactggatattttatcctcatgtcttttaatttaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagaggtaagggaattactagcatttctaacatcacaagctgtactcgccagttgctgctcatataataacttattgagaaatactctttacaaagggggatgtgggcctctagttgttgacagctgataaaatagggtcaagggcactgcaccacctcgttaaaaagtgtacaggtcttctgggtgttatctgaaagaagagagacatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatataattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactctttagttcctgacgtaaggctgtaattacgcaagagattgctgacagctcagtcatttaggatctccaggtccctaggattccctggcctcttggggtcaccagggagatcagagagaacgtcaggccttcagagaaactcaatcaagtccatcacctgggaatcctctcagcctaaggttttctgtgaccaatctgaggctatgaactttataccccctatatgatgaaatgaggttttagaacaggcctattaattcccatgctgaaattgaacttttcactctaacattgctgtttgctatttgattttacaaaatgagtcaaaaatacttaagttaaactctgctcttttttttggaaaaaagtatgtatacttatactttccaaaaaagagagcagagcttaagtatttttgtatataatattcatgtatacttattatatatatatatatatatatatatatatatatatttactgtctcaatatctaagaatgttgactaacctttcttagacattgacacagatttagccctactgtggatattcaagaatacccaggaaaaataccgagttttaaaattatatgattttatggatagttctttcctataagtgaactaatagtaatgttacagacatcttcatgaaaaaaaaaattcgatcattcagttacaatgtttataattatttaacaaagtagtgggatgtttcattgacttttttgttgaagtgtttgactttgtgtaaattttttgggtgataaagtaggaccataagaaatgtttattaactgattggttttattaattgactggtgtttggttggcttgttggttgaatatgagaacatgaaccactggtacttcacaatgcccacttgtgcagggtgcatggttcacacttgttactttcacctggataattatcaggtggtaatgacatccaagatcacacccagtgggtttctgaaaaattgtgcaatgtttttttctgagctaagggaatgtggaccattgagcaagtttcctctttcagaaatctttgagtacgagcagagtttgaaacttaacaccaggctgacgggtttcactctagaatctaggggtttaggtaaactgcccattcagaattttaacctagaaagtggcctaacatgatttaccccttatcttacttaccgatgaaatagaatagaacatgaagtacccagcatagagtctggcatatggtaaatgttcactaagtgagaggtctctcatacctttttcttggttaattttgtgtgtgtgttctctttccccattttgtgtgttcatctcctcatttgttgtgtctcttccctctatttttatctacttcgctatcctttttctcaccattgcacttactgagtatctgtaggagttattaatgggaaatattaattttatcattacactcgtaaaactctagagactttcctctttgatttctactcaggaatagaaatttttggttttcagttagactatttctctttatcaaggtataggttataaaaaactgtataagacagatgtctagcttacaaagtatctctggatgactagacccagttagaaactttttcattataaaggaagtaagattccacttgcattttatatctgaagaattacatattctcaatgatatctgctctaacttttcatgccactgtccattaattgtagaaaattataattgtgtgaataaattgaagtcttagattgactttagttttatgattttaaagaaattgtttttccactttacatgagcaattttgttcatgattttagttttgctttcatctagcagtgttaagcattatttttaatgtcataatgagatgaaagatatcaaagaaagtgagaaaaaggagttcaaggaacagctttggaatctagaacaagtactgctaatcatagtaagctgttctgccggagacttggatttaaagaggttaaatcaaacccactgacagccaactctgtgatgttaattaaatggagtaaggttttattgccagaaagttgacaactataagtcataagatgatgaagtaattgtgtaacttaaaggattatgtactattttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctctgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatcatggaaattgatccagaggaaaatgggaaagaattagttctagggagaactcaaagagtaggaataaaatctaagtttatcatgcctagaatatttgttgttaatcaattttataatatagtagatatagtttagtagtattgaattattttatagtatattaaaactataatatatattagtgtacctagtatctctgcgtccatatcatgggacttggaacatattgatttccctttaaactgctacagaagtatagatgtgttttattttttacagtatcttgggtcatagctgtggtttatttgagtttgagtctttggttagaatttctgtcaccaattataattgtattcttatgtataataaatgttatccacttcgtgatgtggtttccaagaacatgataggaaaaagcaaataacttgaaatatctctctagtatgtaggactgtaatttgcttgcctttctggttaaaaagacttttcaggcagaggtaaaagaaatccaaattctcactttagagtttctaaacaaaaatccaatattttttattttaaattccctagaaaagtaatataaattagactctaatttgaagcaagaattaaagcaaggagagatcctggacattttcaaaatgcactttggctaccttccattgttctccctcacgttgtcatactttagcctactgcacctgccttccttgtcacagtgataaccacccaaaggtctggtctcacagcctggctctctagcttccaaagttcatcttcattaaagcttatattaacttctctacctatcctataaacacaaataatagctatcatttactgagagtctactatatgctgacaaaaaaaaaaatctcataacattcttcaaaattggcattaccaaatctgttttacaaaacagggaaggaagggaactgagacccaggaaagtttaagtaatgtgtccaagtttacacgggcaatgccataactacaattcaaacacaggtctaaaagcctacacttgccattttttgagattgagtctcactctatcgcccaggctagagtgcagtggtgtgatctcagctcactgcaaccccccgcctcccgggttcaagcgattctcctgcctcagccgcccaagtagctgggattacaggtgcctgccaccatgcccagctattttttgtatttttagtagaaatgaggtttcaccatgttggccagcctggtctcgaactcatgacctcaagtgacccacccacctcggcctcccaaagtgctgggattacacgtgtgagccactgcacctggcccacaccattttctttaaagagtctctcttggtcttttcaggtctgtctggctcccaaacccattttctctctacactgccatattgccactaagagagtgcaaggatattgtctgttttgtttatctacttaggcccagcacattgcactgtgactgcaacatccaaagtgcttaaataaatattttcaagtagattggttgaacaaattagaatttaacaaatatgcattctaatgttctatcacctttgagagagtcatctttaaaagatacccagtcattccagttgcactgtagtatcctaaaatatttttgaattccagtccctctctccaagtatctttctcaatgtataatacattatctgttctcaataatgatttgtctttgctttgaaaaggtaaatctcattgaaatggccataactatgtagggtcaagtataggctattagttgatgatcgaattgggtaaaacagttgtaattactgtgggaaagtgatgagatggatgttcttgtgagttttatattctgattctgtcctaaatgctttgagcattaacatcattacatggtctctcaaatggtttgctatggggaaaattctcattaggagatataaattctgatacacatagtaccaagaaaatataattgttttaatagaaatcaatgtaagtattaggttttctttttatccaaagaataaaaggaccgagagttttcagctgaattttaaataaagcagagcaaagtggatttgggagcctggatttcatgtgtataagctggcagagcagaaagtgaggagtgggagttgaaatgggaacaaatataaaacaaaaggagaatgagaataatgatgtagacaagagcagccttgtttacatctggtttttcatattactgaaataatgaaaagggttttgagtgggaagcaatgtgagcaacacaggagaatgttttgttctgtcttccacagatttaaacctattcaaatgtaatcttttctcttgagttcatcatatgcttgggagcaatattttttatcttgtttgtgaatcttaaaattagatgtttttaccttctgtcttactcctacctacctttgagcaggccaaatgtttgtgctgtaaaatctttaatccattacaatctgttactctgcaattagatgaaatgtcagtgattgacttgtactagttgtactacagaataagggaggagaatgaggactcgctgaaaaacaagagcttaaataattaaagaatgcgagagagaggaagcatacacagacacacaaacttacttgctttaaacatgattaaattcttgccaattatgaacaagaacttttaaatactgtaaattaattttatttattcattctttcactgatttcatcatatattaaacctcttttataagccaggtattgtgctaacttcagggaatacagtggtgaataagatagacccccacgttcggccacctgaccttccgagctggcggggctgaggctggagtcctcccaggagccacaggggaatgaaatttgcagacttccggggcgcctggccctgggcgttgggcgagcccggggatggtcggaagggctgggggtgggggtgggggggcgtgggggggggcggcaggaggagcccgaacgaagcctttgcgattacagtcatggccacccagatggggcagtcttctggaggagaagggctgtttaccggcaatggcaacattggaatggccttgcctaacggcatgtatgacttgcatgatctctctaaagctgaactggcctcacctcatcctgtcttgctggcaaatgcggccttcagtgggaaagtaaatggcagctgctgtgattacctggtcggtgaagaaagacagatggcaaaattgatgcctgttggggatgacagcttttcagatagtgaagaaggagaaggcctcgaagagtgctgaaatgaaaggtgaacctcatgggctgagacgtttggaactcagcgttgtagaacttcagcctgcatttgaagcatcagctgctccagagatttacagctcaaataaagatcttcctcctgaaacacctggaacagaggacagaggcaagaactcgaagaccaaatcctttcgctgtaagtcatgccaatatgaagcagaatctgaagaacagtttgtgcatcacatcagagtgcacagtgccaagaaattttttgtggaagtgcggagaggcaggccgcggtggctcacgcctgtaatcccagcactttgggaggccgagacgggagaatcacctgaggtcaggagttcgagaccagcctgaccaacatggagaaaccctgtctccattaaaaatacaaaattagcccggtgttgtggcgcatgcctgtaatcccagctactcgggaggctgaagccaggaggcggagcttgcatgcggtgagccgagatcatgccattgcactgcagcctatacaacaagagcgaaactccgtcaaaagaaagaaagaaagaagaaataaagaaagaaagaaagaaaaaagaaagaaaggaaaagaaagaaaagaaggaaaagaaagaagaaagaaagaaagaaagaaaaagaaagaaagaaagaaagaaagaaagaaagaaagaaagaaagaaaagagaaggaagcaatagacaaggaatctggctcttccactgcagaagagggagatttctccaaggtctgtattcgctgtgaccactgtggctacaataccaatcgatatggtccctatactgcacacctgaaacaccacaccagagctggggataatgagcgagtctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaataagttatgtgataatggtgtgtgttttgtgtgcatgaatggaaattgtaaatgttgaattctaggctccgataatcactgtcaacagaagatcaagctgcaaatatttatgctttaaaacttaaattataaagctagttaaatctttctaacaactagttttaatgttcatgggtacattttacctaaggtactgttaacattgtatagagaaagattcatcttaagcacagattggctatcaggaattagtttggggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttcagtttaattacatcccatttgtcaattttggcttttgttgccattgcttttggtgttttagacatgaagtccttgcccatgcctatgtactgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcccaattgcttctttttctgaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttggttccatatgaactttaaagtagttttttccaattctgtgaagaaagtcattggtagcttgatgggaatggcattgaatctataaattaccttgggcagtatggccattttcatgatattgattcttcctacccgtgagcatggaatgttcttccatttgtttgtatcctcttttatttcattgagcagtggtttgtagttctccttgaagaggtccttcacgtccctcgtaagttggattcctaggtattttattctctttgaagcaattgtgaatgggagttcactcataatttggctctctgtttgtctgttattggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaatacgctttatttccttctcctgcctaatggccctggccagacttccaacagtatattgaataggagtggtgagagagggcatccctgtcttgtgccagttttcaaagggaatgcttccagtttttgcccattcagtatgatattggctgtgggtttgtcatagatagctcttattattttgagatacgtccccatcaaaaagtgggcaaaggacatgaacagacacttctcaaaagaagacatttatgcagccaaaaaacacatgaaaaaatgctcaccatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaagcaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatggatacatatgtaactaacctgcacattgtgcacatgtaccctaaaacttaaagtgtaataataataaaataaaaaataaaattaattaattaattaatttttaaaaaggaattagtttggggaaaatgtttttttgtggattctttcatactgcaaaagtaaaaccatttgccttctggggaattgagctaaattctcatctagtctaagactaaaatgctaaaaacaaaaacatgaaggaaattaaaaccccttattattaaatcgatttgtaaaaatgttgttactggaaatttattggacttgaggccttcttccagaaaataaggacttgattgtcagggcctgtattaggttctgaaccttaatgccatgtattcgtacttatcagaaattatttcagtgaaaagtacattagcagtatgaacttctgatccagttggaagttcttccatttgaaaaatgtgatatttgcatggaactgttttcatctttttcttttctagtcccactcccccacactggatagaatttaagctagaattttcccttttgataaaagaacaaaaaatgaacatgttatttgtaagttgatgtgtagtatctagtgataaacttgaaacactagaatacatgacaagcctaatcttaggtagtcttatgaaaacgaatctcttacctatcttttgaaactatattcacattgatttttaagattttttaagttatattttttccttttttcttcagagctgcttcttattttggcaccacttttttcttttattgtgtaattcacaaggggctgcattttttttttttttttttgataaggcttgtaactatggctggatgttttgctctagtcttctaagaaaggccattttatttttcagagtcacttataaagtcatgtgtaactaactttgtagactgttttgcatatgactgctgctacaaattaaaacccaaatagacctcattgcatgtcactctatgaatgttgacaatgaaaggaataccttgcctgtggtatactgtcacttttggactgaaaagctgaggaagaaacttaattttcttttttgcataagtcagaaaaacttacagctggtgttcccagtttcctggttgactccagcagatgaaatgaacagatagtgttaattcagactgaagaaattatctgaatcttggcttgtgtagatttacaatctacatgcaatattaactaaatcagatagcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgtaacagataaaaatgaagcagattgcaaatccttttttaaaatcttaaaccatgtaccaagtttttggtccaaattgtgtaggataagttaaccttaaattgcattctattaaccaataagagggtatttccgtaagcatagttatgttgaaatacagttttaaaaagcaaaaaaaaaaaaaaacaaaataaaagatagacctgctaagcttagtcaattaaaaattaatggtgagacagaactacagggtagattaaagctcagcctatatgcatcaccatgactccgcttactactgatgtctccttcggcttgttgcttaatcctttcataaaatgggattagtatttactcacctccatgagttgtgacacactctaaatgagataattaatgtaaagcacttagaacaatacttggcaccagagaagctctcaaaaaaatattagcggggccgggcgcggtggctcacgcctgtaattccagcactttgggaggccgaggcgggcggatcacgaggtcaggagatcgagaccatcctggttaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattagcggtttttgttattaaaaacattggtcagagcccttatttccttgccagccgaaaagcattgctctgatgactagatttacatccttccttttttgaggacagtgggacagcctaagtgttcagaaggcattgtcatacatggttttaataaaaaagtggatatctgagcctagataccatgtgcgagagtctgtgggatgtgaaaagattgcacaaagacgaacccagtttaaggctcagcacgtgtgagtggaagatagtgctaccatggtgtgacctcagtgattgtgcaccaattaattcctctaagctctgacaccccacaaaggaactcaaagtttcaggctctgctaaaataagacagacaatagcaagtgttggcaaagatgtgaaaaaattggaattcttatacgttgctaatggaaggtaaaatgatgtagccacttttgaaaccagtttgacagttcctcaaaatgttaaataaagttgccatgctatccaacaattctactaagttctacccaagaaaaatggaaactcatgtatacacaccaaaaaaaatgtacaacaacagtagtagcatttttcataacagccaaaaaagtagaaacaaccaaaatattcatcaagtgatgaatggataagcaaaatgtggtatatccatacaatagaaaattacttagctgtaaaaagaaatagtcttgatacatgctataacactcatgagccaaaataggcaaatccacagacagacagaaagtagattcatgcctaagggtaaggttagggtaggaaatggggaatgacaggtaatgggtatgggattcttttggagtgatgaaaatcttctagaattagatagcaatgatggttacataacccagtgaatatactaaaatccaccaaactgtacactttaaatgggtgaattttatggtatgtgaataaataccatttttctcaataagctgtttcttattttttattttctttattatttttatattaaatacaattaaaaaaattatttgagacagggtctctttttgtcacccagaccagtgtacagtggcacaatcatagctcactgcagcttcaaactcccaaacccaagcaatcctttcacctcagcctcctgagtagctgggactgcaggctggcaccaccatgcccagctaatattttttgtttgtttgtttgtagagactggatcttactatgttactcagtttggcctcaaactcctggcctcaaacaatcctctcacctaagcctcataacctgtggatcaccacagccagtcctaaatctgtttttaaaaaaaagtttcagggacagagatcctaaacatcaaagcatgatgctccaggctgactggggttccatgtgaaacagccctcaggtgtgctggaaatgtctttcctggggctgtttcaaaagttttgggatattcgctgaaaatattctagtctctctttaaagtagaacacttgtctccaaaatcacactccttattaccatttctattgatataagggcagtactaaggttcactttttagagatgaggaacccaggcctaggacatatgctagccaatgagagctcaagatgtaaatgccagtttttctgattccacagccattttctagtagtctactctcccttaagacaagaagtttatgcctaattctcctgatgtaaaaacaaagttttaaacatgagaaccaatctttttgcagcttgttttcatactgtagcttctcagagattcccccaagttgctcttttccagacctttttcctactaacatcgtgactttttaaattgaaataaaattggcatgcaataaaatgcacagatgttaagtgtacagttcaatgagtcttgacaacgctatacacagtgtaacaccaatcaagctacagaacatttcttatccccaaagaagttcctcatacctctttccaatgtgtcttagtgcaagctcctagaggtaacttctgttctgatttttcttaccacagattagtttgcctgttttgaactatataccatggaatcatgttattttgtgtctggcttcttcagctcaagatgatgtttatgagattcttcatacagtaatatttcactcctttttattgctaagtggtattctattatgtgaatatatcaagatttatccattttcctattggtggacttttgggttacttccagtttgagattgttaggaataaagctgttgtacagctttctgtggacatatgctttcatttctcctgaactgctggttcataggtaggtgtatgtatcacacttctttaaagctaaaatgaccaggaccccaggtaatagtctatacaggaatgtgttgtgatacctactgtacaggcttcagtcatgttttcttttcattctcactagcctccacgatgatgctcagtaccaccttgattcttgacctgggcactatgttgtctatcgtccaccgtacaactggcacctcataacacacgtttattctctaagtgtaggtgcatacccacacaatgctgttagataaaaagatgccttgtttacctgtttcgttgtctcgataggtagaacataagcttcttataagtgaggaaagcatcttagcacttttgcacatcacagtaattagctcttaggagaaagtatggcatggatcaaatgagcatagaactcggagtccaagtcacatcaactctctgagcctcatttccacatatgttaaatattattgaaaaaatgtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttcgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccagctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatagaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttctcttttcatgtgaactataactatgttatatgcaagaataaatttctgggccctggataacactagaatacagacagaaacatttatgagtgaagcgaaaggccccacgtacaattctagatgaggacaaaaaggaaaatttgaaactatctctagtcaacttttcttattctctaagctgcagatactctggaatgtagtcagaggttgagatttgccacaagttaaccaactgctcttcactttaagctgtgatttctacatgaataaatcaatattccgacaaggtgcttccctgaattttaacgttctgctagtgttttaaagataggagaaaaaaatgtttttcagaaaccaacatagcgtcagaaatagtctgctcttaatcgtatctcagtgtcaaaaaacaaaaacagagtgagattagaatattaaaataggcagagagtgtggaattttatgtttttattttataacgtatttttggatagcctctcaagtcataaacagggaatatagaaagcagactttgaaatgcccgcctgatataaaataaacattaatatttaacttagaatcagaggagagatgtacgcctcttttcaaggtcatcaactttccaagctgtgtcacactgatgttctgtttatgttgaagccatgctgccatgtttgaagatgacataaaggcaatggaacctatgtgtcgcagtaggattacctaattttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgtgtattttaatgttctccaaatagtatttaattaggggtacttgaatatatgagaaatgtctttgcaaagtaaatgttttacgtgcttagagttttctaagcccttgtgtttcataatgcaatataagctctttattagtaccctctggctgagataagatattgagctgtgaagaattgcccaaaatttaaaactttttaaagaataaaaaagctaccaaaaaatgtatgattccctaaaatgtactgcgatgtgaactgcagcactgaccattctcccaaatttccatcccaaaaccctgcttctcatgaaagagagagagaaaaatagggagaaaaaagcacatgctgcatcttacaaaaccagatagttactaaatgcttgtcatttggtccccaaattatcctttcttgaaatccaaatctttaatattttaaagaataaattgcagcatttctgccttgaggtttttatgtcatcttcataggaatcattttgaccaattttacatataacttagctaaatttttgtgttagatctgaatcttggagcataactagtctgtattagatgaggaacagttgtcattttcagttatgactctccaaacgtcatatcagctggtgctatggctctgatttcctctatcagcagcacctctctcgggtaatttatctttttttctttttcccctttttttttttttttttttttgagacagagtggtgcgatctcagctcactgcaacctccgcctcctggggttcaggtgattctcctgcctcagcctcccaagtagcttggactataggcatgttccaccaggcacagctaatttttgtgtttttagtagagatggggtttcaccatgttggccaggatggtctctatctcttggcctcgtgatcggcccaactcggcctcccaaagtgctgggattacaggtgtgagccaccacacctggcctctcgggtaatttctgaagaccttgattctcaccaccactgcaaacccccaaacccaacccattctacctgctggcttgtgctccctcttcagaactttcctaattttgtgattctagttgctgttcagtccccttgagaggaaaaacaatggacaaacttaatttaaatctgaaataactgattagttcaatgaaatctcacaaactgtgttacagatattattaagacaaatttgcaaattaggaaactgagactcagaaaggctaagaaatttatctggaatcatataactaaggaagtaatggccaaaaatttaaatcaaaagtttgccttactccaaagtgtgtgttaattactattttaaagttctgttaaagcagggacttcatgttaaattcctagtattgggagttcaggaaatgttcaagaaaagcatgagggtccctggtaatgaacttatgaaagaaatgtatcatgtgaatatggtgacttttccttttttaacaaatggattgaaggtttcctgaaaaagtgatgagggataactttaaaaggtgcctatttaaattagcatacaggcagtttgaattctagttcttcctcttttagtatgttaaagggaaggaaatggtttatcccagtgactgctactccatagacacctgaactgaacctgaaggtagaaaaggaatgggacttagctgaattttaacaaggatcatttaggccagggctgctgttcagggcactgggtttgagtctgagactagtatttaccaaaatatgttatacaagtcatcaggggatacattcatggaaaaactcagtacacaaggacaaggaccaaaccttctttcagatcctcatgttgagcacataatgaattcagtgccctgggctagaatttaagtaactgggaacagaaaccagttcatcatgtgtaatttctataggaagataatgcttcagatattgtgtggtctcctccaagtggagcacagccacttgcccagccattagttagagtgcccggacgagaggagagaagcagaggctgggaacgtaacaggggagtgcagttgattgttcctctcagggccaagatgaagtgacccaccgtttcccaccgcccctctcattctcagtatacagtctggtcaatgttccctaagaaaatgattcattcagcatgccccatttccagttgaaatcacatacacttgacttcagaactgagaacgaaaatggttcttcctaaatgcaagttctggcatgcctaaacaaaaatttcatatatagtaagctaaaatctcctaaagagtttaacgcataacttattcaaacgtattctgagactgtgaaaattgaggactcatctatcctcaaatggaaactgccgctggcctcatcttctgcaccttatctttccttttaaaaaaaactctgagatttaccacttacatgcctgcatctgtttggattaactttcatgttccatatatttctgtttttattagttcatctttgtcctccaaatgtgggtcatcatacaagtgataagtttaagtaagatttacattctctttgttcttatgagtgtatcagtgaatattattaatattgcctcacatttgcaggacactttaatgtgctatggaagccattggaacccagccccgtatttctgaaccaaattctctcctccctcaaactctcggggcgttgggcatttcctcaattatgtggcgtctatggcagtttctaatctgattggggctcttaaaatagaaccagaatctcttttttggagtgagagagcgcagtgatgagtatttattaattaagggaaaagcctccacttgaggcagctgggaatgactttctgaagacactaaaatccaaataaaaagaaagacattcaaatgtgggaagaaaaagtaaacccagtaagaccctcctgaaagtgttaaatgttgaaacgatatctgaaagaaccaacttctttggaggatttttaaaaataagaattggggcatggatttgtagtcttgcttcaaggcaagggaatagacaaggtgatctcccgtgggatctaacagccctgtaattcatcaaagaaggtatttaaaagcaaagccatgggggaaagagaacagtagcatcaatctaaatcaagccttacatgcattttctctcttttttttttttttcacttctaatctctccctgcttttttgtaagacctatcacagcaggacatactctctacaattactttgacaaacaatggtaacagcacttgggtttttaatgtcttccaaagtaatctatttttgacagtgaaaagtagaggaaactgattcctgaagctatgaactaaaatgacagatttggggatctgatttaccagagtgggttttccatatatcagcccttgctgacattcctgggcaagtacccacaggcacaaactcccaatggaaagtcggataaatgtaacacaaacaacagtcataagttgactttcctatcaggtaccttgtgaaaaaataggtacaacattttataaatcttttattttaatgaagtttacttaacaccgaaaacgtcagtccagagatgtgaaatcttacattataaagaattatggcaaatagaaacactaacaaactgagcctttagctgtcatatctgaaatactatacatacacatattcatggatgccaacatgctgtaacataattttacatattaaaataggctcaattttcaatgataataaaatggttactgatactatgacttcatggaatattagatagccattaggcatacttatatggaaaaatgttttagtatgttaaatagaaaaagcaaaatataaaattatatataaattatatatatatgcttttgtagtgggttttaaaaatatttgcatatgtataaaaataatttgggaatccatgaaatgagaataattattttaggaggctaagattatggtatttttgtttctattttcttttttttttttttttttttgagatagagtcttcctctgtcacccaggctggagtgcagtggcgcaatctcagctcactaccacctccacctcccgtgttcaagcgattctcctgcctcagcctcctgagtatctgggattacaggtgcacgccaccactcctggctaattttttgtatttttagtagaaacggggtttcaccatgttgttcaggatggtctcaaactcctgaccttgtgatctgcctgcctcggcctcccaaagtgctgggattacaggcgtgagccaccgcgcctggcctgtttccattttcaatatacaaaaatacaaatgcacacacacagggagataacacatttgatgtaacaaatgaccgtgctttcagaattcagtccagtatattatggttgaagaacagacttacattaagtgttctgccacgagttatcagaaaaagtcaatagacccacatgaccccgccttcattcccttttctcctcttaacacctctgccagcaagaacacacacactgagtgggccattgtaacttagatccatctggtaagattctttttcttcttccaaattagtttgttccaaaaattatccagcagattgttcaagagaggcatttaatatttgtctttaagaaatgagaaaatagggaggtcaaaatgaattagcatttaaaaataagacctatagcacccctgcggtgcatctgtggggtttgagatgtgcagcatcatacaaatatcactaggaaactgagacatttggaaacagctaagaagagccacgttgctggaaaaaaccatgactggcaaaaaaaaaagctttttgtgaatattccataacctacaaagaacgggacaaaaataaatacataaagacttataccctggaataacacagcagaaaatatcttattaaaaggttttcactacctttgagataccatgacataatcatattaatccaaaatacttccttgaagcatggatttttaaagcttgactttttaatgccagttgggctgtgttataagtagccatcagattttttgtttccttttcctggccaactaccaaaaatctttggtagttggtgagtttgctctactacaagaaaacctggtaaccttgggatactctgctgttaatatccgattcctattcaagtatcttcccaggaaaagcatgggggttgcagggggaggccaaaccatctgcttattttaacaaggcttttggccagcttctcatggttaaggagcgctaactctctggctagcctaccagaagctcagagaatgagagttcctggtatttacagtgttactttttaaatcagtttcagaatgtgattagcacaccttcctaggtaggaaaaagctatgttatggctgaaaagaaaagaagcagatactcttattcttggtggatgtgggaaaacaaacaatttggatactgaataaagaataaatactgttaagcacttaatttcatacacaaaatatatagagaatttattttaagctttcaattgccttttagatgccaaattcagatctatttatagatgccagctttgagtaattcaaaaatttatataaaatcatttctgtgaaacttacagtttatggaaaacagagaaaggtttgcccatttcaggtaaggcctatgatttcctccttttacactgatttagtatggctacagataaggttcatggaataagaaggtttttgtagtcagacctgggttcggattgcctctgccattcatgagccatgcaaacttgaagacagctaacctccctgtgctttaatgttctcatgcataagatagagaatataaaacctcatcacagtgttattgtagggattagatgagatgcaatatgcaaaaacacccaaaactaacaagtatgcagtcaatattagctccctttcctcttttccttcttccaggctcttgggctactgtaatttacacattaactcattctgtaactttaatttcctactacctctttaaaatacagaccatatttattgatggggggaaaatatacaaagcttaaagcatgtgccgtaaaatagttccttaaagggtagtacagcaaaatggaacacattttcttgcccattcacaggacgactgtgaattttagcataattattgaaaaaaactcagctactctgactttttacaatatctagtgatcaagaaaacctttagatcatattacttttcctctcaatgttgtagttaggctattcactcagagaggcctgtgacaagctatagttaataagtcttccatggtgtcaaaagtaataatattaacacgcctttgtgagttaaattaattttgttttgtgcactggcctgcataaatgtgaatgacatttcaaaatatgatcaggcagaagctgagaaggagccaagtggcaaggcagaatgagatgcggtcattagagcagagcagccagctgcaagcatttgtcagtgcaggcaaagaggtgcaggatattattacagcaaacttagggggttgttctttcagttcattttgccctttggaaaaaaaatactgatttttgtctttagagaaaaatagagatgtttgacatccaggctctccatgtttggaaatgaaagaccatcttcctgctaatcactgatttcaagtgtctttcaacccacagattttttttctctgcctgcgagaggcagctgattggtaatagcttttaaactaatgaccaaacagtggcattttaaagtcttaatggttgtgtttatttcagagacttcttcagattccccaccaccaccatacacaaaggcatatacctcctgcaaatagaacaaataaatatgctgtctgtaaacagttaaaagatacaggttgaacctaggaagaaaacacctcaggatgactcagggatcagatgaccaaaatgactggtgtaataagttttatactttttaccaaatggctggacaagcccttttccacttgagttctagtattttgattactgcaatcagaaatcaaattataagaaaaatggagatgttcctattaaggcagtcaccgtaaacaagaactggataataatttaaggggctctgtacctcttcatatgttaaacttgacaatttaggcaacatcccatagtaatgagcctctacatttctttcatatatctagtatcacaatatttttgtctgttcagaagtactacacatgcaacaaacaatttttaaatttgtctatagaagtttctctattttaataaaatgaagagcactatattcagagctctgcatattgtttagtatccacagcaatcctacatgatatgaaagcattgttatcctcatttcacaaaggaaaagtaaaggaattccctgaaagctataggactgttaagtcacagaatctgtgttttaactcagatcaatttcactccaaagcctgtgctctaggtaacatatagccaaaaatacccatgccctatttccttctggcaaccaatccactgtgacttctatggtaaacaactatgttctgtagcttctgcatttaactatctcaaatcaaaaggcaccagcaaaggaaatggcttattctggaagattttgcattaatctgatgattcacttcaacaaacatacatcttcagatcatttcatgctgggcactggtgatgtaaagatgaattagacagtgctaggctcaaggacttcataggcgatgaggaagggatgatgctatctggaagtgaagagagttcagaagagatggtcagaatgtaaatttgaaatgagttctaaaggatgactaggaattcaactgattgagaataagggcttccaagaagaggaagcagggaaagcattggaacatgtaaagaacaagatgtccagatctgattataatctagtactgtacatgtgagaggggaatggcgtgaggggtaagccagaaaaaataaataagggtaatattttagggccttgaaggtgggagttaacattttaagtctcacatttgggaggcagggaggatattaaagctgtcagtggccacatcagctctgtgtgtaagaaagccaattttttggcagtgtgaagatgaattggaggctcttgcctccatttaggagtccatgaacgatatggctgtgaagacagaatgtgaactaaaattgaaaaagtattttcaaaacaagaatttgcagaattttgttactgatcagatagagaggtgaggggcagagaaagctattgaaaataatttcaattagtttggttgactgagaaatgagcaaacaggacaataaatgaaattacaggaagatgcactaattttaagggaaaacattaagttctgttttggacatgttcattaaaacagagttcatttctatttaagatgatattacatccttttttaccccaccacaacttgttttaatgttttatatgcagtatttaatgttctcctaaatagtaccatacccacagtcaaggagcattatttaatttatctgattccactatctctttaccaacctaacacttctttaaaattactcatggccgggtgcggtggctcacgcctgtaatcccagcactttgggaggctgaggcgggcagatcacgaggttaggagatcgagaccatcctggctaacacagtgaaaccccgtctctactaaaaatacaaaaaattagccgggcgtggtggcaggcacctgcagtcccagctactcaggaggctgaggcaggagaatggcctgaacccgggaggcagagcttgcagtaagccaagatcacgccatagcactccagcctgggcgacagagcgagactccatctcaaaaaaaaaaaaaaaaattactcacaaagaaatcataaaaccatgtttttttctttcaaaagaattccaaaggaaaaaaaatgccctgaagaatagcaagcatggcctttatctttgcagcttaggatgctgcattttcaggtttcctcatggactttgtgatttccatttcaacacatcccagttagcagccaggtataacaaaccgctacaatcatccgctctttattgtgctgatccaagctcatggccacagaggggttaagtggaaaatgaaatccaaactgtgttatccaagcacaagattcagtggacttcagctctgaaagacccactgggtgaggaggccgtaagcaaccctgcagaaggagagccttggaaagggcccaagtgtggtaagatacacacctccacatagatgtcttacaaggcctcactccatgtgctcttctgtgtgtctaagaaaaacctggtaagagagctgacttaggggaatgtctctatatgaacacttacatgacattatctttccattaattaatatactgaaaatataagtgtctgctatgtgccaggcactagctgagcacgaaatacacaaagttggataaaacattttaaaattattcttaattacctatggatgggaatgctactgtacttgaataataatgaaataactagcatgcatgtacactttccacattctaggcactgttctgaccactttatctcatctcatctcatttaatcctcacaaccaggtgagatcagtacaattattatccccattttatacaataggaaacaagcttagagaaatgaaacaatctgcacaaggtcacctatctagtaagtggcaagccagagtttccaagctgtgtctgtctgacttaaggcttcagctgcaaactcctactctgtgtaacctaacaggtgcttcactcacacagccatctctacactgtatccattgaccttcagccatatggaaacggagaagatagcacttattgcttgtttagagaaggtggcttgcttttatctttttctaattcactccttaaaataatccctttcttgcatttatccctcttttttgcagaaagcatatctttccacctattttatcgtatttgacctcattaaatccctataaggagagaggaataaattttattacccctcctgagtcaaggcactgtaatacatctcctcttagtcaatctgtttaactcaggcaacctcaggaatgtaaaggaaaatcagaagcttgtgtttggacatgattctgctcctctgagaaaccctttcacctcaacagtctacagatttccatggaagaccttgagacggtcattcaggaattgtagcctgctgtttcctgtgcattcaggaagacatgaaagcaattacaaattgcttaacagatgatgcataatattagagatgaagaatctggctgtgaacacttgcaccagggaaattctgctgtgtgatttctcttccagatcagcaccttgtgctaacagtatcgtactggcatgatgctgagtactcctaaataatgatccagtataagaagaaaattaaaatttcagaaactttcactacatagaagaaagagcatggatgtctgtgcttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcatatatatctatgattcatctccttcagccaaatggtctgaaatattcaaggacttcaactgcctaaaggcttttttcagataacacaattgtgcatatactcttttcagctttaaattcaaaatactgtccattagatttttcatattctcctagttgaaagactttttaggacatctaaaatttgtgtgaatttttaaatttatgtcttttgagttattttcttcttttattttgccaagaattaatatgcattttaaagcaatagaaataatttgtccctttgcagcattttttatccctttgcagaatttattagacaatagttactacctttatgaagcagatttcctggacatctacaaacttctttaaattacagtgttagtagtaaacatgcttttatgagattccacatgtggaaaaaaataactttttaagaatgtttagtttgatctctgcccaataggatatcatataataaaattataggtaaaagccacaaaaaaaaataaagtcataaaaaatgataaaagttatctggtgaaattgattagcaatgtatggatcatttttctcatttacatttttctagaaacttattaatttttcttcatcaaaatgtgatgctcaaaagttgaaagccagaatgccatcacaaataaggaggaaaattgtcgtagtttagaatgcctaaagttacaattgcataacatatgctgttaaaaaaatatatcctctattagtcatttctcacaaaaatctgtgatgaactttacataaccaaaaaatccctggtatctcagcagggtcactccagctgtcagtgtgaatacatgcaaaatgaaacaaacaagatatacctattttctttctttgtctgaaaaggatggctttcattcaaattcacatcatacatttgcagataaactatatttttgcattgtgtgatttagtgacatcacattttcatgcaaaggaccattgaattccctaatgatgttctgattttcttaacaatgaacaccagtgaactttcccctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacctgctttgtgaaggaggtaactcattaagcacgtttctttacattgtttcaaatacgtcatttagctagttatatgaaaatctgaattcaaattcttaatctatgtgtctacattttctacttcacacactctcttacctataccccaaaatggaattaaatggactgtgcatgaaaaagattttgtttctattacccacaatctaattatattattttcacagtgacattatgaaactatccagtagatgcaacatgtttgtcacacaaaagataaattgtgctttcttctttatttcaagtaaagaatccttacaattctcatagcattccatctacagagggttataatttccccagatgtgactaaaatggccatagttatcattaggttttatatcttgtctgagtccatttaggctactataacaagataccataaactgggtggctcataaacaacaaaaatttatttctcacagttctggaagctgagaagtctgagatgaaggtgccagcaaatttagtgtctgatgaagtccgcttactggctcatggtcttttcaccatgtcctcacatgtcagacggggcaaaggaattctctctggcctcttttacaaggactctcatcccattcaggaagactcagccctcatcacctaatcacctcccattggcctcacctcctaataccatcaccttgggagttaggatttcaatgtatgaattctgcggaggagacacaaacattcacagcacagtgtacctattcagaaattcagatattccacctcagctactatgtcatcaagtaatcagggcttttttgcatttttacaaggttcactcatatctaaatctaaatctaaagagggtttttttgcatctttacaagattcagccactcaatgtctttaaaaaataatgaggcaaagtcaggaaaacgctttttagaaagggttattctactggcattaaactagcaagaaaaaaaatattggcatctttcatttatagaacaggtttaatttctcaacacttttatgttttgacttgtttattcctaccagctctttgttataaaagatagttacattattatttataaatctaacaacaaacaacaaaccagccaaattcccaatgttgtttatgtatcatttttcaaacctattcatttttctcaaattgtgattgttttctctttgtcttgtttacattttttcctgccaagttaattctccaataaactttatacatggtccgtgacattgctccccttctggaaacattgatacccaaaatcctactttatatttttacctttgcttttaatgagaaacccaaatgtatcttaactcttcaaaaaaaagttactgagtatacgctatgtgctaggcagctttttctttttaatatcactattgcctgtagcttagtttttcatttttacctcatggtcttgaccaactaactccaaacttttcttactgaggtacaaactaagaatgactattttctctgtcctatgcctttcccacagttaaaaaaaaaaatctctcttgtctgtaactctatattcatatggtgcacactgttaggcaaaccgattaaaacccaggacatatttaatgaaagagggagaaaggtgagcagatatttacggcacaatattgcaagtgctatactgagggtttgggaaggtgttacagaaatgcaaagaaagaagaagggccaaacttgaacgagaatggtcagggaaaggctcggcgaggatatgacagtgagaaataagtaggagaccagtaggaaaacaagggaagggaagttgtaccaggcagatgaagcagcacgttcaaaggcttggaggcacaagaacatggtgcaatcgagaacatgcacgcatccgctctccttgttctatttcctgcaaccctatatgaatttgctttcacgtagtaagatttctgttgtgtaagcttaatctcctttgatatttctttgataatactttcatcatttttcttcttatgtccatagacttcatcctctactctggcatcatcttcataggttgccctttgtattcttaaaaatcttttcaagtgggatcaccttttccaaaagcctgtcaagaggtcaggttatgtttaaccaggaccctcccatgtctactgtgttaatccttcttgcttgtaaatattaggagagccaggaacattcacaaagctggtcttttttatttctcacgacacattgacacatctaactcactttttccttctcccacaattcattcccccactccaggtgacattcttcccctactgatgagtatcaaaacatcccaagcctatcccttcaggtgtgttgacctccctctttacattatagtaaagtgcttgtgcttaatagtaaattccattctgcttccaacacggcaagcagtgctttcctacacttgtacgattttatttagtcccccaagaccctttcaactagatctttctttctggaatctaatgtctcctcttgtcagatagtcctttttcctggaacttgggttttatccacagaaagcctgttatgtttgtctgtttttccagcctttcctcgtatttcttctgtgtgttcttatgcctttcctttccttgtatgcctttgcttgtgttctctgatgctttttttttttttttactcgcaatcttttctttaatcttctgtggacttcaaacacaggtccgtgtttgaaaaggcagtggtttccctttcctctgcaagaaccatcttctccaggcacctttatcttggctcttgctcttccgactagcttatttaaattcctgctgtacctttcaatccattttgagagaagtataaataatatgtaacattgataacattttcctccattcaatcaacaatagtttaccaacacacacacatacccaaaatacccaatgacaacctctttttagggtccatccattcaaaaacacataccctgtgctaaacctctcatgctaccttttccttatctgagacttttctccaagcactttcttctcatgtgatttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctactgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttcttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccctctgacctccctaacactgcactcattcattcattcattgagacaggatctcagtcttttacccaggctggagtgcagtggcaatcatagttcactgcagcctccttataacttctgggctcaagcaatccttccacctcggcctctggaatagctgggatgaccggtgcacaccaccatgctgggccaattatttattttttatttcatgttatgtatttatttatttttattattttttattttggggggtggagacagggtcttgttttgttgcacaggctggtctcaaactcctgatttcaagagatcttctgccttagcctccaaaaattttgggagtacagcatgagccactgtgcccagcccctaacactcctttaaatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacagctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctgctctgtcaggaagcctgtgtataaatcattcagatacatatctctgccactaaagattatgcttctcagagttaaaagtactaaacaatgccttccaaggtttatctgccactgtttttcatgaacgctccaggatcaagagcacactttctggcatattgctttaaaatgcctcctttctaactgtgcaggtcaaatctgcattgttatttagaaatacatgttgcccatatttcaaaattacttggtatccacacttacatttacattttaacagaagataatactggttcccataatccaaatcactatgaggcagctttatcccagagcctcaaagtcaggtgaggacaggaaagtagaatgtttaaaattggatttgacccagaaaaccgaggacatgtggttgacagagggagaatgttaaagtgacaaagcaacttggtaaaaggtttgtctttggacgccatccccaaactgttctccattagtttctttccacttcgcatgtccttaggcaattggccatttgcctggattcctacttagccctctaccgagagcagcacccaagctatggggctcacctaccatcttccccatttttcaccatttccattgacttagagaaatcatccatattccaagaaaatgtcaactaatttttttttcttttttctttttcctttttttttttcttttttgagacaggatctcactctgtcacccaggctggagggcagtggtacaaatcatagctcactgcagcttcaaactcctgggcttaggcaatcccccgacctcctacctcagcctcccaagtcactgggactacaggcatacaccaccactaattttctttaatttttatttttagtcgctttgttgcccaggctggtcttgaactcctgagctcaagtgatcctcccaccctgacctcccaacaaactgggattacaactgtgagccaccacacctgaccaactaaaatttctcttttttttttcttcaatccctccctgcctccctccctccctcccttccttacttcctttcttccttccttcttccctccctccctccctttttttttattatactttaagttctagggtacatgtgcacaatgtgcaggtttgttacatatgtatacatgtgctgtgttggtttgccgcacccattaactcgtcatttacattaggtatttctcctaatactatccctcccccatcccccgaccccacaacaggcccgtgtgtgatgttccccaccctgtgtccaagtgttctcattgttcaattcccacctatgagtgagaacatgcagtgtttgtttttctgtccttgtgatagtttgctcagaataatggtttccagcttcatccatgtcactacaaacaacatgaattcatccttttttatggctgcgtagtattccatggtgtatatgtgccgcattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaaggaattgccacactgtcttccacaatggttgaactaatttacactcccaccaacagtgtaaaagtgttcctatttctccacatcctctccagcacctgttgtttcctgactttttaatgatcgccattctaactgttgtgagatagtatctcattgtggttttgatttgcatttctctgatgaccagtgatgatgagcattttttcatgtgtctgttggctgcataaatgtcttcttttgaaaagtatctgttcatatcctttgcccacgttttgatggggtcgtttgatttttcttgtaaatttgtttaagttctttgtagattctggaaattagccctttgtcagatgggtagattgcaaaaattttctgccattctgaaggttacctgttcactctgatggtagtttcttttgctgtgcagaagccctttagtttaattagatcccatttgtctattttgacttttgttgtcattgcttttggtgttttagtcatgaagtccttgcccatgcctacgtcctgaatggtattgcctaggttttcttctagggattttatggttttaggtctaacatttaagtctttaatgcatcttgaattaatttttgtataaggtgtaaggaagggatccagtttcagctttctacataatggctagccagttttcccagcaccatttgttaaatagggaatcctttccccatttcttgtttttgtcagttttgtcaaagatcagatggttgtagatgtgtggtgttatttctgagggctctgttctgttccattggtctatatgtctgttttggtaccagtaccatgctgttttggttactgtagccttgtagtatagtttgaagtcaggtagtgtgatgcctccagctttgttctttttgcttaggatgtcttggcaatgcgggctcttttttggttccatatgaactttaaagtagttttttccaattctgtgaagaaagtcattggtagcttgatggggatggcactgaatctataaattaccttgggcagtatggccattttcatgatattcattcttcctgtccatgaacatggagtgttcttccatttgcttgtgtcctcttttatttccttgagcagtggtttgtagttctccttgaagaggtccttcacatcccttgtaagttggattcctaggtatttttttctctttgtggtaattgtgaatgggagctcactcatgatttggctctctgtttgtctgttattggtgtataagaatgcttgtgattttgcatattgattttgtatcctgagactgctgaagttgcttatcagcttaaggagattttgggctgagacaatggggttttctaaatatacaatcatgtcatctgcaaacagggacaatttgacttcctgttttcctaattgaataccctttatttctttcccttgcctgattgccctctggccaactacaatttcataccatgatggatgccatgttgcccattagggggtgaaacagtgtttcatattgttttaaaggacccatagagatctaaagctttagctaaaggtaataaatggtagaatttcaagtacctcagcacactatagcataaagaatcttttgacaaggacacttttggaattcacttttccctactctccactaaaaagtcacagtagtaattatttacaaattcctctactttctctatagtggtccttcctaatacatgtttctataatgacacctacaattttatgttgaatttttgtttatatgcctgttcatgccagcattgaaaaagcttcttagggcaaagacatgttttaatcatcctttgtttctagttctttgtagcatgactggcatattgaaaacccaacataagggtttgacatataagactaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctgtctcactgaacctctgccatcttcagcatttcagcatgtagcttccaaggtcactctgaggtcactatcacagacatagaaaagaaaaaaaatcatgggtaggagttctgggggactgggtctaggagtggtgcacatcacttctgttcacattccattagctagaacccaatcacaagaccacatctaactacaagaaaggctgggaaatgtagtctagctgtgttctcaggaagaagagcgtggacttttggtaaactacagagactctggcagtctctgccagagtggaatacttaataaatacattcattcttttttttttttttttttttttttttgagacagagtctcgctctgttgcctaggctggagtgcagtggcatgatctcagctcactgcaagctccaactcccaggttcacaccattctcctgcctcagcctcccaagtagctgggactataggcacccgccaccatgcccagctaattttttgtatttttagtagagacggagtttcaccgtgttagccaggatggtcttgatctcctgacctcgtgatccacccgcctcgtcattcagaaagatgtgaaagatgagtgaaagttaactaagtaaacgggagggtggcaagagggcagaatgtcaagcaaaaggaactgtttatgtgaagcctctgaaagtgtaggtggcgtggcacagttaatgatataaagaaggctttccccttgtggctgttgcgcagagggagaaagaggcatttgatgaggcagaggaataagtaggaaatagaacttgaagattattctaaatgatcataagaatttgggccttttaactcaagagagataggagacctacttaaggattttaagatttggttttttgatgttttgttttttagagacagggtcttgctctgttgcccaggctggagtgcagtgccacaatcatagctcactgaagactcaaactctcgggctcaactgatcttcctgcctcagcctcctgagtcactggaaccacaggcatgcaccaccatgcccggctatttttttgttttttgtagagatagagtctggcttcattgcccagactggtctcaaaatcctggtttcaagctattcgccctccttggcctcccaaagtgcggggattataggagtgagatacgatgcctgttatttaaaaggtgactctgtcaattgtattctaagagtaaatttcaggaaaccaattaagagggtattggagtaatctatatgagagattatttgatcacatggtgaagactataaggatggaaacaagtgaacttattgagagattttatgataaataaaatcagaactcaaaagaagtcaatgatcaacgatcagtgataatgcccagttttctggcttaagcaaccccttggatgctaatatcatttgttgaaatcgagtgaaccagatttagaagaaagatcataaattcagtttttggcattcgagtctaaaacgagtgtgagatattcaatgactagtggacagttagatataaaagtctggggcttagagaaaatatctaaactagagatacaaactggagaatcacttccatattataactaaaaccatatactgggataagattagtttatgaagaaaagaagttagttataactacaccctgcaaagggagaccaagagtgagtggccagggaggcagagaaactaaaatcaggaaatcattgtattatagaatccaaggaaagaaagggagtcaataaattctgctgaaagttcatggaaatgagacctgcaaaatattaatggttcggtaatatggatgtcatttgaaatcttagtagcaactattttaataaaatgatggagagagaaatcaatggaacatgaaaaaatggggacagtgattgtaaccaatttcttcaagaaatttggctgtgcaaaggagcagagagacatggcacatgtagaaaagaggatagttgaaataggaattttgttatgataatagcgaacactcacacagtacattttgtgagccaggaactcttctaactccttttttacatactaactgatgtaattctactgactccatcactattcttccattttagagattagaaaagtgaggcacagaagagaaagtacattgcctgaggcttagtaggtaataagaagcagacttgggaattgaacctaagtagcctgactatagagtccatgttgttacaaagtcactgaggaatcttctaagcatattttaatgttgaaagaaagatctcaaatgttattttgtcttttgtcagtaataaaatatttggcacatactcccaatatttctgtctttctataaatcatatatatattgtgctataccaatatatgatgtgttttataaaacatataaatgaaacacaattttgaaaatatgggataaaagtaaatataaatagaaggtctaatattgtcttctcatactccaatggattatcttatgaaatctgcaatgaagataactaaagaagagagggaaaggatagagaaaaagaactgagtgcatttactggtttcgactacatgtgcaaatttccacaaactccgtggcttaaaacacccatttattagttcagtccagtaaaacagagagaaaaactagacaggtagctctaataaagtaaaatcatggaaatatatgatttcccagccagaagaaccttcaggactgtgttatccagacctgttttataaagacaaggaaggtggatcccgatggttaagcagttgaccacatttcacctccttcaaatccttcttatacagacattccctgaacttcctgtttcaaattgctatccttattccccacctactttacatgtttccacagcacatacctcaccaaacatgccttttattttactgttattttgttgactttgcgtgtcttactgaccactgtgcccaagtgcctagaacagtgcctggcacagaggaggtacccaataaatatcagttataccaaaaaatagtgaatgaatacacatggtggtccagtgctctttccaccactctatactgtactttactgtcactttttgtttgtttttgttattgagacagggtctcgctctgtctcccaggctaaactacagtggcacgatctctgcccactgcaacctccacctcttgggcccaagtaatcctcccacctcagcctcctgagtagctggggctataggcacgcatcacaccacacctggctatttttttgtatttttttgtagagacaggatttcaccaagttgcccaggctggtctcaaactcctgggctcaagcagtctgcccgcctctgccttccaaagtgctggtattacagccatgagccaccacacccggcctactgtcacttttaagaagcattttgattttctattttcatccttattttgatcacatcagaatatctgcttttctgtgaattattatttctaatgggaccacaagtgtatcagttaatcaaaatataaattatggacatcatgaggaaattttgaatttctaaatcataaagtggaaatccattttcaattaaattacatgaattttacacttacagaagagtaacttggtttaagctgttcaaggggtatagtactgtgtacatgcattcctgtgcctagaacactcatgccctcttgtggacagggttcatcctgacttcctgccgaaccttccttatctcagctcaggtaaccgctcctccaggacacctatatgtcccctgccctcctcctcctcccacagacaccagctctggttaaaaggggaaaactagaaggcttgtcttaaagctacatttgcatggccagcacattggttttacaaagaacatgcatttggggtggcttgcagaaatttataacgattattgagggaataaatctctaaagtccccctctccttagttactagaccctggaaggtttcaatcttcacctcctatagcatttgtgccacttctgtagtacagtcaatgcattatatttttactcatctaggtatccatagagcctagactagaacctagaagagtctgtggtggaactcagtaattattttttaataagaaatgaacgaatataaaccaatgagttacagagtatgcctaaagaataagcatccaaagatacactctctttcacctgaacaatttactatacatttgtagactaggccagattcagtctttctagcctgaacacattacacagcaacatttcacactgtgaccatctggtccattagatgtaaataccgatttggcagatacttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcttacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatcattaatttgtgtctattcaatggctgcatttttttaaaaataatgaaattatcaagctgctcagaacaaagctgccttctgattgtcagctgtatattctaaaagagcaggtaaatttctctgaatctcacagctggaacttttctaacactaactggcagtttccacctagtgatcaaggcaattgactaaaataaattacacataaagctgaaattcctaatagtaataaggccccttcatgagataatcacaccagcaaaagcactcatgtgttggctgcaaccctacagggtcttgaaattatcttataaaagctatacctccagaaatggttttgtttctagtttcatgacagggctaatatgacagtgtccatagcactaggtacaaaggaggagctccaaacaaaattcgttacttgactggattaaaatggagacactgttgttaaagcactaacatcagtgctatttacaaagcagatgactggtgaggacctcatttcaatacagtcaactgacaattatttcgaagcttttattatgtgcctggagctaggcatagaaaagtagtatatagtccctgctcttctggagtttaaggtgagttgagctcacgtgtaagaaataaatagggaaaaagtaatctcgaggcaccattctaccagctataaagcaattgctagcagaaatccaagtgggctagaatagtaaggaggtttttttgtttgtttgtgtgtttgttttttctttttttttttttttttgaacatggactagggcttaatggttaggagtaatttgattaggcagaagggaataaaggattgcagatggattttccaactaagcaaaagtctggtaactggaaggaatatagctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcataccagtatctaggagaatattgctgacagaaggaacagcaatgcaaagatcctcagatagaagtgtgtttggcatgttttggaaagaggaagtgaaatctggagaacagtggtaggatacgaagggggcagatcatatcaggccttttagtgtaaggaacagatgttattctaagtaaaaagggaagatctcaaagggctttgagtaggattgtcccatgatcagatttccattttaaaaggatcatgctgccttttatgtgagaaggaaactagaaaggagcaagaagagatgcagagaggctattatgaggctattacagaggtctaggtcagaagtgacaatgacatggacttaaggttgccactggtcatggcttgcctgggactgaggggtttcccaggatgcaggacttttagatcttaaaccaggaggatcttaaacaaatcaggatgtttggtcaccctacttggactagagtaataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggaggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagttagtgaccctgacagaaagatgttggaaagaatagttgaggggagggattggtattgaacattaatttagttacagatataaagtaagagtggaataaccaagtggatggccagctgggatattagtttctatcattccagacagcagtgtactagtaaagaaaactcatgattttgagttaaaagagtttgccccagttcctctctgagacagctatgtaacctacaccctctcagtctcaaagtctttatatataaaatggacataacagtacctcgttcacagggctattctagaaaaaagtagacaaaattgtcaaggagcagcaaggatatgacttgggtatcttcttttttctttgcaaattttccaagaacccttttagtccccatcaccataatcccaccaaagaaaaacattctttttaatttagaaaatcttggtttctagaactttagagtgataaataaaatatttatattaaatgtttataaattactatgcagccatctttcttccaaactggcatgccaaaactatgaaattagagtttgatgtaaaactgttcatataaaactattgggttcttctaattcttctatgttgatggacaagagatatagtaaaagcttcacatgctagaacaagactctagggacagaagtgcttttcttctcatcacagaagttcagtgaaagacttcactgaggaaatgaaaatattggtttccaaaaattcgtactggcatgagtctttaaatctgattcagggtaacaacactggcttactatataagccacaaacacaagccttgttttgactggggcagaatagaacacaccttgtggggatgacacagaagtccagatcgtcctgccgtgagggtccttcttgcgggcagtatcagggcctccccaggatgcatattcttttttttttttttttttttttttgagacggagtctcgctctgtcgcccaggctggagtgcagtggcgcgatctcggctcactgcaagctccgcctcccgggttcacaccattctcctgcctcagcctccagagtagctgggactacaggcgcccgccaccatgcccggctaattttttctatttttagtagagacggggttttaccgtgttagccaggatggtctcgatgtcctgacctcgtgatccgcccgcctcggactcccaaagagctgggattacaggcgtgagccaccgcgcccggccctcaggatgcatattcttgctcttgtttcacataaacttcaagtccctcatcctccccaacatgtgagaaacacatgacaatcatatttgcaaatatcctagatcaattaatcttggatcaaaccaccaggtagtaaaagaaagctgccctaattttcaaacttttggtagacaattattaaagctaattcttagggcattagggaaagcatatacttaaacctccaaaaatttcactaacaagaaaatggttagtataaattggatattttccttgcctttttctggaaatgagtttttctctatcttgttgatgcccataaaggacacaaatttcaggaaaatcaaggactagctttcaaatatcttggagatccagaagtaataaaatgctaaaactttttgaaaagtaacttcagttaattaatataaactacacattcaatttggcatatcaattacaataattttatgagcaaatgaaattttacatgttaaagttcttaaactaatgaagcaaatgtagatctgtaaagggtgctttaaaaaagcacttttccatatttttctttctcccaaaatgcccatatttttctcttaaacactcattcttctcccatcccataactttaaaattacaagtaacatcacagatttctcctgcttccgagcatgctttttcaaactgtacaaatactctcttctgaagataaatattatgtaaaatcttttaaacttcctatgtgtcataagattgaggaataaaaggtattggaagaagacatttgtgacatttctttgttcaacacaattgcaatgcccctaaattaatcgtggaattagattatggcccataaagggagatgttatttaagagagagcagtcatgtctgaaattcctaattagaacagttagagtaacctgatcctgcaacacaatcagttccccaaggaggctattgtggaaaatagacagaattctgcgaaaaaaaaaaaaagagccctcctcctaacgagcattttgaacagcaattttgttcatttacatttctcttgtcccataaagttcagataaatttgtccatattttatattaatttccatgatattgtctcccattcattattttcagatactctgaagagtaatttattccactagcctctcctgttgtataaattaattcctaggagtgagtaggcacatcaggtgaattcagcacattagaagtaactctttattatttatattagtgaaagggggttatgacctagataattcaaaacaggtattttctaaagtttccacttatttaagttttgaaactgtgtggaaagtgataatttaatgatggatcctgtcttcaaggagtttacaatcatgtgggagaattaagacatatacacactgagacaaaaacagagttcttggtaacatagagatgtatggtaaaatgctatggggactcaagaaatgaaacacttggagccataaacatatttggtgatgtttccagcacagacattactttagcagaaagaggcactatttctccctcacacattgaatgtattacctctcaattatagaaaaattacaatctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgtgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgttcaaaaatgcctgagtacaggactgttgaatgttctttgggcctaaagtatggttatcagtgaaataacatgagaagttatgagatgcatttgcattgtgttactatgggtttcaattttctagcctgctgctcagatttttagaattaggaataaaagttagacctcacttaagatgagtaatactaaaagtgcgaaaccttatactttgttacatttcagctatcaggaattcagaatttctcatcaataaatagaatttaatgacacacaaatgcaagtccttttcccaaaaacctagagtattagaggtaatcctatttgaaatgtaaaaggacaaaaatttaggtcgattgattcaactaaagtgttaggcttatttcaaagctgtttaataaaaacatgaaaattttgccaagagttttgcagtgctattcagagcacaaagtctctttaaaaagtcatgttgttctcatttcctgcaccattgaattatagatatattttgatgaacattaaagtatagatgatctttgttaaaaactgaaatagatggtcttaaaaaaaaaaagctgttatcactcttgataccttagtcaatgaaaggccactgtgtaaatgccaatggacctacaattttcaaattctaatcaacataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccacttcttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatttattaggtatttgatagcctaacatagttcctacgataccatttattaaagacacagcatttcaatatatatgcataatgaaatctctgtttcagagtgaacccctatggtaatgcatttaattccacagctgacattgaggatgggagagatgtggggattgaaatttccatacaacccaaccttagtaaaacgtggtggataaagtataccctggctcaaaagcaaagtcaactcaaggacttgtcacttccacggttgaacataatttttcttcttctgcatatgattaaatcaattatatttttaattttccgctaaatcattaaagtgtgaggaattttcttgatatgccacaaggtcatcataaattgactgcagttgtcattgtttgtggctgtggaattacaactaacattactggttattcaacactttctttaataaaaatattgcaaacttcaaaaggtcatcctaaggcagcatggtgattttttattctaaagcataacagctaaaaagtgctacagctgagcttcccctcacttacccactaatttgtcgaccaaattctcctggtacctgagtgtatttctctttataaataagtcacctggggaagctgtactaattctttcatgtcattaagaccctatttaataacttgctgtttttattgtgcctagcagtgtaacacagcaaatttgaagcaaagagcacagtgttctctagaagtatagagtatttaatgtgactataagtgaaaaacatgcagagaaatttttaactacaataacagttccctcctagattattacttagtttcctaaggtaacttcagacacctttaacatttccctgtcctttggttcaacagccaactatcatgacatgatttctttgtatcctgtctcttatgctttgtcccaaatatccatgccaaccatcccctcataacctatgtctagtactctgctagtcttcctaagtcatcctatctgcttcagcagataggatttgtcctggcttcttccggggtcccagaaatgagttcccatcatcatagagagatatttcaaccacgagttgttcatcccagtttgctgtctgtttccactaggacttctccaccgtctgtccccttctcgttcagtggcatcagagaggctggctgcaggcattttggaacttggctaagggaagttaggtctagcaggttatttttatggggcttacagtcatataatgtatagtgaggttattgctagctatcccaaagaaggaagggtacctgcaatgcactaactaactcagcattgtgaaatgaataaggaaaggccaaaggtcatacctaattttgtattcataattttatattctttgtttctgaagagaaccagcaaaaccatattagcttcaggatcctcacaacctgggttcacccctacatttgaattacctggaaggagtttaattattaagtaagaatatttaaagagtaaatatcctgaaaagccctaattttaagggcttctcactgcctgtagaattaagccataatcactctaatcacttgagtctacataatgtagatatgtccagcctatgtcatgccatatctcattttcaccaaattgaccaacacactcttttgcaaacaaactatacaactttctgcctctattacttgcttaggtcgtttccttcacctggaattctcttccttccaacaatgtctagccaattcctacccattctttaggcccagcttaagtattatctcctccattcattcaataaacatatattgtgtccctactttaagtcaacattgttctgagcactaggtttacatttgtggataaaacagtgcaaaagaccctcccctcctgcagcttgcattctaatgtagggaaacagaaaagaagccaacagatagcaaaagcatgagtctaccaagagataacaggtgctatggagcagtaaagcaggaagtaggataaggaatattggggattcatcttaaatggggttcaaagaagacctctgagtaggtggcatttccgcaacaacctggaagaagtgatgaattgagccacggcgcgtctgggagagagaacaaccacggggcttctgggagagagaacagccatggggtgtctgggagagacaacagatacctcgtggctcacttcttcacttcttccaggttgttgctgaaatgccacctactcatgaggtcttaagacctcatggttttaagatccatcccagtagaacaaatctttgcctttttttaaatgccattagccatttgtttacacccctcaaacatcatgcttctctctcactagactgtgttctgtatttatccctcccacaatgctctcagtgatgggtagcactaagcatagctgctgaatgaataatgaattatttacaaaggagctatggcctgaaaaaacaagtcttgcatttcaaatgtgtctaacccacttaccattaaaataactttaagcacttggatggtctgtctcaaagtaagttgacctatgtacgaggagaccaaaattatataataagatcattccaggtaattcaaatgccaaagtacatttgctggaaatgactagttaattggaaccaaagtgggttgttttgccagagtttaaactccatctgccactaactagcaatttgacattgcacaagttatttatttaactcttctaagcctcagctgcattatctataaagtgggaataatgagaggactttgttgatgatgctatgagaaataaatgaaagcacagggcctggcacaactaagtactcactaaatactattgtagtcatttctattagtaattttatcaaatcttgggataaatatgcaacatgggaaagcaaccaatggatgatttaaccaattacttgcttcaatggggaaaaaaagtttatcttattgtttgatggaattagctgattaattcaggcaaacgtatcagtaggcccacattttgcatagacactatagtgaattaagataattaacaaaacatttgagaaaataaaacatgaaaacatatgtaaaataattttcttattgctctccaacaaggttatttccttcctgcagtattcattcaaaatgcattgcacaaagatttggcctctattgtatatccacatgcaaaaaatgcaaatctcagcccttcatactttacagtgacaagcctaattggactatgcacatctctacagtagatccttgcatttgcattcttaatatcccaactttcaaatgcttgtgagcaacagtgaggatttctgaatttaactgcagtcatgtgttgattaacaacaggcatacattttgagaaatgtatcattaggttatttgatcattgcacaaatatcataaacacaaacctagatggtgcagcctgctacacacctaagctatgtggtatggcttattgctcctaggctaccaatctatacaacatgttaccatactgaatactgtaggtaattgtatttgtgtatctaaacatagagaaggtacaacaaaaatacagtattataatcttatgggaccaccattctataggcagtccatccttgactgaaatgtggttacacagggcatgactgtatttgtattgagatcttgaatcttgcaggctgcaagactgttcttcaggagcaagttggtgctgtagaacatgtgtaggactttttgccttatacgtggagacaatcaagacttctgcctcttaaacatgtctcaatagcttcgttgccttttacacatctctgtgtggagtaaatcttccttcaaataagaaatgttttctatttgggaaaattggggaagagaataaagaggtcaaagtaaaggcattggaaacattgaggcttcccaaaggtatgaggctgtgtgtctcatagttttaagctaaagtatataacttttattcttaaatttgtacctgtgtaaactcctaagtcagagactaatcagatacgttgctacttgtccctatttgtgtcatagcaatcactttcctcaagtttggtgttttgttttgttttttgtcatctcagaaatttgacacgtctgagtacagctttaatgaggaatgtcaacactgtaagtttagtttaggctttctgttgtaaattaaatgaaattctgaaagttttctatttaaggacatggccgtttaaagaaggaaacactaaactttaaaataagcaaaaattgaagtgattatagcttttaaattttgatctattccgtagaaattctgtttttctacttcaatctgagaattatttttaactgttaaaaagtcacattatcagttatagaacactttctaatttagaaatattttttaacttggttttctcatgtggttctcatgatagccctgtgagatactttctgaagatagcattctgattttaccagtgagaaaattgaagcttagagacattagacaatgtccataaactatcttcctgcatgtggcacatagatgggggtgttcaatacttgcaattgctcttatcactactgacatttgatctcagctgatttgagggtaggactgaagttcagatccccccagttctcaatgcagaggactttctaatatagcattcagccttgcccacacccctaccttcaagatgggagagcaaggattcctcagctctaacctgcgtgaggtgcctcccctgcccaaagccgaaacatcaagatgaggtcgtcacagtagggaagactagaaatggagtcttcatggattgttggaaatggagggattcttggagactggggaaaatgttcgtaactgtaaacccttaaggatactcctagtcaaatagctccagggtgccccctttcttgccttctcagaaccacaaattgattttcttgcttcacttgtggtttctggcagattcctcttcttgcctggcccaatatgaaacagaatgtgatctcacagacatgttctacttccctcattccctgaagctagcacctaattcttctgagacttttttctgtgtttgtactgctagtagccatggcaaatcaacaagggtaaaaagtgtgcagttctgctcgtttgatgtggtttgcattcacctaaattggaggagtagggaacataacaaaagtatgtcaagcatgggggcaagctggaaacccatatggtaaagggctgaaatcacatgtagctattccagcagcctcctgaacatcaaggagctagggaggtggctaggaggtgggatcaggtcaacaatggttgcaaagtgctctccttcatcatttttctgtccctttcactctgtgttctatgacccatccctagtcctcttcctggccatccctagtcctgccttgttactatgaaatgaaacctgtactgtgaaaagcaacatttggggctgtaggagagttcctccaaaacatctctaagtctccaaaagaaaagggaaatgaaatgtttgaaagtggcagcaattacttgagggaaatgatagagagggaacaggggactcgtggtgatgaaggagtcaccatcactatatgtcacactgccagtgtgtggattagctactgtgacctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcaaaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcctcaaataagaagttctatttctttcatcagtccagtatcctcttccctgaaaaatacctggcccacatgtctaaattattatctttttttcttgagtctcctccactgaaagaggaaataaaagcaatagatgtttcctttgtacattctgaagttgtttcctagtacccttgactaccacccttatctgtccttccactggtgctgaaagcacaacaaagaaaaacactccaaattcaattgatgtgaactaaaagccaccagtctgggagccgggccaataaataaaatggcaaaaacttatttgaaccaattagacagggatatgcaaattaattggccatgatatcagggtcaagcaataatatgcaaataaactggcatcttattgagctaatgggacaggaatatgcataataatttggctgtgatgtcagaagcttcatcataattttaggcatgaatgttacaatataatatcaattctgggatacttcaaaatgcttaattacaatattgataaaataatctgaattcgtaaaacatgaacagattggtctaaaaaacaaatgacaagtcttgaaactggatcattctagaaaatgagtaattagaaaggattatagccaagcccggtacaagttgggacccaggcacagttatccacagaatggatagaaatgctctgcctgaaggactaaaagttttagagaaatgagcagatgtgaaatcaagagaaataagtgataggctgtaatgtatttgttcagaagagttagcccaaaaactcctaagtagattctttagccagcaggtatatatccaatcagtcaacaaacatcatgtgaaaactcctctgtgccaggcaccatgccagtccttgagaatatgagtaaaaacagcagacacttgcatagcagaatgtgagcccagacactgttctaaatgctttacatatggctaactgatttaatccccagtacaaccctatgaggtagatactatttttaatgtgattttattgatgatggaactgaaggacagagaggtacataacttacccaaggtcacaggattactatttgacagagctaggatgtcaacccaagcagactgtcttcagactccaatgaataaaacctgatgtctaggtccttatcattgctcagcaggttcaacctggagaacaggtggataactacatgctgcagtttgaaagatgtccaaaagtgacctgattccaaatatcctctatactcaagctaaaattctatcatggaactcactaacataaatcagttggttgactgtttaattagttcttcagctacttagacagcaaaggtgagatcaacaagtccataacaccagacattgaatagttatagatgatttttatgctggaaaggactgtatcagtttctccctaatgtacagattggtatgttattttagtgacttattcttcacacacaaaagaagatgagacacaaaacagtgacatttcagctgtatctgtggtacagaagagaggttgccgaacatggtagaagagagtccaagtttaagggatttgagtgccttttagagattaaagaaaaattttacctacaactaaattttagcaagggctaattctgtaaaggagtatgtgatattattgggagaggggcagtatgatgtaggagtacaaaagcttactacccttgtaaattgttatgggactctttgggtcaaaattacatatataaatactaaaattaaagaaatttgaattgcaatagacaacttaccaggaaaacacatgtcagctagataattttaacaagagaaatctacagatgaagaagtagaaacagggagttccaaagaggtctgttctaaggcactttcaccagtcaccttaaaactcataattctgaagataagataaacgtttccagccattgaaatgcaaagctcagtggtaaatttaaaaaatctagctaagctgagtaagccaaaaaatgtggtagatgtgcttcatttgggtcaagctaaaaaataatacactaaaaggaaaacgtgacccaatttagagtatagagtaataggatcaattataaatcaagaaaaatgtcacatagaaccatccattgaagacattcaccaagtgaacatgtcttttttgctaccccaaaaaaggcttgatgttgtcacagaagattttataaataaaagggagggaaaatctcctacctttgtccaattccagagctcattcatgtgtacaacacacagagttttggttgttcacctcagaaaagacagtggtattagatgactatctgctggaggaaagcagctacaataaagggatgaaggggccgtgtgtgaggacaggctaggaacagcgggactttgtggtctgaaaaggatatgatgaaagtctgaaaatcatgaaaggtagagctagagtaatacctacctatttatcacatcccacaatactagaatcaggaagtcaccttgatgtttgaaagagaatagataaaagggatagctattcaggatgatctcaaaggcacctttctactcaaaaattctttgtcaaattttctttactactttacatttgggttgtaaatacgtgttgctctaggaaatggaacagattgaaatataagactgagataagtgtaggtctgttttgtgttataggcttacaaggagacatctctaaacctttgtgttgtcttgtaggaacccctcatgcctttccatgggtaaccataaatagcccacagctgcatatctcactaatccaacccagaatgcttacatttgcatccttcagttggccacttctattcccttctcttcattcagtatacagaaaaaaaaataaggagggtcagaatttctaataggtaattgcactgggaggaatagagtccccacaaattcctatttttaaaaattatgtttagtgggttctttcaggagatatttgggagtttctaataaaactattagaaacatgtagcaaaagtcggtgctattcccccttccttttacaaaggtataagattcctgttagtaaagcctataataggtgacaaaagcatgcaaagttttgagtctcaaacactataataatgctcagaaatggaaacatcaaagacagtcttttaaaaacaactgtactggccaggtgcagtggctcacacctgtaatcccagtacttgggcaggccaaggtgggaggctcgcttgagcccaggagtttgagatcagcctgagctgcatagtgggacccccatctctacaaaaaaaattaaaaaaaaaaaaaatagccaggaatggtagcgcacacctgtggtcccagctacatgggaagctgaggtgagaagatctctcaagcccaggaggtcaaggctgcagtgagctgtgattgtgccactgcactccagcctgagtgacaaagcgtgtccctgtctcaaaaaaaaaaaaaaattgtactttattataatcacttctgcttccaaaagtatatactgtttctacttggttccttaatcccttattcttaatctcagttataaaaatatcattcttgttcccttttcaccatagtcttgccacttgctgcaccatgagctactttgagagcagggattgtgtctacttatgtctgtgttctcagagcccctagcatatatgctgaagaaacagaccttaatataccctgcctaaacaatcagttttaaatttttaaattccactaatctaactgattattttgtcttcatcttccaaatgatctgacttaatttcatcacttaatgcaattattttggcatcatatagtagtaatcctattataatagaaatatcggctcataaataaaaaccagacaatggaattcttaaaaccaattggttattttagccatcattttcagaagattttacttccttccttcatttcccccctccccaccccctttaatggttaaacgaaagaaaaacagactatctccaagagataaaagagagtgacacagaaatgcacacattactgtagttatacctcaacgacagtcataaaggcattttcaagggaaaaagtaaagacagagaatgatcccttggtcaccttttgcccagcatgaacagataaggcaatgattcagcatcttacttgtccactgttttaaagactaactccttatcaaaggaagtcaaaagaccataccggctgacagcctttttaaattactaatggcctaaattttgcggtacatcattttcaatgatgactggacaactaggaggcttcctataattttttctttcagaaataaatgattttatttaacttaaaaaaagaattaagcgcatttattttatatcctcagaaccactgaaactgcttttagccaaaactaaagcaacatgattaagaaattaatagatttcaaactactgatttcagtcaacaatatgacagtgtaattaactaataaagtgtcccgttaacaaacaaaaagagccgaatgcacatttcgtgatagtgcacttgcagaattactacatatactacatatacatatgaaactgcaagattactcagtaatctactgacgcagctgtcatttttagagaatattatgaacttccatatccttattaaggaaacaaatgctttcacaaatagccctgtgtttaaatatttatctagaattttagttttaaaattataggaaagctcaagaaataaagttaatccacaaccccaccacttcttttcatacataagtaaaaaagtaactcaaatcagccccctctaatcctttcccattcctcagagttaattgactcaaggaaataatttgaaatttcatatccttccaggttttctttctgcttatatcaattctatacatatatatacaaatatatatacattttacaaaatgggattttaaacacattattctgtaattatttttaacctaccaatatataatggagatcctttgggccaacatatagatctgccatatctagtggttgcatagcatccctttgttcgaatgtatcatggtatatttagtaattctcttataaatataactatgagaaaaactatataaattcactgaaagacttcaaatgagacctaaataaatagaaaaataacatgctcttggatagggaacaatatagtaaagatgtcatgcttcccaaataaatgccataaatgaatttgaaagatgagtaacacacgaaaagaaagctttgcctcacataaacagatcaagtattaatatccctgtaatacaaagagtttctacatatcagtgagaaagaaaagcaataggagaaagtctctattttattaatgttcctaaaatttacttgctgctgcttctactactggctgctgttgctgagaagtaaaatgttacatttatacaatgtcattatgcatctaaataagaaaggattttaaagtaagatgcaattaccctaagttcaaaatctaaaaatgtgttgcttaaaaagacagcctagactgattgcaaagagtaccagaaaaaaaaaaaaaaaagcaggtcattagcttgtagattttcatattttcatcaactatatttgcaggagtctgaatccattaaaacactcaatccagcagcattattatgataacaacttgaaaagatatgtgacagtcactaaaagtcaaagtaaaaatacataccgctatgaaagtcattttgaagggaagttcccaatttctagactttataaaaacaattaagcatctgaaagctacttttactaaaagttgccaattcgtgtatctagaaaacactcctgcattttacagcactgtctttaatgtagtgaaaatattgcaaatgaaactagcctaaagggcaataatatatcacagtatatctccagttacagtaattaggaatctattctaatcttacctgaaagatatgttagtgttttatgtttataaggatttcaccaaaattttttaaaaatagcttagtagaagagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcagggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtgtgtgtgtgtgtgtgtgtgtgtgtgtgtgtgtgtgtgtgttcaaagaatgcctcttcattatttggatggcagttaactgctttggctaacttatgttggcatcctgaagctaacagcaaatcctcctcccatctcctgtaacttgtggccacaagacccagcatattttataagaaatcagaccagtagtatatttctacgatcttcagtttgttaagctatttatttgagttaagacaccgagttgtcttccaagtacttcttttatgataacagatccaagacagacacagctaatttgggcaacaagtagggacaaagaggaagaacagagcctctgtcatcctaattatcaagttaatgcctggttgctggacaaactctccctctctctaaaatgaaccaccgcaagttggaacctgctgttgcaatgttaatttgactagaagtggcaggacctggtcccagagcagctcctggttgtctttccaaataattttgccccaggtaataaatacctaattgatgcaatatgagtcagtatttgttgttcattgctacataattgagtggtcaaggtttcatctttcacctgtctctacaaattcttaatctccacaagtagtcaacattaaaaacaagaaagttacccatgtaaatttctacatgcttgcatccaaacaccctttgactctcttcagcttgctttcctctcgatgaaatttcattttccatattaaacatatctccaggctgtgcccatcttggcatttcaaaaaaaaaatagaaaaacctggttggattatacgtctgccttctccttaaatcagatgaattgctccacttgccggtaggataaatagttcagttaaagcatatactaagaatctcagataagtagctcagttaaaacatatactaagaacctaggtaagaaatgtgaaaaaaaaatattgcttattagtcctacagcagagatgatacctttttttaaaaaaaaaaattattattatactttaagttttagggtacatgtgcacaatgcgcaggttagttacatatgtatacatgtgccatgctggtgtgctgcacccattaacccgtcatttagcattaggtatatctcctaaagctatccctccccccaccccacaacagtccccagagtgtgatgttccccttcctgtgtccatgtgttctcattgttcaattcccacctatgagtgagaacacgcggtgtttgattttttttccttgcaatagtttactgagaatgatgacttccaatttcatccatgtccctacaaaggacatgaactcatcattttttatggctgcatagtattccatggtgtatatgtgccacattttcttaatccagtctatcatttttggacatttggattggttccaagtctttgctattgtgaatagtgcctcaataaacatacgtgtgcatgtgtctttacagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtaatgagatgatacttttataacactttgatttgtcattttactaattgctaaatttgcccatatcagtcatgttgaactgtgcctccctcaaacaactagcaagactgatctgaggttgaaccaattgcttaggaaacatcctctatgaagctataaacctgaaacctatctatattcagtctctggagatgaaagtgtcagagctggcagggcatggtggctcatccctgtaatcccagaactttagaaggctgaggcaggaggattgctggaaaccaggagtttgagaccagcctgggcaacatagtgaaaccctgtctctacaaaaattattagccaggcatggtggcatatgcctgtagtcctaattacatgggaaggtgaggcaggaggattgcttgagcccaggaggctcaagcccatgatcactcatactgccacactccagactgggtgacaaagcgagactctgcctcaaaaagaaaagaaaaagaaagtgtcagataaatttaagaggtacatttcagcctgatccatattgagattaagggctgctttctttttaaataaagatatgtttagtatttctacaataggattcaatacaatagaattgaaagtatgtgtaagtttagcccaaagctaaagagaaagatactattctcaagccaaattacatacagtatgtagatgtacctgtatctttatctttttttattttttttgagacaggcagatatatcttttaaaattgacttggcctcatacttttatagcacatgcagattttgattcttgtaactgtcacttgaaattttgttttttaaagctaaattagtccaatcatcttgcatgctgcaagaggaactagttattcaaactatgagaatttagtatttgcttacaagcaagataacaagaatggaatcttttttatcttgggtgggtcagtgagcaaaaagatatttctttttatttctgtgtgctattaatatgggtggttcttatcattgcctctctaactttccatttaaatttcaaaatgatttaatcttaaatgtaaaacaactgtgaaatcttattaccgagattatttatttcaaaaatgagtctccggcaacagagttcctatactctatgctgagagatctggaatattgcattcatttctgaaaacacacttaagaggagagacattaactttctgaagcaaattcagcaggaaatcagggtcatgcagagggcagatacagtctcagttaaggaacagttcaggcaattggagatgtttaagctgcaaaatacagaattcaaagaggacataactgtctgaaaaatgtgagaaaagaattgaacctactcttattaactataaagacctgaactgggatccatgagtataagtgatggaaatccatacttggttcttcccattttagttcccaaacaaaagctagaggaaagtttatcagaaatactgagttagggccgggcgcggtggctcactcctgtaatcccagcactttgggaggctgaggcgggcggatcacgaggtcagaagatcgggaccatcctggctaaaacggtgaaaccccctctctactaaaaatacaaaaaatttagccgggcatggtgacgggcgcctgtagtcccagctactcaggaggctgagacaggagaatggcgtgaacccgggaggcggagcttgcagtgagcagagatcgcgccactgcactccagcctgggcgacagagcgatattccgtctcaaaaaataataataataaaaataaaaaataaaaataaaagaaatactgagttagggatggtaccctacctacctgccataggttagggaattaacctattaaatccctccaatcttctaaagtttcattttaaaactctaaaagatcatgcccagcctaaagacaacatcagcccatggaagagcacatctattaaagacaaatgtatcctcaccaaaagtgattattttattttttccttaagataatacgaatgaaagactactactgctaataataattatagttataatctagtcagtgctttctctgctgtgcatttactaatttcgtcttgtttaatcctattcatactctcatgaggtaggtatggttatccccatatatgaatgagaaaactaaggtttggaaaagagactcgctcaaggtcacaaggtaaagaaatggcaaaggcccagctcctcactccagctgcatctgttacctaagcctgcccacttactcacagcttcccccacctagacagtgcacactgtaatttcaattggccataatccccaaatcatagaaacctcaactctagaagataatgaatgctcttgagcagcaaaatgatcatcagttgactcacaatgaatactctctatagattattttgacaaagtaacgctatccaactgtgcctgcaaatgccaacacatgcaaatccctgcgacttcataaacagcaaatgccctaatgagctaaagaaacaattgctctttattcattttcttcagtgtgtttcttatttctgctggaaaataatgtccagaaggaatttgtgttctattcaatgactataaaaaagaggaaggttagtgtttacaagtttacataatacaaaaaagagtggccgtgaaacagtgagctgtggcttcctggtgggaagacactcacatgcagcctgtgacttcctgggcagttttaatttacttttaatcatttcagaagtcatgcctcagaggtttgagataaaaagtttcatagcatcttacctttttcttttctgcccctccttttttagtttggtaaaatgtagtccagaaaaacaggtggagggggaagagccagtttaagtatttgctcctccaggaaacttcccacatatcctaaacccatctttgttcttctttacctttatactgtccacgttttttcacttgatcactgactgttgtgtttcttcaactgtgttctgtacataccttttctcattcatgagaatgaattgtttaatcatcagggttgccaacaccctcattatttctttttctgtgttcccatggtgcactggagttatctcgtcccatgatttatcacacactgtaggtattcgtggctctttctctgtgaactcctttaaggagaccaacttaattcacttttgcataaccgtcatctagcatcgcctagcacattgtaggcccccatgaagaaattaaattaaatgaaaactcgaatagttcacttaatccccagtgtttaacatatagtatgaactgaattgaagtaaagtgaattaaattcaatcagaacaaatcaaaatgaactgaaatgattataagacattattatgttggataaagttatccagattatatttataatttgtagaaaaattgattagcacagcctagctatgttgttgtgtgattcctatgatggacactcaggattgcccattatgttactaccatagaaaggtcagcagcctttaggcccaatattacagctagttctttaagctgaggccataagggtagacacagtctaaatcactgtgtattggctgagaaatgtagaccaaactccggaaggctgacagtatttctgaacaagcaaatgatgcttaaagtgaactgaagctgttgattatacaggaggattccccaacaagtagatctaaaatttcatttccagggctaagtcaccttcttggtccatggtttgctgtgatctcagagggagaggaaaccatacccacaacagcccctcatccctcccctctcttcttatctctagcttctaaatagttgtccatcagcacgcactgtgcaccccatctgagttcagctgtgtgttaggcacctgaaattcagtcaataccatgaacattatctctccacttttgggtcctaacttctcaaaaaggagaccaacaataagtaagtaccaaaaatattaatcataaatgatcacaaattctatcaggctgtgaaagagagaaatgacaagatatttccctcatccaaaaatgtagactctgatttaggagtataggcaattcttttctcaaaattatatctcttttcatcaaaaaaagtaattattggtaaaccagataaataagcattttgtaaaaatgaaaatgattgggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatttgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctctaacctgaaatagatgatcatttttacctgtaggcatgactgacagagcacagctgaagaagaggtaccagctgggtcatattctcatttctcactcgtgtttgcattatcaagttttcttcaagccacagttgttgttcaggactcattttaggcaacatgctcattttgtgaagagtagtttggttacaattaaataacataatctataaaccaatttaactgggctcacataaagcgcaatacatagaaaaatgctaacagcaaataaagtgcaggcccctctggcaccccaccccacggtggcgcttccatgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatgttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatttgaagaactaccctgtggacaaaagtatggaatcacatattcagcaaatatgtattaaatgcctacttactaagtgccacagtgaggagctggagagctggtggtagtgagatggattttgtgatacctgcctacaaagagcttggaacgagctcagggagatccactttaaaatactgtgtgatttagattaggagtaaacaaactttttttgtaaaggaccagatagtaaatattttaggctttgcaggccacatggtctctcgcaactaaatattcaactctattgcaacacaaaagcagccacagacagtctgtaaggagtagacatagctgtgttctaatcaaactttttatttatggatactgatatgcaaatttcatgtaattttatatgtcatgaaatattaatcttttttatttttttcaactctaaaaatgtaaacattttcttagcttacgacctacagaaacatgcagcagccagatctggtccacaggtagtaacctgccgggagctaattaacaggatttcacaagagctcagaggaagagtacttaacctccactggagatttcgtgggcgcttcctggagaaaccaagaaccgggttgagggattgtgcagggcaaagggataggccaaaaggacagtgagagctaaggcctggttgtacaaaacagatcgtgtagtgtagaggagctgctaagaaatgaagttagagaggcagagcccagtcaggaaagttgaactttatgttccagaggtggtgagtagccactgcagggatttaagcagggagtttgtgctgcaaactgtaacattaattccagctcaggctgtggaatcaaactgacatgattaggatcccagttctgccactcaccaagcatctgaattcaaatcattttcttatcctcttcaaatatcagttccatcatctgaaaaccaaagataatccctaccttgctctttgttattctctattcttgtacctgtctgcttcacttattgctcatagtgtcacaactggtaatataaatttcattgctaacttgttatttgactgatgccccctctagattgtggggccatgtcatcatccatataaaccaggtacctagcagggcgcctgactcaaaagtacctgatgaataaatggaaaaaaaaaatcaactcacaatgataaagccaaccatctcccaccttgtagttctatcactatccatgcttgcttcttgccttacaaggataaatatgttgtatcatttatttaaaacttggaataaagtcataaagaaaaatgattaatcatttctatacatctatcttatccataatgtttattttcttgagcaagttctcattacacttcattttgccacatggcttttccttcttccactgagacgcacttcctccaagaaactttcttaatctaaatgttacaggaaaggggtcccaatccagaccccaagagagggttcttggatcttgtgcaaggaggaattcagggcgagtctgcagtgcacagtgaaagcaagtttattaagaaagtaaaggaataaaagaatggctactccatagacagagcagtcccgagggctgctggttgcccatttttatggtcatttcttgatgatatgctgaacaaagggtggattattcatgcctcccctttttagaccatatagggtaacttcctgatgttgccatggcatttgtaaactgtcatggtactggtgggagtgtagcagtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccaatgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttactgtgtgccatgtattgttaaatcttcccttttagagatgtttatgtaacattttttgtttttttgttttgttttgtttttttgagacagagtctcgctccattgcccaggctggagtgcagtggcgcaatctcagctcactgcaagctctgcctcccaggttcacaccattctcctgcctcagcctcccgagtagctgggactgcaggctaccgccaccatgcccggctaattttttgtattttcagtagagacgaggtttcaccgttttagccaggatggtctcgatctcctgacctcgtgatccgcctaccttggcctcccaaagttctaggattacggtaacatgtgttttaaggtgtttattttctaaatagcttaaatcttaaccaccaatttatttttttcttctatatgtgttggtaattgtggcctagataaaagctctagcaattgtagtgacaggacaaaatataaaaattctcagggctatttaaattataaacagattttaagaagcactgtgtggtgtttctgttatccttctgctttccaagagaatatatctgcatcctgaaatctaatcacatttacttcaggcagagttgcttttggaaattcaggctttgcccatattgtctttgttgtataaacaacttagcttccctttctcccttttgttctagaattatttagtactaattatagattgagaatatccagggtcaggaagacctagtccaggtctagggagaatccaggttcaggaagagaggagagcatgggcttggttagggacatattaagcctatgacaccaattaagacaacaaatggagatgtctaatatgcagttagtccaccaaaattatattcttatttcttaagtttttcaaactgccatggaatagtccctttttcattatctcaaccatgacaaatttctcatatttatcactcccaatacatttaaaaggtgttagctagagtgtgtttctcacttattcctcatactatctaattcttaaagctcttaactatataaaatgcaggccataagccatggagttttcactcatccttatttttaattcacttgctagattatcaaattcaaattctcttctattagaaatctttgcctcactaactggaagaagctcaagtcttgattcctttatgcaatccttccaatccaaccccagtttacagatgtgtgcctttttccaggataaatttggaaaccttccgaaatatcacagatatgaccaacttttgaaggatcttctattgtggttatgtaatctgtgtcacataaacacaactcttaaaatttcaaagagaacagtccactggaaacaacctttttgattcttcttactaccaaacaggctagattacgtagcccatgaagccagtttacagaaatgaatttgtaaagaaaatcgcttttaaagaatcaactgaagagaggttagtttagtggcctcacagacttcattaaaaacaaatcttgctcctgatttggcagggattttcaaactattctgattcaagaaccacttgtgaaggtcaaaagcacaatttactagcctcattggctataaaaagaaacaaaacatgacccccagtggggtaaaggcttctgatgagacactagcattaaattgctaactcatgccaaaaacaaaagtataaagattggaatctaggtcagtagtgattaatccgaggaacaggctggaatgaaacaacctaaggaccctacttggggaagcattaaatgtcataaataaaaatggccattagatgaatttacagcccaaattaggaaagtttttctatcagttacttgcatacagaacttaggaaatttatggaagacgtgacagtgacttccaaaatcgatagaaaaattagtacatgtttgaaaacagactttgggtcaaagtgtttcttttcaaaataggggtgggagttggggatgtgttaccctctaaaatcttccatagtaatttcctcctgagaaaagaaattcatttcattttagtgttcctatcatgtttttgagaatttccatcctcattttctgttctgagagcatggtttagtaaatagtcctcagacccaataaacatatcaacagagaattttttagcaagttaatcaaaatatgaggaaaacaatgggatatgcttgaaataacaagtcacttgattacttaattaggttaacaagactgccacaaattgaaaccctgtcgttttttaaaacctcggtcgaaaatatttctgggtaatgattcaaggaatgaagaaaattggcctttttgaaggttaccaaaatgtaccagctgtgtaccattccaaggagtcctctgagaaccctgaaaatacatacgggtttttgttaatcattttaaaatctcaaagagcagtctgtgctacacaataatacacgaaatccacatgaagcctcccggtattttatggcaagtcctacttaggccaagctttttggatttgcttcagatctttatttccaagctcagtagcaaactcctgaaagctttgatttcaaataaacatctccattttgtcttttgcctcttcatgtagtaatcgtgtatatgtttatatactgaagaatcaatcatccaatagaaatctagctttgataactatgtttactaagaggatactaaaattacccataaggtaatttaagggaattcattacccaaataaaagactatgagcataaaaaactatagatattgctgagagtttacttactgtgcttaatacttcacatgtactattacgactaatttgccttcttgaaaagatgaggaaacaagcctaaggaaattaaataatttgctgaaggttacacccgagagcaagcaactgaaccaatcatctaacccaggccttctaactccatttgggtcatcttttctgatttgtggctctaaaaccccctttccagaaacaatctgacatttttagaaaccttcttttagaattgacgtattttactgaaaaagattccatttcttttgaagattaaccagagattttaaagctaatcttggcttttctttcaacatttcttcaccactgccacccccaccaaaaaataagagaaaatgcagtttctgtcatttagatattttgagaaaatattaactgcagaaacaaattagcatgctctgaaaaacaagtcccagagtttagagagactctgacaaagatgcaatttgagtgtgttcctcaagcacattcattgccatttataccttattcacaatcagcaaatctggctgtgcctgggatgaagaattttttgtttatttattttagagacagaactttgctctgccacccaggctgctgcatcctaggtgatgtagcctgctacatgatcatagctcactgaagcctcgaaactcccctcttgcctcagcctcccaagtagtcgggactacagatacacaccaccctgctctgctaatttttttaatacatgggggtctcactatattgcccaggctggtctcaaactcctggcctcaagcaatccttccacctcagccttccaggtatctgggattgctggcatgagccatcatgcccagctaaacaagttcttccctaaaagtgaagagggcttgtttaaaaggactgtaataagcttcccttgcaattccccaagtggactttgcaaaatgtcctcctcccctcaattcttccacctcctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccctgattcctactttaaaacacaaccatttccattttcgaaagattatagatccatctcttgcttgcctgaaagtaacacattctttcttcaaaggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttacctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataaacactaattatagagtattataatgatttctgggcttgcctcagaggggcgtctatctggctaggtaattacttccctgacagataggtttttacgtgagaatggagcatgatgagcctagtttattgcctgctgatgagaccacgggggaggaaggtcatgcggtatgcttattaagaccattttagtcaacgtgtttttcaatcagtcgtcagggtacccacccctggttaaagaaacgctacagatgaaaatgacacagtgattctcagtcgtgcgagtctgttgctttagggaagtgactaaatggtaagagacttctcaggttgaagtggaaggcatttcttgaaaatatgatgcctttgcctataatgctctaaagttgatccctagtgtgaaagagagtgctgctttctgtatgatacttcattccctgaaagactattttccccagctaagtcagattcaagttcctacacaattctggataatgtttaggaggtatcctgacttcaaggaatttatattcaaaaatacacaaacacatgcactcttctcccttctcccgtaacctaattgagtttgccaggaaaaaggggcaatgattttttccccttgttatttactaatagataataaagaatatatactaggggtaaaaaagacagaaaatcagagagtccagagaggaaaggaagttaaaaaaaagaaaagaaaaactaaatgaagcttttacaaaaatgcgatagtgtacacgtactgcccttcttgaaatgatccatcttattaaatgatgtggtttcagtgcttacctcttagtcctgctacacctatgggaatttggaagaaagctaggtttttcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacattcttgtatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatagggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttatgagggcacgtaatcagagtggctgtacctgaactaggtacaaaaatgcttaatactcagcttaacactagcatgtaaaatgtatgtgaattcagcaaaacatattttaaatgactttacattccattgctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcagctaatggaagggaccactggatttttttttttttttttttgagacagtctcactctgtcacccaggctggagtgcaatggcatgatctcagctcactgcaacctccgcctcctagattcaagtgattctcctgcctcagcctctctagtagttgggattacaggcacccaccaccatgcccagctaattcttgtgtttttggtagagacagggtttcaccatgttggccaggctggtcttgaactcctgccctcaagtgatctgccagcctcggcctcccaaagtgtcgggattacaggcatgagccactgcttctgggcaggaccactggatttccatatggaaaaaactactatcaaaaaaagatttttttttccaaactctacatagataaggattgtataatcagttactggaaatgcattcttaggattgtttgcataatttattttctatgtatttgtggatgctcaatcaagctttatgtatattcattgatttttttcaaatctgattgccctagttatgcgtgtttattccccccaaaattgtcagccacaattaaaattaaaattatgataccaaacttactggtggtagcatgctataatttataattcaagatggtatcagagccacattatatactaaactggttttgtatatgcagtttatcataggatttagaacaaatcagtgtattaggccagagttaccaactgaagggagcatcaaccaactgtggttatacaattacccattgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatcttgtagtcaaaaggaaaacaaactttgttatgtatactcaggctggcccacagaaggtggtgcatggcagtgctggtgaatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttccatgcttattttgcttttattaaaaataagaaatctgtattcctggtattccctggtgtttcgatcttttacacacctattagaaccataatttctgtaacatcataacgcttttcaaaacgtctcagtgcctgttcctgaagttattagtttccaagtctcctcaatgcctagcctcgtgcatccatgggtctgtagttgcgcctatagcattctcattgctacttcagtttccctgtgacctcctacttcacttctctacgggtgtgcactctccttatctttcttgctttctctctcaacgttaaattcacatatatgaaagacattctatgggaagaataacctactccagcatttaatagagccattctaaacatatctgacatagagatgtccgcctgtcacctgcctattcaggaaatgagcttgagattggagatagatatattattgcaaaccacaatcaaggctaatatcttaacctgattttatcctaatttatctctgtttatcttcattttcagcatttctgctctttctaccctctcttacccaccttgtaatcttcaaatactatatctaactgatacccttcataaagggaatatttttgcacatattatgcactttcagttgaagagacagtaaccctccaagacagcaatggcccagaaaagagactagaaatgtagtgataattcataagtcaacatctgcctctcttttctaccttagccaagtttaatgcagagggcattacacttagttctagtctcaagtctaccataattagaaccataatcatgggcaaatcatttaacttgtctgggcatcaatctctcaatgaaaaaactaagctatttgacacatatggccccttttatgtttaaatcaattttattgttttttactaaatgaggtgtagaacattgacccatcaaatgaaatcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcacatatgttaacctttttctttaaaagttactttgttatatgaacatttattttttaggttatatatttaatcccaaatctttgctatctcatgaagaccagtttgtcataaacacttaataaatgtcattttgttcaattaaaacagaagggcctgtacatcctatgcatacatactttttcttctactgcattgtacaaacatttaaacctgtgtgtgtatagcttcaggaaactgtagctggagctgggccagaaaatgtctacagtagccttacaatagttttctagttccttggtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaaaaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggacatgatctacatcattacatcacacatgagtccagccctctttgtctaagcctgtgacacatacttaaaccctgctgtttaacaaatcaactccaaagtaacccatctttgaatgtcattaaggatgagtatctgcaatgcaagaaactttgttatcccatgatgtttagaaaaatctgcttaataagtagatatattccacttgtttgttactctccataggtactctctctctacttacaacagaattatatgtaatcagttgttctcattcacataaacaaaccctgacaagaaataaaaatgtggtaatatcagttctctgcatcaaggaacatttttaataaactgtactatagaacgtcttactaatcagatcttttaacaaaacatatgttagccgtaatttctgtactaagacactgaatctatattacattgtaaaaatttgagtatgagctatctatacgttcccagcattgtatcctatgtaaaaaccctaaattaaataatacacccaaagaaattgagaccatttttagttaatttaagaaaataatgtcagatatttccagttgctaagcatttaatatgaatcaggcactgtgctaagaattttatagagagtagcccatctaaccctcacagtaaccctatatggtaggtactgtaattaatattattttacagaggaggaaactaaaatgttaaaagcttaattgtccataattgtaagtggagctagaattcaaaccaagtttttctggctcctgaattatatttttataccaccacctaccagtacatttatattcaggtttctttggctatctcaccataaaatgctgccaccccatcttaatggttgaggagattcaactctcagttctaccataagcagtagcatgcaattttagctatagctctagaagtatccaagattatttagctcaatttcccagctctgtaggttaaattcattgtctttaatgtgtttcactctagctacccaatgcaaattatgtcactaagaacaaaggaatagtcactacttgtttgtttccaataattcttttttttttttcttttttttgagacggagtcttgctctgttgcccaggctggagtgcagcggcgcgatcttggctcactgcaatttctgcctcctgggttcacaccattctcctgcctcagcctcctgagtagctgggactacaggcgcccgccaccatgcccggctaatttttttgtctttttaatagagacggggtttcactgttttagccaggatggtctcgatctcctgaccttgtgatccgcccgccccagcctcccaaagtgctgggattacaggcgtgaaccaccgcgcccggcctccaataattctttattatatactgtgctgtattgaattaccttggattccattattttgccaaatcatttatttataaggtaaattcctagaagtaacatttctgggtcaaacgacgttagtaatattgataggtacaaaggctttttgttattgtttgttttcatttttattaaagttatgcatacaagcacatagatttaagaatcaaacaattctacaatttttttaaaaggataagaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctagcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccatctgtgtgggagcttctaatgtcttcctctttcagtgttggctccatcttggtggcaaacatccagtagtaactaactgcctgcaaggtgactttgggaaagctgcttaacaactccaaacctcagtcctctcatctcaccttaattgtgtcactacttttaagattagtcatagcctcttgacccagtggttaaagcagttgttttcaattggcagaatgcattagaagttctggggggcatttgttaaaaatgctggtgcccaggcccaccccagtgatcctgattcaatagctctgaaatagggtgtatctgaatattaaaaatacctggtggttattctgatgcaaagtcctgaagaatcactttttaagaagcaccagctcaaagatataaaacaaaaataacaagtcagcagtgattttcaaagccaacagtaaaagaagctttcaaaaatcccttcccagttctaaaatgtatacattgggggatgccagaaatatattgcttaagatttttgaaaagttccctaggaattttaaaaaaactaatttaataaagaataacacagtccataggtcattaacttcaaatcatgtattaggaagatggcgaagagctaaagtggcccatttttattattttctgaaagtggaaaagatgttgccaaaagcaaagaaaagaagacattatcttttgtaatcattgaaatagaatttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatattgtaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcatttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttggttttctgtcctcgtggtattttgctgagaatgatggtttccagcttcatccatgtccctgcaaaggacatgaactcatccttttttgtggctgcatagtattccatggtgtatatgtgccacattttctttatccagtctattattgatggacgtttgggttggctccaagtctttgctatggtgaatagtgccaaaataaacatacgtgtgcatgtgtctttgtagtagtgtgacttataatcctttgggtatatacccagtaatgggattgctgggtcaaatggtatttctagttctagatccttgaggaatcaccacactgtcttccacaatggttgtactaattcacactcccaccaacagtgtaaaagcgttcctatttcttcacatcctctccagcatctgttgtttcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatagtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagctatagcaggggctgcattaaagacataatatgtcatttgtctgtaatctgctctaatgctttggcatctggtcacatgtattacttaaaatcagacaaatacataaactcttcacatagcccagatagctcggtgatagcacctggtaaatgctaggggtatgtagccgggtattaacttgaattgcaatggaccagcagatatgaaaatgatttgggatattaccaaagcagttgttaaaatggaaataatattgctcttactgggaagaaaaaattgaaaacagtaaaaatgcagctacaaaaaaaattacaggcagaagcgctatagtattttagatttaacctgtgtaggcaactgacaaacactgataaagacagatggccatgacagcatataaaacagtcctcaggatgattcagtatacaaatgtgaacccatttaagctaataaagatcaataccaaccagaagttgatgatgcataacccaccctttattcttatgtctcattttaaaggttaacacatttcaaaatttatacatttaaagatgcttaacttttaagataggaattgatttggcttattttatgttaaagaaaactgtttcagctcacatcaataaaatataatacctaactagaattcatcaaaaacaggtttctactgcaacatttcaacaaactagatgatatgttttacgcttattaattactcaaatgctaaaacatctggactgtaaatttaatcttccaatgaaatagctacacaatacagttttttcactattaaatacattaggttattaccctgtttacctaaagttacctccataattaccaatagaattaaggttaagttgataaatttcatgagaatcccaaagtttgaaaactattttcacacaacacacacataattttattatcttatattattttttaaggccaagataattttaaagaacttgatacataataagccttaaatacatttgtcaaagagatgagagaaaaagaggaagggaaagaggtagagaggaagactggttgtagaagagacatgaataaaccatggctgcatttaaaaattcctctgaatgatttatgaattcattacagagatcaacttttttggttttttggttttttggtttttgtttttgagatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaatactttagaaattgagtgaggtatttagtatgctgaccattttataaggtccaaagagtatgctaatggagttccaggtgagaacaagaaatttttataatgatggccaattttcatctgggaccaccctcaatgcagaaggattggttgatgtcatgtctgccctaaactgaaactatttcacttgaatacaaatttagaaaaatatgttgataattcttcagcatattgcaagtaaatattaatttaaatattaaatgtataagtattaaattaaatattaatccagtctttctcaaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagacaaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccaaagtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgaactcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaaagtgttcagtatgaaaggccagtctgatccacagaataagggtaggagggctcttgctgtaacataggctgagctcctctgaactaacagggaaaatgtgatcaaatgctattgaatgaattccatactttaagaagacagaatactaagggccatgctctgagttcatagcagtagttatctcatatttaataattgacttggcttttaaatactgtcttaaaatatcttctgaattattatgtttaattcttaatttatcctggctttgtactgttagccaacttaattttaaatttcctgataacaaggagtaggtattatatggggcccatgtgtgttaagcctattatgacataaaatatgtaataggaagtcagtaaataggtgccgaataaagtaaacgtttaacagaatatggtccttatatggtccttattatggtccttgactctagaagtcaagaataaggtccttatactttagactttaaaatgcatttaaaatatgataaatgttaacttatacaaatcaacatatataaaatttgtcaacagtagacatgtatcaaaacatttgcaaataggatttattgatgaggaaaattttctgggaaaacatctaaattgctattttagaaggaaaatgattgtaatatataaaatggacatgttttttaaataatgcattttgagtaggagagggtacagaatctaatatcggggccaaacaattttctattcaacagtaattccttttacagtatttttgccatggcccttgtagctgattcttctccaacccctgctccaagtcactgtccagctcaacacgaccatacgaataaccagtacagtagatgaaaataaatcatgtagtctcagaaagtcttctatatttctgtctgcttagtcagtcaatgttgacaacattaatacatagtccagtattgttgtccctggtttcctttgaaatgctacaattttagaatcctattatttcagtgacatttattttcttaggggattggattagggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttatcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcctagagtgtatcagacggaaactgaaaaagtgaccatatcagacagcattttcagttttctagaaggcagaaaaacacaaaggggataatttgatggctgcttgccagaaagtagcaggacagaaattagagctatggaaatttgtaactgtcttaatcacctctggtgaaacacaacatccggcagaacataacaaatgagaccacgccatgtctgatagtaagttttagactgagggcacattgctgaaaggcaggtgttgttctgatcacctttgtactcactgttgcctgggctattgccatgttttcataagcctcagtagtgcatttggtttccatggagtccatccatgaactaaaagaacaaaacatctaatcccaaagcagaatacagatctcttgtagtttcattcacccttttaaacaatatcacagtaatttttagattcaaataatcattgagagaccctgtactagcagttagggacatgtcatctgggcattggctctattgaacaatatgatcttaaataaaccttttcagtgccttgggtctatggcccatctgtaaggtggacataatgctgcctggctaatctgcctttcattgttattataatacatatcaaattgcattgtagaataaaaatgtcaaacaagggccaatggaatactggtgacaaagttgaatagcactagtaactagaatcaagtcaattatcagctttcaaacataccgaatatcaagaaagtaccataaggccaggcacaatgactcatgcctgtaatcccagcactttgggaggctgaggcaggaagattccttaagcccaggagttccaggctgcagtgcactatgattgtgccactgcactccagctggggagacaaagcgagacccggtgtcaattacaaaaaaaaagtgtgccataataatctcataatgctttcacttcgtattcatgaagctagtaacataagcccccttgataatacagcctattacaaaatcaaagttggccccttctactttggaacaaatgtattttatgagtgctttggttggctaatgaatttctgtagaaagaattttacttttcagttttcttcattttgataaaggagattaccacatggaagaatgatattaaagataataattaaaactcaacaaaactcaaactttttttttttttttttggagacaaggtctcaccctgctacccaggctggagtgcagcagcacagtcatagctcactgtagcctctaactcctgggctcaagagatcctcctgcctcagcttcccaagtagctaggactacaggcaggagccaccatgtccggctaattatttcatttttgtaaagtcatggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcttgagtcagtctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgttttgatgtagagatctctgtgaaagctcattaaatcctcagtgtgtgaggcagggcttagggaaaaatagaaatagggataataagacaccatatccatccatactgacatatttgcaaagcattcattagttaaaatcctccaaggaaactccatgtgactcctcagcatattaaggacctgaatcagctcttctggttaaaccacagtccagattaacagttacatactggagagatacagttagtttttgttttgttttatttttcataataccacgaacaaacctattgcaaaagcaattcaaagcatggttcccataatgaagaaccagttgggtcctcttcaggaggaaagatagccccatataccatgaatatctaatacatctgaataaatgataataagtcattagatgacgggtgtatatgagaaaagccaaacttactaagttaggtccccactgcttttattttctggaagacattcataaggaaagatgtatcttcatgcttcagccaaaacccagatgggaataagaccttctattatacaggattccccagagaaacagaaccaatagtgagggggtcaggggaagaggcagttgggagagagggagaaagagagagaggctttatcttaaggaactggctcattcaattttagagtttggcaagtccaaaatttgcagagtagcccagtagactggagacccaggaaatacttgatgttcagtccaaaggcactctgctggcaaaattccctcttcttcaggggaggtcttttttctcttaaggcttctaactgattggataaagcccacctagtgacctcattgtaatttaattacttctttaaagacattgtctccaaatacaatctcattctggggtgctaagggttacaacttcaacatatgaatttaaggggacacaatttcacccataaaatacctcagtgggttttattatgatctagatattagaaagagagagagagacagagacagagacatggggaggttgataaatagcagatgtatttctcaaagcagtgattctcaaagtataggcccaggcccagaagtatcagtatcatgtgagaattggttagaaatgcaaattctcagcccctaccccaaatctgctgagtctgtaagtggggcccaggaatttgtgaataaaccttccttcctggtggttccaatgaaggctaaagtttgaaaacaactctcttagaagttgctttattaaaagaatgacgccacctaagaagttttccaacaaacatgggtgtaaatatcgtttaatctgtgtgttttcattaaatatatcaagataagtcatattttataagtgagccttggatctattttactcttataaattgaaaacaaagccagagctccaaggataagcaccacaacactgcaaagaaacttggcctctgagtacagatttcacagggtaaaagcaaaactgtgagtacccaataaagctaatatatcaaataccagagcagtctaattgctgtctgtctggttggaagcctccattaccttatgtaattcccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacactgagcaattataccagcaggccattgattgggaagttgatgtttgtctttttccacatgaacaagggcagtcccattgctggaagctagtgctctatcatttttaaataaacagaatgtttgtcattagcattttctaaagtattggagatatctgatctggatttgcttttatttcttcttgatcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctctttaccagtaaagcaaagggtttctcagaaatcccactcagactttccttagatcttattaactggagagtcaaagggccacttttatctaaaagactaaatgagaactaatgggacaagatcatcatggctggcttttaagtacaagaatgacaggaaagtaatggtttaaaaaaattaatatggaaatgaaagaggagaaagggagtcagtaagaccaagtggagcattgctaatataattctgtcataagaacaagaaggtctaggtaatggatcctcttatgatggcttagtttgtaatacctttcatgaaagaaaaaacattatggacaggtggtcagatacttcctaaacaacagtcacaagttgcactgcactgtggtgactggtatgtctgtagctgcaggttaagcactatctcaagcatagaggtgacccttggggcaagatagtgcctctgagcttctaagggttacatgttataggtctgatttccaccttattctatacactctctgaaacttccaaagattctgctacataaatcaacctcatgcccaagttggtggcagcagaaatgaaccttaacttagcccaaaagggtttgaagagaaccaagaaataaagctagaaccagatccagcactatcattattctcatgctactttttaaagtcttgtccacattagtcagtgatagaaaactgatgttaggaacactgagcacctaagtgtcactcactctgatctctagttgctgcttctgataaatttcaccaattagcacaggcttagagtcagattatctgggtttgaataccagttctgctacttgatagtggtgtaatcttggggaagtgcttaaattctctgtatttttcaataaaatattgatcacaatagcacctacctcacagaattgtagtgagaaagaaagtgagttaatatttgaaagtccttgaaaagtgtgtggcacatgtcagccctcccggaatgtctgctatttttattactgcagccattattattctggtgtagaggtgaactaccctgctttggaggtcataaagaccttgattcaaatcctgccattatcacttactatccctatggccctggacaagttaattcatggttctgagcctcagtttatttatctgttaaaaagggataataatgcttgtttcatcaagctatggcaagtattaagatggcatgtgacagtgcttagcacaggccctgacaaataagtaatttgtattcttttttatcctccatgatacactcttttctctgggtttatcactagaactcccccgggatgatctgttacttatgactaatcatactctgtgtacttataccactaatattatttgagtgaaacaaacttaaattcagcatcaggaactaccttgaaaggaaaatagactcataagagtagtctcttccagttttgagaagaaaagatgccatcctacaagtatggtaaaggtcttgatgagggaggtaagaccatgacagtaccaccatgccttcgtctcacttccccaccacaactgagtgatctagccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctgtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaaatcagtttatcctgggtattacacttgaatttaaagcaaatgtatgcacaggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccgtcttaataaagcaagcagttagttccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaaggtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaaggaaagaaagaaaaagtatcactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaaacagaacgacaataataacaacaaaataaagcaggttatacaagctcgtatgcatctcagatgaagaactttcctctagtaataggctccttttccctaaatgtatttactgaaggcctctgtattttaataagctatattttcactggttttaaaacttcattattttcaccattattcacatccatttaatgtgttacttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagcccgagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaaattagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaactcaccacccagaaataagtgcagttaattttatggtacatttttccaggttgattttcatatacacatgtgtatctatatacttctcttaatacaattgaaacatacaaagcacatcatttttaacctcttttttttttagcaatgatatattgaggcgtccttctgcaccaatattcttttcaacattgttttaaattgctatagatcatttcatgatatcattccacaatttaaccaacgtcctattgttggcatggcgagtctgtacaggtctgaaatgttacagtagatagctagtcagacatgaacagggcagtagaaagtttattaaaaagctttagagcagaaagaagtaaagtacacttggaagagggccacacaggtgacttgagagatcaagtccacagtttgaccttttgatttggggttttatacactggcatgcttcctgggtcttgtgtcccttctgccatgattcttcccttggggtgggctgtccgcatgcacagtggcccgccagtgcttaggaggagccagccacatgcagagtgtgtttactggagttgtatgcatgcttacttggggcactcttcccttaccagtcaagtgtccctataaggtaatataccagttaaactccaccatcttgcctcttagtttgcatgcttcagcccattcgcccaactcctgagatcttatcaggaagctgatcactagtctcaggtttttctatgtattgggagactactttccctggggctggctgcaaccaattattattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctctaacagcaaaatcaaaaattaaatattgaaccataactctcttttcctctataagcctaacagttcttttccatatatgtaaggaaggcaaatatgcattttttgtttacaatttaggctgggactgctacagtgactcacctggagtacaccccaatgaaaatttagtgggcaataacacagaacaccatgcccataaaattataaaacattattggggtttgcccatcctccaattgtcttgctgaagtctatttttcttcctctataggagaagctatttagagtcaagcatcattaaatcaaaatgcaaaggaaggagaaattgaatgtgggttaattgcattctgaatgcaactgaaccgcagttggtacaaattactggcctataagaatgcattgtgcctaccaggaagacaagtattttggtgaagccggagtatgggtgtgtaccaggaagtggcagcagatgaggattctgagtgtgtttgtgtgtgtgtatgtgtgtgtgttggcaggtggggacacattagatccttgtatgttgtactaagcagttggtactttgtcctgaagcatagctctcccaggagaattgcagctactgtccaggaggatcccagtctatgcaatttggcacactctgtgtaatcttctctcctttatcgcacaaagaagtcctatacctgcaatcttgctagagaagtaaaacctgtattccttatcagtagatctacagggtaataaagggaacactatgatgggagcagctgtaatggaattgaagacctctttcttcttggcatcaactgcctgaagataaaaggaatacaattaatataaataaagggcagaaaggcactgactctaaggcaatgaaattttgtaataggagtggaaagaaagcagagatgaatgagggctacaagaatcacaacaggctcctgggaggaggtgatacttgctgtccctgccagatgtaaagcataattttcagggtcctcaagaattaagtggcaataggactcaaaaaaccatttctccaaaaggaatatagtgatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataaccaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttaccacttaaacatttttgtatgatagcacataaatagctgcctacgattccctcgagtgaatggaccataatttattgatcattccccaacagtagacatgcagattatatgtagagtttttgccttcataaacaatactattttgaatccctttgtacaaagcttatacttaggcaagggaacctataacataattcctataagcagaattcctgactgaaagggaatatgcattttaaatgttaatagatgttgccaaaattaagccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggagttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatatttaattggttttaattagcttctcactaccttcatgatgaaattcgaattccttagaatgctctgcaagccctttcatgacaaggtccaggcctgcctctccaaatggcatcacttgtaaatggcatcatttaccctatgctccagcagtaataacactatgcattcacacaggggaggttttgtgggtgtcagtgctctccctgaactgtcatcatagtatccccccactcccaccccccacttcaacctggagaacctctaaagttgtgcttttctgtttttcttttgcatatcatgtcctgagaatcttgttaaaaagactttacttctgtgggcctaagatggggcccgatgttctgcatttctaatcagttcccaggcaatgctgggaacacatattgaagacaaagctgaaaaaccttactctaccgttactccctctgtgaaaaactctcctgcaaagctgatctacacaaagcgtcctctttctaatgtttatgacttgtatatagaacatgtacaggtcttcttagatgtctcatgtcttatttaattacttggttataggtctgtccctgtaatcacttgtccatcatcaagggctggaacagtgactgctgctccttgtagtcccagcgctaacatttggtccagatgtataggaatttcctagaagtattttgcatggaaattagcgaaaatttttcacttggtgcccgaatgatcatttcataaggtgttgttaaaaatgtccactggatggaaggttacactaactttttagctctcaaattcgtggtttttctttatgttattgacaatctctccaatggggttttggttagggggaggcttaaaagtaattgatttatgattcttttaaccaacatgtaagtcaagaggctggccaagagtttgaagagcccgaacctgttagacagtaaaccaattatctttgtgaccttgtgggtgacttcaccacccccactgcatagcacagccctgcctgtttccaaaacacctggccttgcacaaaagaatgaagaaagagccaaggcacagagaatattctccagcagagagtttgggcaagaagtcttaaagatgtctgagtagagagacaattagtggaaacaaacatctgtccaaggtctctcccatcatgtcatgaacttgacaagaaaggccagcagtaactcttccaaccgtggtaaccaatggccctgaaatgtgttcaatatcaggtatatcagagcccgagagataagagtggttttcaatgctgtatgcacgttagaatcacctgggaagtgatatttgtaaaatatgaacacctgaggccccaccccagaacagctaattcagaatttctgggggaatggccaaggggtcagtagattttaaaactcaggtgattatactgtgaagccagagttaacaaccactgatagagggtagtaccttcttcccctataggtgcctcagaagtgaacatctaacttcagcttacacatcccactaattgaccactgagtcttacttattttaggcaaaacgaaaccaatagaaagttttgccttttctctatgtagaagggactaatgattctataagaatttttaaatttctactcacatttcccatcacacagttgttgagaaattggtaagttgagaaaaaatgtgaggtgtagaaagaaggaaattgaattcatttagaaaagagaattccaaatgagcttaatttccttttttctaaatcttaataatctaccttgcttttcttctccttccactgcaccctttctccatgaattcatcagtcatagtggtaagctcacagtatccggcagcaggtcaggtgggatcacactggctaacaaaggatctgagggtacaatgcagaagttgccagataatgggattcaattacatttctaagcatagacttctccagtgttggctgttacactgcccaatgtggaaaagcactgctttatctacatggcaagtgcttcatacattttagttgaatctgactcggagtacctcaatttttttaatgaaatatttgaggtctacaatagtaagtataaataataatataatgaagactcttgtacctatcacactaaagaaataaaacctaacatctataatcaaaatagcctatgtcctctttatctcctttctctcattctctcctcagaggtaactgttaccttgaatttatgattcccaaccctgttttctcattttgtttgtcattccaatgtatgtttttatgacacacacagttttggttttgtatgttttcagccatataaatggcactttactgtatgtattttgtgcattttcaagctttatataaattgtatcatatatccttctgcaacttgactccatatttcattcttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccatgttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctctgacaaggaggaggtagggaaacagaaacaagtcagtctggaattaaaacactttttccagttcaaagtagcacaagagagatatgatgtgagtagagagtagtcttccaccattctaaagcagtggtttgtaatctaaatagaagggcattgcacactatcaaaaactatgcttatgtaaatgggagaaatactgagaagtaggaaaaagtattgcaaagtggtagtagcattgtttttcttctagaataaaagatatttactcctttgccttctcagttacattgttcctggttccctaaggaaaaaaaaagtgttcagcttcagaacatctcctagaatttctctcgtttaataccaagctaaagtcctgccacttccagagttccacagtgggaatgcaaccttcacaaagatgctttcctttaaacaaagcagatgtgaaattgagccatgcttaaagatttgacatggctgctttaggagggaatttattgttagtactttcaaagtagacctaaaaacaccactctgctttttttattcctgaactggattttaagatcgtattgctttaaaataaatgaatgaataaataataacattttattttggggaggaggaagtagaaaaataaatatgaattgttttggaattgattgctattttgagttattaaattgttttcccatccattgtggtagatgaaacttcctccaaatgagatctgctgctttttcattactgtcttgaactcttttatatgctggtgtgttttataaatttctaaggtgcgccatttagagagtctgtgcttctgaactgtttgaccatagtttccttgttcaaggaacacctcactggagttcaaaggtcacactttggaaaaatgctagcatagctattctaaaggtggctacaccatcattactaaccattctggccagaaattcacaagacccaattatatgtcatcttgactgaaattctttcatgatagaatatctgtcttgacatgttggttggtatacatattgctcttgcattgaatgctgttatggagacatttgaagccagtctaatttttgctttatccaatgtgacactttttttgtttttttgttttctgttttttttttttattgttggtggtggtgggtgtttttgtttgtttgtttgttttctcaaattcccaaggaatgtctttatacttgaattgtaagtattcaatcagggctgtgttaagcattctgttaccagtatttcctagaacatggtatgttctttcaatctataaatgtggttattctttctctttagtgaaatttccttgtgtggtatttgtgaatacttttcctgttccatttattgaaacttctccttcagggacatcaatttcctcatgttaagtgcttttgaactccaatctgtcaccttctaattcctttggttcccttgtatttacaagccattcctcgaggccggtaattttatttgcagccatgtttattttgttccttgctctgtcaccttttaaaaattcactctataatattgtttttgtactcagcctccttagttctgtaaccttcctggggttctgtcaactcatctttgagctcttgtttttctgagttcatgttctcattaacttgattcatagtacaaagcacttctgaggaattttgttttgttctttggactatgttttctttaaaagagggagtttcatctttcttttgcatgctatgttcctttcttttaaggttgattggttttgtttattttcatttgggagcattgccttagcatgtttggatgtttgtcactgatttcccccatcttactcatacctgaacgctttatctggatcttctctgttctatctagtataggtgacttattgactcaatttccatagactctaacttttttccccaaagctatggttaaagaacttgattttggataccatccacttaactgcagcctaaggaaatggtgcagggagtagagagggaagggaaagctctgctgaagctgtgtgacatctgagttagaactcctgggctctgcacttttggttgctcgtgctctctctctctctctctctgggatttgttagatactttgaactacattttaatccctctctttaatcagaatacatatccatcctgaaggggaacactctaggattttttaaaatcattcagcaaatttttattgagcccctctcctttgcaaggcacattctaatctaggtgctggaagtaagctgtgtgaacaaatgagacgattcccctttctaatgagtttatatgcaatgtggtatctttaccgatacatgctctgtcagaaagaagcagcccacttctgtccaatagccaatccactacccttcagacaaaaatgagaaaaataaggatagtcatttagttagtttctctccagatctgaagactatagtgaggtcttgagagttcagtaattcaccagtaaggttccaggggcaggaagggagttcagggttagaagctacactgtaccactccaagatctgttcttttgtgagccagcattgtatgtgtgtgtgtctgtgcgcccacacatgtgtgcacacgtgcatgcatgctttgttttgttttaatgtccatattattaggttacagtcttttccttatttcattgctgacttattactagaaaggagggagctagtggttttcattgttggtatcccttgtttttagttctgagagaaagagaaagagagagactctataatctgctttcattctatcacctgagcctggaggcctcaactagttcttttaactctaattaagccttagagtctgcaagtataagacagctgtgaagtagctctgccctcagaattttgtaagtactttaagacatagacaaacacacatacacacaacaaaacaaaacaaaaacataaagctgaggtggtttggttgggttccttgccagcttagcctcttactcttggctaaaaaacatttcaaggacttaaactgtggaatagttctaagaaattgcttagtcttatccctggacactgcaaaatggattgcctcagatctaagaaacccatttatcagaaaaattcttcaatttcatgatatgttatggtcgagatgttattgcacaatcccacagaaatctagtccctctcctaaatatgccgaacacctatacagatggaggcaagcagagagaggaaggtgagagtgaacacttgttcctgaaatctcccaagataccggctctgggttagcattagaaggcctaagcacctggatctattaacctaaatagaaaaaagaaataaccaaatacttgttgaaataaccaacaagtatttggttatttcttttttctatttaggttaatagatggagcattacctaaaaatgagatgaagcatcacctacaaatgtccctcaaacaagtcatacttagttcagattataaagagagtatttgataaatgctgtacgtataagggaattcgaatggcactagcttacagcttcttgtgtcactaccatgcctctaatgcaatttcccccatctagaaatgtaaccctcagccagttgccttgaaagctggttaccgtggagatgattatcagtattatgatgacctatttagaagaatttctgcatcaccagaaaacaaataaccacagagagagcctttcaaatgaatcatgctctttctctgaaagtgcctttacaaacaaatgccatggatgtattgtgtttgtgtgctgtgtgtggatttgttcattatttgtatttgcaaaggttttagtgaaattccagttgtctttaggcatgccaagagtagagagggtagtacaaacaacaggcataagcatatagacatctgtcctcttcctacaatttgaaatgcatggccatggctgtattgatttctcagcaatgttaacatttctttcatttgtacagtttttcttgctcatccactgctttttgaggctttttaaggactgctggaatgtggttggcaggtggttggtaaagactggtttttacaaactgattggccattaatagttcctaaacacactatgactacttgatgactattttgattttctcaaaattatgtcatgaaatattctcttaacttctgtttggtctcccatttttctataaaatagttttgtgtgtgattgtatgcagacctagtgttttgttttttttttaagtttttaaatttgttatccattaatcattgccctgctccttataggaaagactgattttcagctgctgccctttttggttttgttttgcttttgatttttcttcttctttttttttttttttttttgagacatttaatttgcacttgtaaaaatttcagtgataaaaattaaacctttattatgttcatagaagcagcaaataacaatataagccaaatgttaccccaaagaggtcaaacagatctaatattttccttccagtctatgaaggtcgtgtattatggcatttttatatttgttcttattgtattttcaggcacactcctttttctactctcatccttccacccactgtcacttcttctaaggtaatggcaggaatgttcatattttctgctgttatttcatatcatctagcaaagtgctggataatcgatgtttaataaacctgacccctcatataacctcaaaagtttcaaaagttctttaaccagataaactccatttttgtctgttcatgttcacaatggccttccagtctaggaatctccattttttaaaccatgtacaggcagtctgttttccacagaacattttgggtttaagtcaattaactaattttggccccattttcaatttctataccatagacttgtccttatgcccaaaatcacattgctctgaactgagggcaaatatcaaattcatattaatcacctcactaatattcttaggctggtctgaatgctatgtaaatcccaataaaaatcttagtgtgaaaaaattttcttcaactaaatataactccttctctttcaatattttttagaagtacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccagacttggagtcctaatcacccagaatagttccagacaagattcagaatcagaactctgactctgcccaacaattccactaaattaattcactctgcactctcttgaatggatttggaaggcaaatcatgagcttgctttagagtatttcctctttgtctaatcttcactcctagaaatgatagtgcttagcatttagcacttgcaatccttcccaccctgaagctaaactgggaagaatgagagcagagtgttctaaccttattcataccacaggcaattattcaaggaaaaaaaaaacatatttcacagcctttaattagataaacttgctttgtgaatagaacacaatcttcagaagaatgatgtggaataacttttctccagaaacattccatggctttattccctcttctctaagaaaattcatgtccttaactgctagctatccaaagcaaatgattaacaccccatgtgtcttgcaatattgtatgatagcgataatctaatattgataacctgcagaactgctcactccaggaagctatcaaaaaaatgataagccaagtgaaaaaagtacagccacacaacagaatgttaatatttatgtttctaataacattttttaaaaggtttctaattaatgtaaatatattatgatatggtttggctgtgtccccacctaaaatctcatcttgaattccagtccccataatccccacatgtcaagggtgggaccaggtgaaggtaattgaatcattgggggagtttcccccatgctgtcctcatgacagtgagtgagtctcaagatatctgacggttttataagcatctggcatttcccctgcttacaattctccttcctgccaccgtgtgaagaaggacgtatttgcttccccttctgccatgattgtaagtttcctgaggcctccctaagccatgctgaactgtcaattaaacttctttcctttataaattacccagtctcaggtatgtcttcattagcagtgtgaaaacagactaatacatattaactcactacagttattccagctaataatttttgtcatgttctatccaatctggaacagtacctgttagggtattcctgatgagaagctcagggagggcactgctggataaatcagctgtttacaagtttcattcaccattatgttagtgttcagtgagtaaattatgccatttaagatttccagggacaattcttatgggcctgtgcccaagaagtccccataaggtttagcgccctcactccaacatgctaagagaataaaccaaaaaccatgtattcattaaagaagtgatcattgaggacccactgtgtgccatcaggttctcagctagtgctaaagatatggtgggaagaaaacaataaaaacggaaatggttcctgtcttttgaggcttagagattaggagggaaaaagacatttataagtcacacaaatagaaagaatgaattggcattttataagaattatgaaagtaaactctgctttagaatgaggagtcaaaggagtttccgtgaataaatgatgttggagctgagcttaattgaagaggtatgggaaagggacatgaggaggaggcatcccaggcatgaggcatgaggagtggaacacattcaaagggctaaaaggtcactgaggctggagtggaggcagcaagtgggagcgtcctgagagaagaaactggagaggtagagcaggagccagatcattcaggctctatttgtctagctcagacatgtctgcatttaacttatggtataattactggattaaaaacaatataaggagttatacaatgttttaatccttctttacacaatgtgtataatctaagttgataatgcttatgaatgttgaattacaatgaatgttcaaagtcacaggacttctgtgataactaatattaactgtgtgactgtggagtgataacttttagtcttaagtacctcatctgtaaaatggaggtcatagtacctacctctcagggtagccactaagtcttcatagataaattggaaagactggatggtacagtgcctggtcaaagccttttaaaaattagaagaaatatgcagcacagcccttatacctgggaaagaatgaaccctatcctggaacccagagtttagagggccctattctggttctcgcctagctacactctcaaagggtggagagtcttcaagtccaacagaatacactcacctggaggccacactgaactctgtattctagatgatgctctggatacctgagaccccaaagtttcctaccaaaatgatcccatgatgattcacgaggcctttaagtgtcttttccccaagcatgcaccatctgaagacagatgcataccccatgtctgaggggtggctagggagcagtggtgaatagcacttgtacatacaggcagagtgtcctcaaatgtatatgtgaaacttcttgcaatgcacgttgtagcttagtgtgagaagaggagggggacgggacagggccagaaataaactttacccacactaccaggttctattgtgggaccacagtctgagaattataaatgtaaagctggattctctggtcattattaacatttatttgtcaagatatgagaacagaaaatacctattgccttagtccacttgcattgctataaaggaatacctgaggctgggtaatttataaagaaaagtggtttatttggctcatggttctataggctggacaagaagcatagtgccagcatctgcttctgctgaggacctcaggaagcttccaattgtagtagaagaaagggagcaggaatcacacaacaagagaaggtgcaagagagagagtgggaggaaagtgccaggctctttttaaaactcaaatttcttgggaactgatagagcaagaactcactcattaccataggatgacaccaagtcattcatgagggatccacccccatgaccccatgaccaaaacacctcccactgggacccacctccagcattggggattaaatttcaatatgaaatttggaggggacaaatatccaaactatatcacatatgttaacagttggattttttgtttttgtttttgaaacggagtctcgctctgttgcccaggctggagtgcagtggtgtgatcttggctcactgcaacctccacctcctaggttcaagcgattctcctgcctcagcctcccacatagctggaactacaggcaccagccaccacgcctggcaaatttttgtatttttattagagagatggggtttcaccatgttgaccaggctggtcttgaacttctggcctcaagtgatacgcccgtctcggcctcccaaactgtggggattacagaccactatgcccagcctggatttttattatgatttttttgtttgtttgtttttgttttttgagctggagtctcactctgtcacccaggatggagtgcagtgacgcgatctcggctcactgcaagctccgcctcccgggttcacgccattctcctgcctcagcctcccgagtagctgggactacaggcacccaccaccacgccctgctaatttttttgtacttttagtagagacggggtttcaccgtgttagccaggatggtcttcatctcctgacctcgtggatttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccactatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaatttaaatataacttttttaggaattgatgtcttctcttcccaactgaactataagttctttgaagaacaaattggaatctgctgttttctgtatgccttcattctcttgcagcccctaagagttgcttaggaaagccgggcatggtggctcatgcctgtaatcccaggactttgggaggctgaggcaggaggatcacttgagttcaagagtttaagaccagcctaggcaacatagcaagatctcatctgtactaaaaatcaaaagaattagccaggtgttgtggtgtgcacctgtagtcccagctacttgggaggctgaggtgggaggatcacttgagcccggaggttgaggcagcagtgagccatgattgtgccactgcactccagcctgggcaacagagcaagactcttgtctcaagactaaacaaaacaacaacaacaaaagagacgctcagtaggtatttatacttaactggttcattcaggtatctagcaaatattgactggattcccaccatgtgccaggctctgtgtcaagcatggggatacagagttgaacaagacactggctgaaagataaatacctggcacataacagacactcagtgagtgagtgaataaatgaatgaatgaattctgtaccacaaagttaagagaaaatatcaagaaaactggaatcaccatttaagttgtcttacatccgaagttatcaaggtgaaagatgtcagcctggcagaatgcccacaattctagaaaatctggggaaaacaagacagtcctagcatttgttcctctggatcatctccatgactatttagtatgtggtgctagaatcttgcaaagaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggattacaggcatgagccaccatgactggcccttgagccaccatgcctggccccatagtttatttttattttctccttctaatattgtaagaaaactagattaccaaggtagaagttgatctctccctcaaagctatttatctccttgatgtgcagtatgcaaactgattttaaacagaattttgcagctttatgaaagagaatcacatttggtcatcaatgaattaaaatgaaatatctctctggaaggataaggaaaatcaacattcaaatataaaaatttaataataaaccaactaacatgttcaaggtttctctttttaaaaaagggcctacattattaatactataaaatttcaaaccagatattatagatcttaaaaaaattgtcattttttctttttttttttaattattatactttaagttctagggtacatgtgcacaacctgcaggtttgttacatatgtatacatgtgccatgttggtttgctgcacccattaactcgtcatttacattaggtatttttcctaatgctatccctccccctgccccccaaccccacaagaggccccggtgtgtgatgttccccttcctgtgtccgtgtgttctcattgttcaattcccacctatgagtgagaacatgcggtttttggttttctgtccttgaacattatcactttttctaatgggagaaaacaactgcattgttcatcctcttccaagtccataggctcaacaaagtcacttaaggttaggaagggggtagcacagggaaagaaactcccttaaaaaaataagtttcttttcttttttttccagagggagtcttgttctgtcacccaggctggagtgcagtggcacaatctcagctcactgcaacctccacctcccaggttcaagcaattctcctgggccagcctcctgagtagctgggattacaggcgtgtacaaccacacccggctaatttttgtattcttagtagagacagagtttcaccatgttggccaggctggtttcgaactcttgacctcatgatccgcccatctcggcctcccaaagtgctgggattacaggtgtgagccaccatgcccagccctattttcttttttaagcagagaaagaagcactgagacgttttcagctaagaaaacttagaagcattacccaaccccctaggaaatatactcaaaaactttgaaaagtactagaaatagttcaaaatgaggaaatgagagtgatttttttcactttttagaagcatttccaggtctccctcagttatcctaagattatctcagtccatacactgcctaattcttagatggcagaatgtttaaaaaacatgcagatatcttaaagcaagtgcgttcaaggaatagagagttaatgaaagtaaaattgattctggccaaaccaattgtagaactgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgccccacctgagaattctttctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcataatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaattatttgtatagtattaaatgattggcttactgatgaactaaggcttaataagtgaacaagaaaacttgcagttggcaaagaaactctgaatgttaaatttattatggtttaactctgtctctgttactactggaccacttatacaagtgcctgatggctcattcctagggatttgatctaatgtgggaggaagatgtctctctgcaaataagtgcaggcacacacaagtttaggcagagatggtgttctagtgactctaggttgagaaactataaatattggttggttgccgcccaccttccatcctgccttcttttaggtagagacttctggcttctgcttgaggaaccaccctatcctactctagccttgtgcttagaataaaattgagcttacccccaattccaaaggtaggtctacctggccttcctaatgatttaaagatagacacataactcaacctagctcatcacattcttttagacacagggattaatatagaataagcatttcatctatgttagtccaatcagaatacacttaggacttgccctgggaattctggatgtagactgtcttttcccttgggtggtatagtgtgatgatataagacttgtagctggtgcagtcatttgcatccataagaggaaagcctagaatggctggaaagcaatggctgggaccttgctgatactgttggatttatgttagatagggaacagaccaaactgctgtaacaaagagattctaaaatacagggactgaaaaagataaaatttcctttttagattctttttttgtcttttgttttccttttagtggagaatggggtcttgctatattgcccaggcagatctcgaacttctgggctcaagctatcctcccacctctgcctccctaagagctgggactacaggagtgagccactgcaccctgctaaactttttattttccttacgtctctgtctatctacctcataactatatggctggccaagagtgataggcagtttggggtcatggggtcagttagggacccaggatcttcctatcttgttgttctgctgtcctgctagggtattgtcttcatgttgcaaagccagtgatgcttcaccaccctcccatcacagccttgtttcagttacaagaaaaaagaaaggaatagtggagggcaagaagcttcttctaatgcagggcttatcaatctaagctctattgacattttgggcctggtaattattttctgtttggggttgtcttgtatattgtatgtttagcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgaattttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcaggcatcttgcattatttggctttgaactgctactttctagttctcattgtaaatacaaaaagcgtttagtggctcccttatatctcacacaaaaggatcattgcttacagccagctgtttggcaattatatttctatgaagttagcataatttgagattagaactgcctgagaagaggggggtggtgataacattctagtgtattgaagtagggtatggaatagtgatggtggaagctctgattttagaagtgaatggcctttccaaagttcatctcgaagccaacagttctgaattcaaaacatattttgccataggaatcttatttttttaagttattagattagcacaggagtcctccaataccagaaaagaaagagacatgtactttacggtagtacagaagaaaatgctgcagggcaaaggaagatttgtctgaaggttcagactgaggaaatcattagtaaaatcttcagggaagtggtgacttttaaactaagctttagatgaggaaagagagaaagggcctttcagggtgaaggacggccagttcaaagacacagtatttaaaattctccatgaggaatagtaagtgcctaccatgagtacagcataaggtttatggagatatgacaataagttaggacggggctgtgaatgtatggtggagtttggatttttttagtccacaagccactaaagagttttaatgaggaggatagtatgatcaaatatagctttaataattacatgaagaatgctttgaaattgaggacattactgcaagagaattggatttctgatcttgagacatggcagtgggttagaaagagagaaatcaccagagaaacaacgtgaaggtaaattggcatgggaggtagagaagaaagaatcaaatatggctccaaatttttaggtctacgaggttggaatcatggcacaaggataggcttaaaaggaaaggaatgagctcagtaggtatctgtctgcaggataagagaagagttaaggtggtcatggccttatcgtatagcatatgggctacatttacatttctgcaaagcttgcccattggggtccctataattggagaaaaatcacttactgaattttgtacctagttccagtcttcctccaagtttactttatattatttgtttgggatatagctccacatgttgaaactgtgcctctaacaccagtgttggtgaagacattgcattccagtgccagattctgtggtcagaaattttgtttaacagaggtagcaataatattggaagcataggttgcattgtagagtgtctgagaaaaggggtgcagagaaaaatcctatcaaacatgtgttaaaataatgtcaaatctgatatactcataaaaacatgcccttgaacatcttggggcagaggaagggatgggagagaataaaggaggatcatctcatgctcaaagagagaaaaagaagagagcaaaggagagtttcgcaggaagggtactgtggaaacgccagcaaaggtgggatcaggaattatctggaaaagagagaatttctggggtgtcttttgatccacatcctacttccttatttctattccatccaggcagttgaagtcatcaaaccaaccaagcctttgtatagcatggtaggtgatggagaaggacagtaattggaacagtaaggaaacagaggcatatctcatatgccatatatgcctgtatatcatatatcatctcctcttactccctggccaaaaaaaagatggcagattcattgtatccaggatatactgatggaggcaagtaggatggaatgccatgcctgaaggactaggtggaggtgatagttcatgccacctagagctagatattggagcatcagggctagatcaacgtgctaggtactgattgctggaaggaacccttcagaaatgaaactcctaccaattaatatgagagatctatgtttcactcaaagtttatgccagaataggactaaatgaacaaaaaagaatggcaccaggccgcaggtgtctgccccatgaattgtattcagaaggggctgcccatttggcagagttgtagaattgctagttcatctttagagttgctcatagactggagctgatcaagtaattacaaaaccagtcaaacaaggtctatatcctcttccttgaaaatagctagtgagaccaaagtagtcatctggtcaccatgctaggatcctctgcttccctctcacatggcatagtcagtgttctaggtctccactgtcttggagctgaggaacaatttgatttgatttggtaagtcatatccccgtagctttaacacagtgacttcctattcctcattctgaataggaaagagtttggggtgcagggtagttttacagctaagtggaaaccagaaagaagaaaacagacagtatagagttttctcagagtagaaaggagtcacgagaaaaagtaagggaagaggtatggatattacctcactccaacaaccaatacatactaccacatctctaacaaaaataaacctcaagcctgagggattccttttctctaattcctcattttcagcagaataaggaaagtagatacttcaggcataatatgcctaagtgtatcaacattagctggcctcagaatctggaaagaagctcagtaaatcagttttgatttacactatcctacagcctcagtaataagattccacctggaactctgagtttaacttttcagctgtgtgtaatttgatctattgatgtcaggaacaggagcaaactgtacaggatgttgaatcagtttcccatctcacgctgcgagaccacctcatataggtggtaatgaaagaaatgttccctttgtcttttatctcatacatgatgacattcttcaaaatgaaccagttgtttagagcgggtatgcttctttccagaaataaattggtactgggatagcttggcttacttgtgcagcaaatgggaagactctttcccatttgctaatggtggttaccaattcagcaaagtgagttgaaggagagtctgattcacagatgctgacttagatgttagccctctcataaaaccatagtaataattaacaatgaaatgtgccagccacactttgaatcactttccatgtggtaactcaatttaattttaacaactttatgagctaggcattatcattttcactactttacagttgagggagttatgccacaaagaggtgaaataacttctccaagaccacacagctagaaaaaagcagagccaagatccaagttaggttggctctagagtctgtacttgtaaacactgtactaaattgtctctctgacatatcacaaagagcagcaggtttggagtcaggatagactggcttgaattctttaaaaaaaaaaaaaatcagcctttctggctgggcacaatggctcacttctgtaatcccagcattttaagagtccaagacaggtggatcacctgaggtcaggagctcaagaccagcctggccaacatggtgaaaccccgtctctactaaaaatacaaaaattagctgggcatgtgcctgtaatcccagctacttgggaggctgaggagggagaatcgcttgaacctgggaggcagaggttgcagtgagccaagactgtgccactgcactccagcctgggtgaaagagcgagactccatctcaaaaaaagagagagagagactcaactacttttttaagataagttaaacaaaagaagtgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaattgtattcttaaagcacaaatgtgactcataggcaggtgtatttccatttagagaactcaaccagtagctgaggatataggagcaaggtctagatctcagaaaaagttacgaacaagctaagcaagagattagggatatcgctaaagggacccaagttcaggacgagacttcaatacagtgaaagaactagaagacacttagttccttggcaatcaagactggagaaaatggagactcaatctaagacttcagattgttgggctaagaagatgctcaaatgtgcccatcccaggtacataacatatagtctaggcttatcgaggcacaaaagctgataaagaaccctaagtttcttccagcttttgttttgactaagttgggaattttgcctgcaacgtaagtgctttggtacctgtatcagggtcaatctgcgaaggcaaagaccgagacttcccgtttatagcagttccaaacctgctccgctttcagccctgttttgttgttgttgttgttgttgttgctgctgctgctgttgttgttgttgttgtgagattctgcctctgttgcccaggctggagtgcagtggtgtgatcttggctcactgcaacctccgtctccctggttcaagcaattctcctgcctcacctttggagtagctgggatcacaggtgtgcaccaccacgcctggctaatttttgtatttttggtagagatggggtctcaccatgttagtcaggctggtctcaaactcctaacctcaggtgatctacctgcctcggcctcccaaagcgctgggattacaggtatgagccactgcacccagcccccaaccctctgttctcttttttatgtatcatgaaatagtagaatacatctgagtcatcagaactgacagcctctgcttacaaaagcaacagatcagcaggtcctaagttaacgctttgacctcaccgtctacctctcttccccctgccttcattgtttctcaaacatgcagaaggaggtgcaacttagggcctttgcaggtactgctccttctggctggtacaagcatcaccatacagccaaatgactggttctttcttgtctttcagttcttggctaaaatgttgccttctcaatgaggactttcctgatcaaccttttttaaattaccctattctccccaaggcattaataacatcatgtcagagctcttagcaaaatctgaaactatcttgttgggttttaatttgcttactgaaatggcagatgtgcaaggttttttcttatcacttattgtgttaaatgaatcaagatactcagagtgcttctcttgagaaaacctatgcctcacttaggttgacaaagtttcaacacatgaacacaggaggcatatatagtatatacatgtatttcatcagtcccaaagaacaactggcgacatgactagctttataaaattgcaaggcgttggatgggggagctagggaactttacaaaacacacaaggtctctgaaccaaaaatcaacattggctgtgaacagtaacatggattatcagtgacattttttgcttccatttacaactgtttacagtggatttttttttaactgaccaactctttagtttgtggagttggttttacatctctaggcctggtttttaaagatattcttaattttgatgaaaatcttcattatgatctcctggactggatgtaacatttaaaaaaatctcctaacaacatatatcctagtaatgcagtctctggggtagtgggaaaaagtcaggactgggagtcacaagacccaggctgaggccctaaataagttccacttattcaacaaaaattgaatatgtgccaggcactgttttagcaaattcaaatagtgaatatgacagacaaagtgtctgtcccttaggaattatgttctactggggatagggagagggtgataaaaatacccttttttcatctgcagttttctcttctaaaaataggtgggcattagactagatcatctggaaagtttctcctagctctacatgttccgagagagaggaaagaaaatttgaaaggcttcgcagtagttattttagggaagtaaaatcctagatttaaatttttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctcttttcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaagacagggatagtctgttgtgttgaggctatattcctagggcctaacagtgcctgtcacatcatagatactcaactaatattgatggagtaaatgaataaatgaatgaatgaaatggctcctttgtcctctctctgttaagtgttttattcccatacagtgttgtgctgcaggcaagccctttgccagctcacaagagtgaacggttaatttttcagggattttgcaagccaattgttaagcttagtggcttgacattggccttggttggggtatatatataccatagacatagggaaatgctgcatgttaagactttttattcccacaaagagctggtttaccagcatacctctactctcatcttctaaatcaaactataaatattgagctatcatgcaaaatcatgcccataggttatttaaaatatttcaataaaaaagtattgaatttaaaaaatattaaatacatgctatataattatttacctgtgggaaatagttcttttataagctaacttataatctaaaatatgtgtctctgatctcctaaagtttgtttcctgtttttcattcagatccttatgtgaagattcatctgatgcagaatggtaagaggctgaagaagaaaaagacaacaattaaaaagaacacacttaacccctactacaatgagtcattcagctttgaagtaccttttgaacaaatccaggtaatgtcaaacataactttgtcttcccactcaatttcattccttcagaccacataaattatacacacagaccttgtaagttatcagtgcacatgccttcattagaactgccattctttctccccatgcacatttgatgcttgagctacatcaggaaggataaaatatacagcacaggatgtgctgactcatcagcccaaaacagctggcactgtgttgagcagaaataaagtaggaaaaagaaaatcaacagaacaactctgctaactcaaaaagtgcatctataaaagttaaaaagcccagagaaaactatgagctttcactatttactcccaggccataaataagtctccccatgagatctttagagcaaaaaatagtgataagagaaatatttttggttgatgctaaatatgcagcatattgagtctttattaaaagatgattaacaatagaaaaattaggctaagttgtgttttcaattatttaaatccagcttcctgtgtctgagttggaatggatggctattttattaaaaatggagccttaatatgccagacaataattatgaagggaaatattctattaaatatccttgtagttaatatgttcatattaagttgctatatgtagccacaatgataacatgcaatcttatcatttaggggtttttgaaaatatttacattttctcaccccatctccatagttagcctataagaatctaaagataatatccaataattttgggccatttcttgcaaatctttaatgggcatcagagagtcaaactgcataaagcaacactatttttacattttattaaataattggcgcaggtgtatattttcagtgatacacaagtttgcccataacttgaaggaaaaacaaagagcagacatcaaacctacaacaaagaaccttctaaaggtccagaataacaaatactctttatttattttattttatttattttaattgccaaatagtagttgtacatattcatggggcacatagtaatgttttcatatatataatgtattgtaatcaaatcagagtagttagcatatttatcatctcaaacatttatcatttgtttgtcttgggaacagtcaatatcctacttgtagctatttgaaattatatcatatgttattgttaactatagccatcctgtagtggtacagaacactagaattcattcctcctatgtagctgtgattttatatccttaaacaaatctctccctaccttccccttcccagtctttagtatcctttgttctaccttttatttctatgatatcaacttttctttagcttccacatgagtaagaacatacagtgtttactttctgttcctggcttatttcacttaacataatgtctgccagttccatccattgccacaaatgacaggattcattcttttttatggccgaatagtattccattgtgtatatgtaccacattttatttatccattcatctgttgttggacacctaggttaattctgtatgttggctgttgtgaatagtgccataccactcttaatatgccaaattgtgtcttcatttacctttaatctattcttagaagacagtatcttatgaattaatcacagctttattccaagaagaaagctaatataatagctacacttattttatatatataaaatatatattttatatatataataagtatagctatataatatatacatatataaaataagtatagctattatgttagctttcttcatggaaacattaatccaaagacatatatatatatatatatatatatatatatatatatatatatattatgcctaggtccaagttaaccactttatgtatgtaatctcatttcatacttagaagaactttatgagaaaagtactattgttattatcctaattttatatgtgaaaaaactgaggcttagaatttctttacatgtaaaataagaatgataacagtccttgtcaaagtgacattatgcatataaaagcacttggaacagcgcccaatacataggaacacacagtaaatggtcctgtcatcatcatcattattattcacatgctaatgtcctctctttttcaagttaacattttattagaaaatagatctaacaataagattaaatcagtatataaatcagtgctgtctaatagaactttgtgatgattgaaatattctatcatccatgctgtccaataatatgatagccacagctggccaatgagcacctcagtcactaatttgaccaaggaacgttatttaacttccatgtatttaaatttaaattgatatagctagatgtggctggtagctactctgtagtatagggcagtcttaaatgaccaaaaataaccaataactctaccatctttgtattggttgatagttttaaatacaacctttatcatataaattttcacatggtgtcaaattatacatacttatttactttcaacatctgttacataagtaaatgcagaggacactggttccctgttcccaataactttttcactagcctgaaccagcgggccccctgctttggacccactcacaaaccctcaagacatcaattttttccaacgatttattttgcaatatttattcagtgaacttttttgagttctaagaccttattcctatggaaactaacacctcctggcatttaatttttttaattccacaaaataaatataaagcaaggcattgagatgaaaactcccattgagctacaattctatgcctttaaaataaatatccttttcaactacaaactgcagaaaatgcaggtatattgaaagtgaagcacattaaaaataagacacatgctaggtttctggggcagcatttcagaggcaatagcgttttgtcaggacagacagaaactatgcccaatatagaatacattagacatggaaataatgagcattcctttgactgtatccctctttctctgctccttgagtcactttgttcttttttttttcctttttttataggaggcaacttttctagtcttcacctttttctagaaaaaaataattgagtatttcacatgctaaaatagggtcttaagtttgccttatcctgaggttataagacaatctgcctgtccttctgtctttctctatccctatgaaatgtattatgaaagaagcaaaatatgctaatttccaaatgcatgtgagaatgtaagcccttctcccccaaatgtagaaataaactacatatgcagctggaaacattaatccaaaggcttcacaaggatattttgtcttgaatgctactaatcaatgcattcctaagtggaataatcaaactctaaaaacttctgttacctttgtgtgtcatgtcccccaccccattcattacaatatgattgcttcctgataaatttgcttagaacaagctctaagaatcagtatagccctcttctttgttccagaaactatccagtggatagttaattcctttcacaatggaatcactccaagggaagattgtccgttttattgacaatgtgttgcatttcacattctaaattccacttgcagaagtgattgttttctctgctctgaagctgtatatcaatgacatttctcatttcattaatataataaaccagtctccagcatataaagtccactaaagggccctaactcagctggttcttaatctggccctagcttttataattacattttctgctactttcaactctggcaataaatgttacatattccatttattttaaactcttacctttacactcagctgctagattgaaaccatcacatattctgctaagtaaattcattacttaggaagtagaactgaaatttgcttttaaaaagtatatattttataccataatggtataggtttgctttcatcagttcaatcattcagaaaaggaagtcatcaaataaactttcaaaatctgatggaatcattgaataaatcccgtgtagcctaaactgatatttccatttgatatcaatgccagatacattgtagttactcagtaaatgtttactaagagaacgtatggatgagaaaaaaatatctttattactactttttaaccatacttttcactatactatcatgttttatgctcacaatcatatgattagttgaaattctatattaattctatattaatttttttgtaacatgctgtccccccacccttaaaatcagattattgcacatggttgccttgggaattgtaatcaaatagagtgggctgaacaccaatgccagaactttcactgataagacaactgaagcaaatgaatttagaggttagcacaagttgacacagactccatggcatggaggttcacagcataggctctgaaaaccaaacaactcattccttaaacaacctcagacaggttatataacttctcagagcttcaagcatccttacctgtataatggcaatattaataggatctattatgagaagtaactgagttcattcatgtaaaagacttagtgcaaagtatataataaaaattaacgtttgagtattaagattcaagtcattttcatcctcatcctagtgcttggagattgattcttctatttccaattctttagcgctcaaggacgctttatagtcgggccttatctctagagctagatgattcatattcatttcatggcttctttcagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttga

SEQ ID NO: 807 - DNA, 13362 bp, Homo sapiens
ctccaagagcagagctttaacttcagaattttagtgtatgtacaaaagtccacagctccagctgaaggccccattgttccgtgctcgcccctgccttaggacagttcagcttgctatgtgcttgtccaggcagagggcacaggagtgccaagtttctattagtgtaacatgattgatttaaaaacaaaacaaaacaaaacaaaaacaaaaaaaactgcttatgcactgtgaaaaaggctcagggacgaaccaggggcccccgagcagccttgctggtgaggacacccaaaacgggcatgaggcatagcgtccctcatcctcgcaaaccacccactcaggctcttgagcccacggcgcacctctctccgcgcgcacagcgctgactgtcggcggcgcgcaggcagctgagaaaagctatgtacatcgaggggttagcaccaagtaggcggctgctagctcctgcttgcccctgcaggacccctcctttccagaaaaaagtggggttggaaggcgatctcgcaggacggtccttagagctgcccgcaggggcgcagcctcatctgagaagactgggcgcgggcgggagggcggcggggccgcaaagcgcctcctcgatgtcctccaggcagcccagcaggtccatgtcgcggagcacgcgtcccagcagctccagcgtggcctcgcgccgcggcgtgcgccgcctccaggtcgccagcatgctgtattgcgcctcgcgcaggcagcgcccgttctgcagctccagccgatcgatctcgtggtcgctcagccctaggcgccgcacgaattccttccagcgcaacgggggcacgttctccaccacggcgtacagcgtcgcggggtcatcagctgcggggacgcgggccggtgagcctcgggcggcaaccccaggccccgccccgcatcccgcgccctccgcctctcgtggtcccctctgggagcgcctcccgcgctcccccggccctcccccagcctcctcgtctccagccgcgggagaaactcactgtctaggctctgtggcttgtgggcgctgtcctcccacttctgaagggggttggggatggggtcggaggcgagggctgtcgcaaggatggggtcagccccctgatagggtggtgccacctctctgcggggagccgcaaagttgggacagtcaccgggggtataggtggagctggaggtgaaggtggaactgggcacgggactgaagcccagggtgggggtgaagcctggagtgggactgaagcttgggtttggggccaggggcttagtagtagttccttcaagctccccctgaaagagagaaggtggcgcaacattagtgcggcagcgaaaaccagccccggccctctttattctacgtgggggttgggacttagagggaatgaggcgagcccccggaaagtgaaggatgattccaggggatctgagcattaggcaattataaggaatggtcagggacatttgggagtaactctctcatttcatctcacctctttttcaggtgtcgatttcccacaaactgaggaaaaagaaagaaagcatcataaatttcacttcctctctcagccctggcaccctggactcagctggcagtggggacttgtggtgacatgcctcagggcctatgtggccccagggacgagagagctactgatgcagctcgacatctccccagccatccagggccaccttctgcccagagtccccagcggtatgaactgaggggacactcctcacctccctccacacatgtccatcgcacccacccatgtcctccctcacccccaccagctccctctccctcccaaagcccccactcaccaatggagtagagcttggacttccaccgttggtagcgatacattaaaccaatgaagaggagggataaaaggcaaagaccaaagaaaatgaccaggggcaacagcactgtggtgcctgcagacaaagcaggtgttggtcagaggagcgggcagaggggggccgcagggatagatggatgggtgggatggatggacgggtgggggcaagaagagggagagggcaggtgagcatgggcaccaggtcacttctcctcacctgagtcctcagtgcccttaacattctcaatctggggtaggcacaacttcgtgcactccaggcttttcttacagctaaaagaagagacggcactggtgaacagaggccctaccattggaggaacacagaaaaacaaccacacagattgttggacatcctttctttacaaatatttttgctgtctcttgatataatttgttttgggaactgatgcagaagaatgaaacacagttaatcatagaatcatttaattttagaattggcagggatcttgaaaaggctgtgtagaaaatgtgaaaagcagtcagggtcagggtgtaaattccagttcattccttggctagcagtgtgaatctaggcaagccattaacccccaagcctcggtttcctcatcaccacagggatcgcccacctctcaggattgaggattaagcaaaatcattatgcctcatttaataagtgcttgagaaggtagccagctagctgttatgggattgttgtttcatcactgttttgctgataagaatcctttggcaaagagaggttaaagggctttttcttaaatgacactgctagttacagtacctgacttcggggagtcggggtcaaacatgcatgtgaaaaatttaaaaacacatgttactggggcagccagagagcaccctgtagaactagcagatcttccatgttgggagttgtcactggacagtgtggagtgatgggaactctatggggtggtgctggaaggaacttgagagagtgagttcccagcaggaagctgaaagcagggagaggcactttagcccaccactcaagctcatggtgagaaccacatagaatggtataaaagtgatttcaagaagagatgaagccggctgggtgcagtggctcacggctgtaatcccagcactttgggaggcagaggcaggtggatcaccaggagtttgagaccagcctgaccaagatggtgaaaccccatctctactaaaaatacaaaaattagccaggcatggtggcacgtgcctgtaatcccagctacttgggaggctgaagcaggagaattgcttgaatctgggaggcagaggttgcagtgagccgagatcgcgccactgcattccagcctgggcgacagagcaggactctgtgtcaaaaaaaaaaaaaaaaaaaaaaaagaagattaatggaaaataaatagttttgtgtcagacgtgttgtaggttttgtttgtttctttgtttttggttctcacaaattcaccaaatgaatgtcattatgcttactttaaatataagaaatctaaggcccaggccaggcgtggtggctcatgcccgtaatcctagcactttgggaggctgaggcggaagatcgcttgagcccaggagtccgaggccagcctgggcaatatagtaggaccctgtctctacaaaaagtaaaacattagctgggtgtagtggtgtgtgcctctaatcccagctactcaggaggctaaggcaagaggatggcttgagccctggaggtggaggctgagccacggttgcaccactgcactccagcctgggtgacagagtgaaaccctgtctcaaaaaaaaaaaaaaaaaaaaaacaccaaaagaaaagtcaggctcagagatgttaagaaacttgcccaacgtcacatagccagtaagtggctatgctggggttcaaactctgagagccctcagagtttattctttgcaagtgagtgacaagaacagcctctgtggagccaggagtaaggaggcctggacagtgactaatgaggaaataccatattgcatcaaacctaagacgccatcaagaataaaaggcacttttctttacattactacccagacgcaaacagagctgccaattcaaccatgatgagtcaccagttataggaggtttgatttcagagctataagagtgtatgtcctagaaccaatgagctatcgtagatccaagaatctacatatctgagttggaagggctgccagcccttggggcatgatcttccatcctcaaagacttcttcagatttgaagagcaaggggaaggactgcctggtgtcttaacgaagtgtctcctactcagccagtaggaccctgagcactctggggcatcctggcatctgttgcccagctaatggttcccaccagtcacccgtcccaacccatgccaccatccagtgcccagcagctctcagagatactcacttactacaggagacacactcgttttctcttagaaagaaacctgcatggcaggtgcacacggtgttctgtttctcctggcctgtagggagaagtgcggcacagctaaaggagaagcgcctgcacccccaccccacaggacagaggaagtgacgagggacagggtgggggcggccagagaggagttggttgtcagacccacagaatacaggagggggaaggaaaggaagtgccaccgcatggggaaggggccaacccctggggtggggagagggcttggcctcaggagagctgcgctcacaggagaggtgcacggtcccattgaggcagaggctgcaattgaagcactggaaaaggttttcactccaataatgccggtactggttcttcctgcagccacacacggtgtcccggtccactgtgcaagaagagatctccacctgacccatttctggtgaggggagaagatggggtatgagtcctgcatcctcctgtccctgcatccccttcctgacatacccctaagtgtgtgtctctgtaatacacactcacatccatgcagtgtcccaccaaaacacacaccttcctgcccacacccaccagcctgcacatagacaggcacccacacaccactcaagacccgcctgactctcctgcctgtgcacactcaccctttcggcatttggagcagctgaggcagtgtctgaggtggttttctgaagcggtgaaggagccgctctcacactccctgcagtccgtatcctgccccgggcctggacagtcattgtacaagtaggttcctgtgaatggggccgcagagttaggctgcgggtgagaacacaaggaaggagccccatgctagggacaacagccagggccgattccctgaagtctctaggagaggagggagggagaaaatcccagcccaggagagacagcaaagttagggaagaacaactggaagaagcagagaaagaagcagcaccccagacctgagggcattcaccgtttccacttgcccctacctttgtggcacttggtacagcaaatcgaattattttgagggtggatatattttccttggggacacacactatctctcttctccctgtcccctaggtgagggaccagtccaataacccctgaggggtatattcccaccaacagctccaggagcacctggggaagaatcagatagaggagacaccatcaagagagggagggatgggaagcttaggggtagcagatctaaaacttccctggctcaagtccttcctcagtgaaacattccgcccaggccacgccactcactaagtttagagttcttccttgaaacttagacagttggggccatacaatctgatgcttaattgttctctagttgtcctgtgtgttcatttttgttccctcaactcaaagctagtaggccccagatctaagctgtatttttttttttttaggcaggatcttgctctgttgtccaggctggagtgcagtgatgcaatcactgcaccctccaccacccacgctcaagcagtcctcccaccttagcctcctgaatagctgggactacggccgtgaaccaccatgcccagctaatttttttttatttttagtagaggcagggtcttgttacgttgctcagactggtctcaaaatcctgggctcaagtgatcctcccaccttggcttcccaaagtgctaggattacaggcgtgagcccagccctgtattttatccttactgtgaaatcccccacagcagctaacagtgctggacacagggcagatgttgaaaggatgtgtttttgattgggaattggcaggttacttcagtgatggccccttcttccaacaagcagccctaaagattggggcggtgtttctccatctgggtgctgggttcaccgtgtgatcgctttgcgaacattcacagaggtaaacaatgaggatctatgcacatcccaggaatatgttacaccatgaaaagctttctgaaaaagtcagctggcggtgggggcgagtgatgttcccgtgagcaccactcctggggagtggacagaagaaggaagtttatttacatgtttgtatcaaacctcaatctgcctccgccctcacattccctggcccatcccctccacctcaaaatttacaaacacccggggttggcaaggacaaatggggaggagagtaaaagggaaaggttggggatcctgcatgggtagacgggggacaaagttgagacgggggcaggagtgggcaaaggtgtgcaggacataggcaaatagagctggccaaggctagcgacccagcttggatgactgtcaggtcagagctgagggcgtgctggggagtcctggagccccctgcacaccatggcattctggaaggtgtgctttgcagtctcaggccaaccccacagcagctaaatggcttgtcctgttccggcatcagtgccaggaaagcaaagccaggagtgaatatttagctctaacttggactttgatctctgccagcttcatttctggttttccctgggcttcattttttttttctactataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcggtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcactgcaaccttcaccaccaggacggaatgtagtggtgtggtcagggctcactacaacctccacctcctgggcccaagccgtcctcccgagctcagtctcccgaatagctgggatgacaagcacgccccaccatgccccgctaatctttgtattttttgtagagacagggttttgctgtgttgcccaggctggtctcgaactcctggactcaagcaatccacacacctcggcctcctgaagtgctggaattacaggcatgaaccacagcacccatctgagatgcctcacctcacttctaatcacagtctgggcacagaatgtgccctaggagaacagcttctgaataaacgaatgaatgaattcctccacctggaaccatattcaacactcttcctccatcctctcccccactccctctaattctcccattcacatttcttagtgtttctcaacatggtttttccactcccgaaccaaggtgtctggcttcctgccaccctgcccatcaacacaaaatcccatctctccattcctctcctcttcctcacatcagtatccaactctgcttccctcctttatagctaccctgacaggcagtgacttcagatgtcagctccacatccacttttctatgaggctttccctccgccatcccatctgacacatctcttgttccttaattccttcagcaaatagttaaggggcacagttaatgtgacaggtcccgtatgggtgctagggatgctgaggtggataatacacagctcgtgctctcaagagctctcacttgagtcaaagacagtcagttgtaggcactgagatctatacagggagtgctgcagttgcacagtgaaggacactgaagcagcgtggggaagctcctgaattttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctctctcacacacacacacacacacacacacacacacacactgtgagctctgcattgcccactgaatggtgagaaattcagaaggatgttgcattccctttgttttccctttcctccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgctacaacctattcccctgatggactgtcaaagctgtgggcagggattttgttctctgctgtaatcccagcacctatcacagtgtctagcccagagcgcacacttaataaatcaaatgaacacttaacatgtatcagtctattcaatcttcaaaacaacagtatgaggtcaagactgtgacacccattttggagataaagaaacgaaggcatggaaggttaggttatataagctgctcttgttcatgcaggaggtatgtgagggagccaggggccgcccccaaacagaaaacagaagcaggatgtcagggcagctggctggtggggagaccgtgggggaaggacagtgggaagaagggaagagcgggtgggactaaggaggcaggaggaggcagaagaagaagagtgagaccctgaccagagacgtgctgcctggggacctggggccgggaccagagcggagcagagaggaggggaaggaggattagcgagaaaagatttcaaaaaaagaggctctgagaagtctgaggagagtctggggagattgctggaagaaaggaatggtaggagaggaagagtataaggcactaaagagaggggaggtaggcgcagccttcagaggccgggcagggcagggaaaatctgcctgactagatgggcccaggacatctgaacaggatgattcccggaccaagacgtggaggacgatcaaggatacattgaaacaaggctgaggccagagaaagggacattttccagtgacgaaaacaactttctaccaacttccccaaactgaactgtagaataagaaaccaagggattgttgtttaggtctgtgagaagcagcggggaggggaagctggaggacaggcccagggacactgaccaggtgggggtaggactagctccctgggaaggctcagtcccacagcggctacctgcctagcagcaggcaaaagggtaaagaatgtccccaggtgagaggccggggcttggccagggcactggggacactgtccactgggttgccctgccccatccagtgtcccagcccattctcaaatacctcccaccatgagcatcccaaacccaccacaccagcccatccccactcctcaactcactcccccacttcaccagccgccaaaatcctgccctacagggtgtgctccaccaagttccacaggcagcctcgcctccccacggcccaacaccctccaggccagccagctgaccggagggacagaattcagaaccgtctggactccccgagcactaatcttcctactcccactcccttcttttccccgccaaatctgccccaccctgggcctatctcctgcccacattcccttggccgcccacaaacttccaccgctgtcaggggccagggcttccttttactctctccctttcaaacttctcccattcccctgcctcagcgcagcccctactccaaaaggcggatgaatggggaaccccacactggcagtggctgaggttaggacctgcaggcctgaggctggcgccaggaccaggcccgggcaggagaggctcggccccctcccggagagggcccacgccagccggaaggtgcctcgcccaccagcccactcttccctttgtccctggtctcaccagtggcagcagcaggtcaggcacggtggagaggcccatgccagacagctatggcctctcactcccccatttgggctcagggcagtgtggcagcggcagtgctggggcttcccgggactcggtctgtccaggacgtcccaagtgccttggggtgacagttgagggttgagactcgggcatagagatcacggcctggtcccagtgatcttgaaccccaaaggccagaactggagcctcagtccagagaattctgagaaaattaaagcagagaggaggggagagaaggtgggaggggaagagtgaggcagtgttgcaacagcgggacaggaagagctggaggag

SEQ ID NO: 808 - DNA, 287832 bp, Homo sapiens
gtatattttgttaacatttttattggtacgtgctctcagtacaacaaacagcatcagtagtgtacactttgataaaaaggaatttttagcttagtagaaaagaaagcccaaaggtcagaagtataatgaatatgtacatctttatggaaactgtttgtgtgaccatctttatcttcccctgtggatgagatgtatgcacacacaagtaaactagagagaattttattctatgggaatttttaggaaaaaaaaaagacttaaggcttagggattgttttactatctggaatttgcctaatttgaccttcaaagttcttgcacaaagtagcagcaattctttagaggtatagagtcaatagtttaagctgttagtttacaacgattaaaatgcaaaagttcttgcacattctgtgctttgagaggttaattcatctacattttagtttgtataatatatttttagacagctcaggtactgacctcaaaatcattatgctgatatcactatctcctctcatgtacatgtaattcatgatgcacttatctctttcaaaaacttttaaaaatgtttctaattcacaatttcattgaacagctagctgagtccatacaatttaatgtttccttgaagggaaacaagtcatcaacttaatatcaactactaaaaatgcaagatgtttgcataacatcaaatttgttcagttttagcttttgagttggctgtagtagtttgcttaaaggtctctatgcacagaacaaagcatgcatctctaattatgtctctctagtttaccaaaatatgtaattgatattagtgtaaatatttagtacataaaaatactatcaagaaaaaaaatcaacttttaataaatatcttcagttctgaattctatgtacaagtactttacatctactccctggagagagcatttctggctttgctgtgagcaaggtgactactgacataaattattagcacattattgcagtcagatgcattgtggttgtgaacatttgaacatgaaccatatggaaaataaatatctcaaccatcgacatatgctttcttgaacctgccttcaaagccccaaagctctactatactcaaatatcaattctagactgatgatatttttctcagctaccaacatacaaataagttatcccaaaactttttcctttgcgattattacagtacattgagtataactgtttgtatctgtcaacaatgcgaaaattaaaaaagaacacacacacacaaaaacaaaggacacctcaacggtgcctactgaggtcctggaaagagggtttcagttttgtcttgcacgagttcattatttactattcgttgatccctgtgaccacaagtgtactaagacaccaatcctttaaattataagtatagaaggcaataggtaagctgatatctgtatatctatagcttttgtgtttcttttctttttctataatttacgtatcacattgttgattcaacaaaaccctttatattgtcagtagctgtaattctaacttctcttttgtaatactctgctttgaaaattaacctatagaatgtcaaacaaggcaatactcaacgacaggcacctagaacatccagaaatgtaatatagtaaacaatcatttgagaacacatctcttaaaataatactgatttttgcaatatacagtatttacacaacagctgcaaatttgctcatacaatatttctaatatagataaataggaatacaagtctaagaattctttgttccatatccaaaatttcttgttaaagtgtaaaccattggtatctctttttaatttttactgtaacttttctaaaacaaacaaaaagtcagctgatatgcacaattggttccagtcccttttctgcttcagagagcgaccaacacaatcttagcaacatatttttcttttgtaataatctttggtgatttcttccaatgaattctggtaaatgagtcaatgcagaacaaaaggaggatgaaagcaactagaaagtgagccagcactttctgttcttccaattacagataaaatgagctgacgatctatagagatttccactttaaacaagcatatgcaccatgggaagagagaggttgtccaggttttcctctggtttctagcctttttggttcactttctcatctttctaaggtggatgatcttgtcggacgtctgttgtcaatgatctttccatctttctttgaggttcttgcctgagaagaagcacctattgaatcactggctgcaaagaaggaagcagcagccatttgtgaagctgaactgaggtggaccctcttggtgggtggggaggatggtacggtgaccagtctcacagtcttacttcctgcttgctgagcactcctctggcgtaaattagcaccatcaggtttactgtttggcctgaaagcagcatatgcatttggacctcccactgaagagatgctactcaaagacatcttctttgcaggggtctctgaatgataaggaaccaaagatgtaggcatcactagagatctagggaggtcactagggttagagatgacatcatcatgagtttcagcagcttctagaaggtatggtggtggcagggtgctactgcgcttgctgcaggactcacaacataacttgttataacctggtatggagcagtatcgtgccaacacttccatttgacagaatatggacttgtctcccaaacatggttcatctgcaaaaataaaaagaaaataaactaacactagcatctaaacataaaataaaaggaggaaaaaaattaaaatttttaatgaatgtaaaaagatttaagtgcaatctgacactaacgggagtgatccacacgagcttttgcattaaaaatatgaatattagaatgaattcactaaaataagtagttctttgtctacaaagtccttgtgatgatcattattttaatatttccaccaggagtcttcagaccacagagggtatttttttctccaagtaggaacctatatctgattttagaatgggcaaagataatttatttaacgttgtggttaaatttttaggatgcaaaggggcatctgtatttttattttatggtatttctgactttctcagagggtactccctacattacgttaaaatgtgaaatcaaaataaatactaaacacttgtaaaaacaaaacaaatcttacaaaggtattctccaaagaataatcaaaataccatcttgatttaaaaaaattctccagtttgagatcgagaccatcctggctaacacagtgaaaagccgtctctactaaaaatacaaaaaaaattagccaggcgcggtggcaggcgcctgtagtcccagctactcgtgaggctgaggtaggagagtggcgtgaacccaggaggtggagcttgcagtgagccaagattgtgccactgcactccagcctgggtgacagagcgagactctgtctcaaaaaaaaaaaaaaaaattctccagtttgaataaaatagtttcatgtttatcattgaatattctcagattatttgttatttgaatgcacaaatttgggtaaagtatgccaaatttcttatgaataattcatggttcttacatttaattttattgaattgacagtactttatgtttaaaggatacttagtaacactcataaaatgtaatttcattgaattgacagcactttgtctaaaaattactaaagtaatactcataaaacacttgataacatctaaagtaacacttctaaaacacttcatactgcatgtgtacacattatttttattactttaaaattttattgattccaggttacaagaattggatttcagataatccaaatattaagctcataaaaatgttaacttgtgcatagttttagtcatcctgggtataccttatgaaataaagacatatcctgtgcctctctgataacagaaccagtgcatagagtagcatccctgcatatgtgcaacacagaaacactgatccatgcccaaagaagaaatgcaaagaactgtcaattgtggcatttatgtaatagaatcacttaaagttacagcctattattgggtaatactatactgctaagaaagaggcctgctacataactccccaaaaattgaaaaaatcctttttctaaagttagaaacaaaaaaagagagagtcagctggcgaagccaatagaggactaaaattaccaacattgagctgtaatacgatgtccacttcccaaattgtgaaatgactcatatatgcttgacatgtgcaggtctattatatggtataatgtgtctgaatacttcatataagctaggtcatcatctaattatgttatgaatgagcattatattaatgagtttcaccttaaatattttctcatgtgtgaattttttttgaaaacctgtatcttaaaataagaaaaatgtcttctttctgtatgtgtcaggctctaggtctcaagaggagaggacattattcgatcttgtcctctctttttcctctaacccctttccctcatcgcccctgttaggaggcccctcttagaagtacgacctgttttctctgagttagagaaggagtccaaccaaaggtctcccatgtctaagtgtgagcactttggcattgcagagtcctgttcataacctgggtttcattagggccagaatttacttttgtgtggaggagcaaaagggagagatattctgagaaaaataagagcaaaggaatacattaaccttatgggaatttgcctactgataaatgagaagagcttacaggcaaaaaaaaaaaaaaaaaatggtacaatcaatcaaaatatggagtcacatgaaaaaaatcaatcaattacaaaaaaattaaggcaacttttcagacttctcgttccacccccaaatcattataagaggttctggaaaagagattcacacatggtctcaaaaggccatttgattctaatagcagtttgagattctgatagaaagtattacttattttacttcaaatatggtagaaacatgtgaccgttagaactcttaggattgccctttgggcctcaattttagaacaacagaacaactaaaagggatatgaaatcactatgatagttaagctatcttattagctccctggttttatattcaaaacaatttcttctggctaaagaaggagaatcaagaaaattcttgctaaccattgggcacgtctgtagaaatgcacagctgtaccagctccaagatcaataaagcttacttacaaagtggcagcctcttaacaggaataactacataagaataaaatattctggtgacagtatatgttaaaacttctgagtaaagtttgttcttttggttttgatttgtattttgagctcttacatatgtcaatactttccaaagtaaaatgattaaatatataagtcctatgtctccctctcatggtcagatatgttcttgctataatatatttcagatgaaaatttataatgaagtaatttataagggttgaagacttaaagcctgaaaatgagcttcaaaaaataaaacatttgacaagatagtgctttgccaattttcttgacaaaaagcaccattcagcagatgtcaatattcaaacaatgtcttacttatggtgttggaggccaaggaaaaagcaacttctttaggcctgagtcttctaatatgtgaaaacaacgtccacagttgtcactgtcgtggctttagcagaactgcatttaagagaagggttgtggtggatggggatgggtgggctaggaaaacaaggcaggagaagaaaatataacggaagagagagtgcaacaaacagatgggggtggcgagagactgacttggggagagaaaatgagacaggaagagaaaaagatgtcagtggaggggctaggaagagaaagataggaggagaaagagacagacacaaggagtaaaagatggaggagtagagaaaaagaggctggaaggagaggaaaaaggtgggtatggcctgaatgtgtgcccccaaaattcctttgttgaaacctaatcctcacggcaatggtactaacagggtggggactttgggaggtgactaggccatcagggtggagcgcttatgaatgcaattcatgcccttataaaagagaatcaagggagctccctggcccttttcaccacatgtggacagaaaaacaaggcaccatctaggaagccctcaccagacactaaatctgctgatgccttgatcatgggcttctagacttagaactctgagcaataatttttttttaataaagtacccagtctcaggtattttgttatagcagctagaacagactaaggcagtggaggagataagagacagggagagagagagaggtggaagagatggagagacagagacagacataccaagttggagaggaaggggaggataaagaaagagaaagggagagggtgaaggggaggacaccgagaaagagaaaatgggagagaaagggagacagacacatggaacaaggaaagaggggaaagagagagccaggaagaggcaggaggagagagaagatgagagggaaaaagaatgataggaggtacagccagggagactaggagagggagagggaaggacagcaagaagaaagagtaaggcctcgaaaaagcatgtgtggctgacatagaaaatgagccacatacaggcagcaggtgacagctcatcagagacagagcaagacagacaccaaaaataagagagagacagaggacagcaaatggagacacagatgaccgagcacaggacagacagagatgtggatagagagctatggaaatggaggcagaaggagacagtgatagagcccaaaaccatccaatatattttgcttgttttatttacttatgttttgaaatggagtctcactctgtcacccaggctggaatgcagtggcgtgatctcagctcactgcaacctctgtctcctgggttcaagcaattctcctgcctctgcctcccaagtagctgaaattacaggcatgcgccaccatgcccagctaatttttgtatttttagtagagacagggttttaccatgttgttcaggctggtctcgaactcctgacctcaggtgattcacccaccttggcctcccaaagtgctgggattacaggcatgagccaccgcacctggccccattttgctgttttaaaatagcaaattgactaaataaagaaaatatactctgcttttgccatacagcaagttggcaggtcaggcaaatgctgaattttatcctatgtgcaaggtgtctgtttgaagttactctatggacagacagttattggaaatggctttagggttgagtaacattacccacagatcaaaattgaataattttagtaaaatatttcaaaatctttgcaaaattatgcttttaataaagatgtgaagttatagttaaatataacaaggaaaaattaagtggttcctattagcaacacaaattgatagacgttacatatacatggcacagccctcactccaatgccaccagccagaaatggcagggctatagtgatcatgataattaaaaagtgtaggacattacctcaaatgctgatcttaaagaactgaactggactaatatttcacaggtgttttcctttggttatttatcagtaaacaaatataaattctataacttctctcaaaaggaaattctgctttttgaggtttaaaaacatcagagcagtgaagtcaattggtgtgacacctaccattacaaggaggcagttgacaggctctgaccgactcaggcttttcaccatcacagtggtccccagccctgcagaggacctgcctcacctccgttccttcaccgcaggtcactgaacactgcagagacaaaggctgtggttacagacatttattgcaccaagaccatgcacatacacacacacacacacacacacacacacacacacacacacacacaaagacacagagatctggagtgggttctctattaagtaatgctgcacagtggttttgaagacagatactactgagtttatattctgactccattatttaccagcctgggagcattgttttttctacataagattcaccttccttatctagtggaaagctgggataataatacctgtcttataagattgttttaggactaaatgaaggcaaaggaacaaagtgtataaagcagtaacaaaattcctgacacctagtaagcatatcatatgaaagaagccatgattaataacaatggtaacatctgctgtagtttctaaatacaatgttgatgatgtctgttctcagggacccaatcatagtattgacagtcctcacttctttcttacagatagcagaatttactgataagttgccttggatggttaattcaacatccttggaactactatttctctgtgctcttaagttcatttctctaatgaaaaggtttactgctctaaaactaagctcagaaagttccatgtaatggccctaggaaggtgctgtggaggagggacttctactgagactttgatatgtgttatcattatcatcctatgtgggtgacctgcacttgtactatggtttgaatgtcccctccaaaactcaggttgaaatttaactgccattgtaacaatgttgagagggacctttaagaggtgggacctttctgaggtgatttatgggcatgggttaatgctattatcttgggaatgggttagttattgcaggaatgggctactgatagaaggatcctctgtgtctctcttgcatgcctccttgccatgtgatgccttcagctacaggaagaccctctccagatgccagtgccatactcttggactctgcagcctccagaaccatatgccaaataaacttttgttctttataaattacccaatctgtggaattctgttaaagcagcaagaaatagataagacaacttgcttgtttcttcctttctgggcttattctccacttactctttagtcttctgtctgctttttcatgccctttcctcctataaactattctcctatgaccccaagatttcttattttgagtctttagaaatatctaagacaggtggtaatagctgacaatgcaacattgagtcagccaattagcaaacaaacatcatctggacaggtatgctaggcactagctgagtgctgaggaaacaaggcatactatttttgagaaatgtgtgtactagtggcaaatatagattcaagaatcagagttataatactctgtcatgaacagcatggtaaagttaagttgtactgcatttcagatatacaggaggaactgccaggaaaggtaccacctggaaggtggtcatttggactacggagatgaggtttggtggagaaggagagattatcaggtaggaggagggggagtacaagtcagctgaaaggtaggaggctcaaacaagcatggtctgtttggaacagtgtgaagtttactcgaactgggacaaagagttggaatgaagaaagaataagaggagttagtgcagtgccaaatggtgctgggccctgcattcaatatcaggggtttggaatttatactgaaggaatagggaagtcaacaaaaatattagacaaaagaacagtcatctttcagacttcttctctatgttatgaaacacataaacatggtttgcccctaacatgtactgtcttaaagcattaatttttcctaacacctccaggtaattacaaaatatgcagtagtttctcagttcacacaaagcctaactgatgtttaagccaaattaaaatatctacacatgcttacacacacactttacttatgcatgcacggaattcacacacctacctcactccagggtcctgttttccactgtgcagggcagggcactctgttacagggccggcggctctcgggacggtcacccatgcagtatttgctgtgcacagagcggttggtgccatcaaggagtggctgaaggcagcgtacagtgcgaagctgatagccagaacttccacaggttttggtgcagtgttcccattcttctgctacccagctgtgggtgcggggatttaatattgcaattatcactggtatgtatagtgtacacatttctacctgcaaagcctagacttttctgctctctaagtgacttgcaacctagtgggcacactgcagttcaggaagtggtttcagaaagatggatataatggataactttttaacaatagtaggctgaaacttttattttattattattatactttaagttttagggtacatgtgcacaatgtgcaggttagttacatatgtatacatgtgccatgctggtgtgctgcacccattaactcatcatttagcattaggtatatcttctaatactatccctccccctccccccaccccacaacagtccccagagtgtgatgttccccttcctgtgtccatgtgttctcactgttcaattcccatctatgagtgagaacatgcggtgtttcgttttttgtccttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagaagcatgatttatagtcctttgggtatatacccagtaatgggatggctgggtcaaatggtatttctagttctagatccctgaggaatcgccacactgacttccacaatggttgaactagcttacagtcccaccaacggtgtaaaagttttcctatttctcaaataggatgtggctgaaacttttaatgccctatttttttctgcctctcagtgactctgaaatcttcttctttcctaaaggatgatctacagagggtttctgaaactcatcttaaagttgccctgttagattcaggcatgaaggcagttttcaaggatagcaccaactcactctcagttacattgcctaatggtgttaaacatctgacagtgaatctttaaaacagaatccatctaatggttgctaagacacacttacgatttctttacataaccttctgttttcactatggtttccttctctcttggtcatgtctattatacatagttaaaaatctggttcacattctacagaggatacacctcatgtctttttctgggttggacgagggcacatttttataaaatctggagagttcactcatgtttaaatattttaactgatatgactgttttatttctacagttgttgctatgaaggctacttgacatatctatactgtttggataatgcagttcttcttattggcccttactgggcctgacaagaggtaagggtggtgtgcattggggctgggtaaaaactgttcacacaaatgcacccgatagaaacatttccagaggcattttccaaaatattaaccaggggacattcccaaattctaatgtcagtgtcagtgtcccaagcactctccaaatcagctgtggatacaacattacacacagttctccagtacacatggttaccaagtcccaaagggtggtcaccattgactccatctggttatgcaagctgtctgtatgtaattcaggctaaaatggatttgccttttccaaagttactttccctctgcaatttatttttctttccatatatatgaggcaccaaaatataaccatgctaaaaccttggcagtctttggtattcacagtttaagactgctttagcttgtcaaactggtggtaaaatgaatgtctcaaggcaactggactgaggaattttgctcaattttgaagacttcagtgatgactctcttttgaagacaaatattatacttcacagatataggtacttctgattacctccattccctcctaagatctcagaatgaaagtaaatgacaaaaatgttataaatctagaaagacaaagaaatttgagaggaagtcacagcaacataattttggaacctagaagacagatggacatatggaaactaactcagcagatctaagaagaatgaagtccaactcagcagtacaaggtgatgagcaaactgacttgcactgtagaactttagaaatatttagggattagaggccttagattcagtgtgagctgtgaaaacaagggtgaagccaagactgaaagcaggataactaatgaaaagtctgtttggaagcagttagacctcctgattcttaaccatacagggtgatttgccctcctccaacgcagaagacatgaggtttatcctctgtagaatgtgaaccagacttaactggatacaatagacatgatcaagagagaaagaaaccacagtgaaaacagaaggttacgtaaaaatccatctgtgaaatggtgagatcgctttagaaacctatacacatttccagaacagcctttaaactggcttacactccctaggcaagaaattgattctgttctatggaatcttttttataagaaaaacactaaatatacaattaattgaggctctttcaataaaatagctgagtcagatcaccctatagttgagcccacgagccacgactgtaaggcaaacttctaatcagccttctaaacactgcatttttatacacgtatgaacatcccaggattaccacatagaaatcctctaacataaatgatggaggtggagtgggtgtggagaagtggaagaaaagaactcaaaagaaattacttagaaacaggaaatgaatccttgatattccagaagagataaaagaatacattgcatctgtgaaataaaaatcaaatgccttgaaaaagaaatacttgaatagatctcttgaatattaatgatatgatagcaaaaatgaaaggttcggcaagtgcaacaatggacaataggagagaaaatccaagctactaatgtcccagaaagaaagaacactgaggaacacgggagaatttttttcaaaacaaaaaaaatacaagaaaatcttccagagataaaagatatacattttatttatttaaaagtttgtgtcatttgccacaacatagatgaaactggaggaagttatgctaagtgaaatgaatcagacacagaaagacaaataccatgtgaccttcacttgttttctagattccatatgtggaatctataaaagtggaactcacagaagtggagactagaatggtggtgattaggggcttgggtgagggtgaaggagtaatggaaagatgttggtcaaggggtacaaagtttcagttagaagaaacatgtttttgagatctactgaacagcatagtgtctatggttaataattatgaaactgatatttcaaaattgctaggagagcagatttgaaatgtgtgtaccacaaaaaatgataagtatgtgatgtgatagattggttaattagctgagtttaatcattccacaatgtatgcatacatcaaaacattacatcgtaccccataaaaacatacaatttttatttttcaattaaaaaactctataagtacacagcacaacgatgagtaaaaatgagcaccaagtcaatttcatcactgggatttcaggacactaggaacaaaatgacggtcctacaaactttgaaagacaaagagaccaaaacaggtcattgagaaagaactgagaatcagaatggcaactgacttttcaacagcaacacttgagtgtagataataatagaacagtatttttgagtctgagggatgatatattatagtttggagtaacagtaaatcccagagaagagaaacgtagtaggaattccaaggaggatgatgaaaggaaaccctaggatgaaagctggtaaaaagtccaagctggagctggaacacagagaactctctgttctctaagactcttccatttctatggagactaaagtgacaggatacttggatgtttagtattttgaggggattgatactgagaaagagagtttgggaatgaattagggaaaagtagtagaagatcaaatacataaaatcaaaatattcatttattctggaagaaacgttacaagaaagaaaccataataatcaatgcatgctgtgtgactcaggtattaagagagatacatgttaatacaaaccctgaatattgcgatcagtaaaaggtatgttaggtcagtaatgggagtagcagggaaggagaaagtgtggcctctgggtgtgcatttgcggagtggtcataaaataatacaatcttcagatttcacagtgaaaattcaatgtataatgtctaacccacctcccaaaaaaagtcaaggaatagaagcaaaaacatttgacttagatggaagcaagtaattaccaaatatcaaaataaatataacagttgaaagtggttgtttttgaggaacaagaatgtggtgaaaggcacagaactgcagctttatataattcctgtgaagtgacttgactatttaaaccatgtctatatagagctttgactgaaaataaaatcaaaactaaaaagagctaaaggcagtgaagtcctgattttgacctccagatatgatagttaaaatagatgcttacagtggatgtgtacactcttgaatattgcacattcgtctaataggtttcggctttttgttggcctcacagaagctgcgatggaccattttattatcacttttcctacggcatccatatttagtgtactggaaacctggaaaaggaaataaagttctttggatttaatcacttcttcatgctgatagttacttgattattcacttactcattcatacatttattcatccattcaataaatatgtattgagtgcatacaaaccggcacttcaataggtgctgaaggtcccaaagaacattaaataaacaaaaacttttaccttttcagagaatacgtttgataaatattgcaactgcatgcatgttaaagaactagactctaaatatacacagtctagcatgagaggtagatacgaaaaccactgtgacaatacttagtgacataggcttttagaaaactatgtaaataacttacagtagagggcaccaaaggaacacagagggaagagatctgtaacttggaggggaggggaaagcttagaggatcagtacttttcttcagcagaatactgaagttcaaatagtatggggtaatggaaatgaagcagaattattctccaagcaaaggaaataacgtgtgaaaaactgcggtttcttcatgtggctagaggatcatgtgtgaagagtgcacgagttagggaaggatcagatcttgaaagccttcagtgtctaacaagtttctggacattatcctgaaggttatagggagttactgagggtctctcaaacatcaacttttatatttgtaattatgtatataaatttgaaaaaattcaaacctatccaaaagttgtaagaaaaaacaatatttgtataccttgcatctagattgatcttttgtgactatgtcacatttgctatatttctttatatatgtgtatgtgtgtaaatatacatataattttgctgaaccatttgaaagttgaggacatcctgatccttcactcctaaatacttcagcacagatttcagaagtacattctcttatataactataatataattcttaaaatcaggacatttaacatagacatagtgctattatctaacatacagacctattcaaaaatgttcagttgtccctatcatgttatttatggcaatccttttccagtcaaggatcatatgttgcgtttaactgttatgtctccagcctccatcaatcagaaataattactgaacctctttttgtcttacggcatttactagttttgaaatttaaaaactatttgttttataaaatgttccgaaatttgggcctgtttaactgtgttctaatgatgagattcaagggattcatttttagaaagaatgctacataaagtgatgttgtgtcttcagggcaacatgttagaagactgaaggattttaatctgggaaataatataattttaccattcattcatgcatgcattcaagaaaaattaccctgtaaattaaggaagagaagaacatcaatattagttgactagttaaaaggctattgcaataatcgtccctcccaaagtggtgactggagtctggtgaagaaggaatagatgtggtagatatgaagaaggtatatctgacaaatattatgaccaagtaaatgttgagagtacagcagaagggagggtccaaattaaataagcatcttgtaatggataaagagatgtcatttaaaatacttaactattgtattcttccctcaagaaaacactttagaaatacagccttgaacttaaaattataaaataaataatttacacaagcactgcctaatacaaattttgttctcaattatttgctgtcatttttgtaacagcctcttgccttctcctgcccatggtgggaaattggtaatggagcacttgtttagaactagaggaatggatgatgggagaaattgagagacattaaatccagcttaatggactctggagagggaacggaggcagcacagtgcagtgagtgagagcatgtgttcagaagccaggttatctgggtttgaatcctatgggctctgggcaattatcttctgtgtgcttcagttttgctaccactttaacagagataacaacagtaccaactgcgtagggccattgtgagtattcatgcattgatatataaagcatttagaacagtatctggtttcaaatacatagcatagtcagttacacagtcatgtaaccaatagctcttttgttattaactctggtagaaatgcagagagatacagaaagcaaaagtaggtaagaagaaagatgaggaccagagtacactgaatttgggagagttttggagtttgggaagaataaagtgattaagggtaccactacagtaaatgcaagacaaaggacctgagagaaaagggcaagaggattttaaggtctgtcactgttatgaaaggaatcctatgatttggtgattctgagatttcagtaaaaatgttttgtattgatgttttgatggttatgtttggtgtttctcagattgtggcctcgattagagacagcaataaaggtagaagcaagattggtttttatatgcattacattttaatataataaatgtgttcaatggttacctccaccacagggtttggaacactgagaccagctcttcaaagcccactcaaaagtatctaattcttcctggatgacattgttgctgttgattgtaggtacagagtcttcatggatgatgtacttatatgtcaggctagagcgggtatcattttcttgaggtataatctaacatacacatgaaatcaatatgtaaatcacctgagggttttaaattttgagtgtaaaattacaaatatttcagaatattgctcttattaaaactgaaaactttcaaatagtttcaaaaattataatgtttttatttctataaaccatagtgcaaatgtgccctgtttaagaaaaagatgaagtatctataaaacttttaacataaaagtgttaaaaaatacatacactgaggagtaagagtttgtattataaaaataataactttataaggttcactgtaggtttccttaaattatatcatctcctttttaaaggattttaacttttaagtgtaaagaattataattaaaattaaaggattaaaatttttaaattaaaatttttaaatttttaaattttttgaatttttaaatttaaaaattttggtgcattttaaaattgtcttcaacggaaattgttgtgttgtgatgataaagatagtaatgttccctccagaaaatatatacattatggaaaaatagaaagaaaacgaaaaatcataattctacctaactagagaaaaccagtcacttttattattgtgatagtccctcaagatatttgcattctgtgtgtgtgtgtgtgtgtgtgtgtgtgtgtgtgtgtgtgtgtgtgtacagacatatttactttcctggctttgtttatttcatgtaacatgcacatttctcaaaatattctttgaaaacatgcttttggagtgtggaatgatggtcattggagactcagaggggtcagagggaatggaaggagggctgaatgatgggaacttgcttggtgggtacaatgtgcattgctccagtgatggatgcactgaaggccctgactttaccacaatgcaagatatcaatgtagctaaattgcacttgtacaaaaaaaagttaaaaaaagaaaatatacttttaaatgtcagcatagtctgtaatcctaaaattgttatgtattattgttaataagtgtgtggtaactcttcaatatttgttttcattagaaattttcccaacctttgtggggatttctggcgtttcttagtagactgaagggaacaaacactttttataattctagttcttctgatagactggtgaatggtcctccggaacagttagaacaattgttactttaataatgagagtgtatgaaagtggccatttgacactacatgttacataattttcacctttattaattggatgggaaaaatatcatgattttagttgttatttatttgataactaataaagtttaattttcctaagtttattactcacatattttaaacactgtacattgcatgactgtcctggtttttattggaactgtacacattttttctctcctaatctgtgcactaaagatatgaattcctttttgtaatatgagttgcaaatattttctcagtttgtctcttgccttttaattttgttcagggcaaagctgcctttaaaaaaattgattttcatgtagctttcataggattttactgattatgcaaagagagaaatgtgcaattcattggtattccaaactaaatttttagaactaccttttgtttgagaaatgaggtgatactaaaatcagtgggggtagaggatctggttatctggcttttattctcttttttctgtctttttttttaaaacagcattaaaaatcaagcaccattcgaacaacccttacactctagccagatatctaattctctttgccccagacagcctagccaccatgttccaggactcagaatggaaaagcaatgtcataatgatagaacattgcttgtctacaccctcatctcctagctacaaatctccctcttgtacctccagcccacaccacttgctgtggtcagattataatcagtgggcaagtcttgaagcatctatcatgatggttaagcatcaggtctctaaagccagatactcatgttgctagaaaagaatacaatgtaattatatcagcatgaaatacagcttctggcctccaatcattcatatttaaaataagctaaataaaactttgattaacatatattttattatggaacaggatgagagtctagaatagacccacataaatgtggataattaattttgacacaattgaaaggcattttaataaaggacagacttctaacaaatagtgctaaaacaactggacattgtgatggtttaagaaatgtagatacattaggtaaaaaaggactgagaattccgtctcggtttcactgtcccatgttctcgctcacttgagtcacttgctgtagtggaagtcagtgccatattgtgaggatgtataagcatcctatggagaggcttaagtggtaaagaatcatggactgctacccaccacatggaaaagctggggaacaatcatctgaggcctttcagcaccatgtgactaagcttggaagcagagtaacccccagtcaagctgagatgactctagccacagttgacagcaaactcatcagatactctatgccagaactagccagttaagtggtgtccagatacatgttccacagaaactataagtattgcttgtgttcagccactaagtttgagggtaatttgttttacaacaatagataactaatatagacatccatatgcaaaaataaggacctaacacttcatacaaaattaaccccaagtgatacatatacctaaatgtaaaatgtataactctaaaacagttaccaaaaaaagtaggagaaaatgttttgatgctggattagacaaaaaaaaatttcataacaccaaaatctttatccacaaaagaaaacattaaaaaattggacttcgataaagctaaaagattttgctctatgaaagaaactactaaaagaatgaaaagacaacctatggactggaataaaacatttgcaaatcatgtatttcacagaggacttgaatatacaaagagctctcgaaactcaacaaaaagaaaatataacaactttaacaatgggcaaaagatttgaacagatatttcaaaatggaactaattttcagagaagaaaaaccctaaaaattgagtggagcaatttgacttaagtataatattttataggaaatccaataaataaaaattctgtataaaacagaaactaacaataaatttcaaatcaagtagctgtcttctgctttcatccatgagggagtaatggagttgccgtcttgatattaaaagctataaaactgggcaaaatatttgcagaaactttttttttttgtttggcaatgtatgtcatgacaaaggacaccaatccttgtaagaagagaaacaagccagatcttattcctgacaagggccaggttctggacctggagctagattagagtttggaactttcagagccggccactaaagaggggcctgcttagagagatcacctagaaatctacatgggtccatgactgagggttggtctgtgtatgctcaagccaagacaccaggcagtccacagtgggagtgctgggggtgggacagtgataccagaaaccaggcagggctgagcctggcaccatgaaaggccacaccatgggaagaaggacaacactgaaatagactagctgtaaggaagaataaaactaggccttaaaggatcagaatgatctgacaataacttaaccgcctgccagaacaaaaccagacaccttacaatttatcttccaaaatgtcgagtgtacaagaaaaaaagaagcaggaaatgtgatccataaaaaaaattgacaatgtgaagacccagaacttaaagggtaacttagatgtaatgagtgaacattatgaaaaattcagccgaaaaatggaaataaaaaaaaaaaaagaaccaaatggaaattctataaaagaaaagtgcaccatcggatacgaaaaatttactggataggctcaaggacagattggagatcacctaagagaaatagtgacttagagctcaaaaggaataatccgatctgaaaaatgtattttaaaaaagattataaaggatgaacagagcctgagacttgtagaacaatttcaactgatttaagtgagtcctaggagtgaagaagagaaagatggggtgggggtgagggtttgggaaaaacaactaactagaacacatcatgggaaatttacccaaatttggtcaaaaacatcaacctacaaagccaagattctcagtgaaccccaagcataagacatacaaagaacacggtaaactgagtatatcacagtcaaactgctaaaccaacaagacaaaacaaaaagatgaagagaaaaatcttaaaaagcagccagagaaaactgacacattacatgcagtgcagcaatataaatgaggcttctcttcataaatgatggattctggaaggcaagtgctgtataaatgagtaaaagagggctcctgtatattggcccctaggttctttcttcacagcaggctgaggctgagatctgttagctcaaaagccctctgatgccaaacacaaacttttatacatccagttgtttttaacgctgcccaaatgagggagttttagccattcagggactgcttgctttgcacagctctaggaaactacatccaacatctgctagatatgaataagaccttctggctataaggacctcacgcagctgcctcccttggagccctctgacccacagactctcttctgtgctgctgaatgacaccacctaggcacataaaccacctcagattcccctctttctcagaagttcccttgcccttctctcctctaggtagtggccccacttgcaaaccagctgaggcctagcccaaataaagtgtgtgtgtgctactgccaccttgtggccatatatttttctttgatcagcccccaaacccttggaactcgctgcaagatcataaaaacacagtgctgaaagaagggaaaacagggaataaaaaaccaaaaaactagcaactcaaattctatatctagtaaagatatccttcaaaaatgagggtgaaataaagatattttcagatcattgacagatgagagaattacttgccaatacacccacaccacaagaaatgctgaagatctttatattgaaggtaaatgatactagatggaacgtcagatgtacaaagtagaatgaaaagcatacaaaatggtaaatatgtgggtaaatacaaaaatctacttttagtgttgtctttaaaagatgataactgattatttaagtcaaaaatcagaatgctgcattattcagtttataatgtctatataataaattacatgaaaatattgcacaaagagtggggggaaagataaatggaattattttaaaaagcaactcatgtttcaaagttcaaagtacacttaatgttcaaggtaaaagtgttttcagataaattaattataaagtaagctgagctaactataccatgagcccataatgccacataccaaaacaataacaggatcatgtaaaggtccatcggtgtgaagactttcaatgtcatcttcaatgttataatcccactccacaccaagatctatgaaggtccgcgacttggcttcctcccctttgccatttaaaatataatggcctgtagcctggttcttaatagctaaagggagaaaaatgagtaaccagcatacattttattttatcatattaagtgctgaagattcacagcaagtatatcctttctacaaatcaatgaccatgtttctttattagtagcaaggaatcaaaatgggtgttagttctgatattatttccattgtcttgattaggcattcaaaactctcaagaagcattcctaactagtcaaaaatacagcaagatggttaaataggcaaaaataatgtttgcaaatattcccatttgaaaacatcgtcaaagaggttaatagtttctaaatcatttatcctatatatttccttagaaaactgggaatatcttgaaaatgatagctaccttttcaataattaatagaaacaatttatgctaggatagcatataatgtaacggttaattattgcatatattttttaaagttggtcaaaatatttatagtcatccaacatagttgaagtaatttttcaggcaacaatttagttctcatgattgtaaaattccagagccatatcacctactcatatagttagaaaaagctgcttactgctaatggaattcttaatgtagtatatatttattacatattatacaatgaaataaaatgctggcttaatgagtaaaaaataatgaatgggattttaaattttagatttgtttatcagcatataatgttacattagaaagcaaaatttcatgttactacaattattgaaaatgtgtgaaaaacatgagtaattttaattaaatgtatttattcctcttgggctttaaactggtctattttttccaaggacattaatatgaattctaggatgaaaaataagggattttaaatgcttgagagagaactatagctgactgctagactattacgacatttagtagtgaatataaattaaatgtgtttaaaaattctatgaaacaccataaaacaatgcactttttaaagtcacaactgaaataaaacaatttgctacaaattttcatggagttgatacgtgatgtcttagcttcagaaattatcttagtgttcttataggccaaggaataagtaagttatgtttacacttgtctatacaatttaaatgtaaacctctttaaagtgacatttccatgtaatcgtctcataaaagaaaaaaaaatcttcttgtggaaattataatcagctctccgtggcaaatggatctgcatgtgccagtcaaaaacctgacacatgtcagatattagaataatttaagattagattagtaaaattcacctgtggttgcttttcaaagaatgtgaaatacaataaaaataaggatacgtacagtattggatcaatcaaaatatcagaacttatttgtaaacataagtatgatgaatttttctgatattccttgatttagtggattttattaacatatttattttcttattccttagagcaaaaagtgtataagaaatataagcttgtcaaatgatttttccctcatatagttaggaaccaaccccagtttctatacaaaattaaagctctactttttttatgtttcttgttttaaagtaagcatagttgggagaaatgaccaaaaaaaacctacataacattcaattaatgcatttatatattattttgattcttacatatacgtatgcacatgtatgtacatatacatatgcacatgtacacacatatacacatgcacatgtacgcacatatacgcatgcacatcatgcacatgtacgcacatatacgtatgcacatgtacgtacatatacgtatgcacatgtatgtacatatacgtatgcacatatatgtgtacatatatacatatctatatttaggatttctttgacatttcaatgtttcagtgcatgttaaagcagagacagcagacagaaacacttaccaagaatatgaggagaagcctcgtcttcttggattaacacatgtctagccccagggggtatatcaaacatcttaaggtaccctttgcatgtgtagtaaatattgtaggaagcaaagaagaaaacaaaagcaacaaccatggttagttgagcactacattcttactgcttctgcgtgcagaagagggcatccataaatttaaagaagcagtttcggaaattaacttcaaagcattggtagcttttgtgacatccaacatgaaattagaggcaacttttttttttattaaagagggaaaaaagttaatcttgttaccaacgtattagtcacttatcttgcgttgaccttcaaatgatgtgaacaacaattcaggcaaatactatactttcctgtgtccctctgtgtgattctagttttctaaaccatccttttgaagtggagtcaatttttagtgaaagttcacttaagttgtaaactttttgggatatgttatctgcttacatgttattttaaaagtctaagagggaagtatagacagctaaacttctaattattaaaatattttcatatttaaagccttctttattctaaaggagttacaacagaaaaatcagtgctttcatttttcttgtgatcagtattaattttaaagctttaggcaagttttatgatgggactattttaaccaaatcgacaacatggattttaaaccacttagttggaaaatgtgtgcaagatgtgttatgcattgcctttatatgcaccctaacctcaaaacctcctaagccagaaataagaaaatcaatatgcttaataggttgctttgtgttttaaaatcatatatcattcctattactgtaaatgtcatatatcacatactatgttgatactatcacatgtcctaaaaattatcttacaatcatttagaattaagattatgaccataaatcataaatattatgacctgacaatagtcaggtcaattagaacagatgttatacatctcattatcatacaaataaatgaatataaaatgattatgtaacctacaccttcaatacattatgaaacatccaatacatattctatggagaatattaacagaaatccagttatcaatccacaattattgatgaaataagaaaaaacaagtgtttttgtcatttgtatatgtataataatatacacctatgaatagatttacctaagtttttcacaatatttattagtgtcctaactaaataaagtggtccttttgggatcagggtgttcagcactttagcctggggtaaagtctaacacatgaaatgtaccatgtttgcctgagtacacagtggctaaaaggaacatgcttaagatgccaagtacagcaaaacagcttgatgccatttatggatgcccatctttctgcagtttgctacaacttacccagtacgtttttagcttctcttgtttcagcaagagaaatattacgagctcctttgggtaaagtgaaagcgcctcttgtcttcccttaaatagaatgtctttaattagtggagggttcatgtttatcaaagtcttgttgtttcattgactatcccataagtcacatattttattaggcaagttataaaatatgttctgtaagtttatgtgttgaagtcacaatgcatttgtaatagataatgccaataaactgttaatagtcaatgaaagtaagactaagcatgaaagtaagactaagtagatgatttgaagttgaatacttgcagatttcattttccagcaacttcaattctttatggcacctcttgcttaaatgttttcctgttggaaaaggttaattagtctattaaatcactatgatgacaatattagtgcaaagatatggaagttagattatctttgaacagtttgaattggtatgacagatgaaaattttctaatgttcttttggccttgatttgcaagtttagcatgatgtttgaactctctgaaaaacagtaccaataccttatattatacataatatacaatgaatgaacatggcaaaaccttttctttacattattcactgtggaaataaaacaaaatgaattattttacatccaaaagaaaagaataaaatgtaactccaagaaagcacagtatattatttcacagcaagatgaagaaaattacatttgactccactgaaatataatacacgtatataattatatttctctttgctttaataatgcaatcagtcagaaatagcaatatttgctttttaacaattttcaaagtacaaaacatggtaatttataacacaggaatagcaaagacatcagtaacaagaaaaacattagaatatagtctcctagtaattgagttaggtatcaggggtataatgggaataaaaaatacaaaaactaagagaattatttcatttggatgaagactaacttttttataaaaggaaaagttaccccaatgacaatttacttaacgtaaaccatatttctttgtttttgttttactttcatgattttataagataccaacggctctttggaagacatcaaaatcttcttgagcaaacaccacatcaaatttatctttaagtgctgaattcccagaaacatttgccaaataaatccttattgaataactgaatagtatctgatacaaactcaagaaattattcagtaataaatgtctgtatacaaatcttttatgaaaattccaatgaatattattaaactatggataattttgcctattatttgatgcatgaagacagctttttgttccacctttgaaccttcagtgtatgtctaagttcaagttattgactatgtaacaagcataaacatttatagagatgagcaattacatctcaggttagtttttggttgtacctcaattttgtttaaagtaaatttttaaaaattatgtgaaatacagatccaagattcctagatttataaacaggataaaattgttcacttttaaaataagtaaaactaatgtgatattttaaaagttgtatctaaaattttgtaatttttaaactcctgatcaataatttatatgcaacaagaattcaaaataaacaccaattctaataattcaatctgcattttattaaaaatgcaaaataaaacacagattttagctagctagtataactgatactgattttacttgtttcttttctaaatttagtatgtatttttttcatcattgacgctagggagtatgaattcattcaaagtgatttcttttttttttttaagttccttaaaaggtaatctgaataacaataaatcagcagctaaattttgattatgtttatagagaaaatgctgcatttctaaaggaagaagcctcaaaaagtacaaatcacagagaagaatactaaatccatgagagacctcatcttaccaagcttcctgggagttctggtaaatgtccccttcacggttcggcagtgggaattatctcctccacagacaccacacttatcctcaaccttattagaaccaatttctttatcacagcccactttctggagagagaagatgtcaaatgtggctaattttagtgtgcccagtagtggtcaacatcccagagaatgatgaaccctttgttcagtcatggcccacagtcagccaatttatagcaaactgccactgtagtcataatttttaatacctcagttttttaaaaaaaataatgggaaaccaaatgacttgtaccctaagtaataaagaatatatttcctccagtccaatgaaatatttacaccattttaaattgtcatagtcatcaaacacacatgtaatgaaaacagatgtagctgatgctgaggagacaagaaaacaacaagacagtgcttttcccttgctgctctcacatttatgatgatggataatatagtgagttgtatattagtgcaatctttaaaagatggttatgatgtgagacaaaacttcaccagggtggtgaagattttcacaggggccaaagaaacacagaatagaaaagcatttcaggaaagcagatgagttacaacaaagccagagaagtatgttcatggaaagtgggtgcagaggtcaatatctaaacccatatttaaaccaatggaaggttagtgtttcatgataaggaaagaacagtgaaaaatctgcattgaatagactgcagaagacttgaataccaggaagaatttacattttcccttgaaacaggaaaatattgaaggttttctgaaccaaggcatgttcttaatgtaaatcactgtagaataatgatacacaatacactactgcactcaaaagtatgggatgaaaggtggcagggaaaataaagacaacacatacgtttaatgtactaggtactgcggcaggtaaaagctgaacaacacatactatgctttcaggaaaatgtaagctcaattactttagactcattaatacagcacttcagttttgatgaagtataaaggaaatatatgttaggagcagtgtttcagttaataagataatttcatatcgatttaactatgaacacaagaaataaaatgcatttttaacctgagattaaatggagcaaaaaaacatgtttgcttctctactacttttgttctaatgtgaaatttagcctttaaacttagaattgattggaaggtgagaaagaaatgtcttattatctttacaacaaaagattaaatatacttagcactgattatttttaaaaagaccttgtattttaatagcagatggctactaaaatacccgaagcaaatgcattattaccaatttgtattcccaacctagaggcctcagagttactcagaaaaggcatttggctggaaattaggaaaattatttaaaccttgattctgccagtgaccaaagtttgatttgagaaagtacaatgtctctcaaatttattttagctattgaactattcatagacacttactataatgtgatttcaaagataaaatagtttaaaaaattaaaaatgtgcagatgaatgacagtaaacgtagataacgtagaaagcctttggggaagcaatttgaacttaccacacactctcctcgcacacatatgctatatggatctttgtaagaacagtgcgttccatcatgcaccagttgtttcatgtaagcaacatctccagtctccttggactgacagtaaaggtggcatcttttcttggctgcataagatggaggataaaattaactatttacataaaatggaatgtttgaacagcatagtttattttatttttaaatataaggtttcactgtgatttcctgaaaacaaaaggaataccgtataaacaaataaaataaggagtaaggaggaaagtatgtacatttgacattttttttttagctaaggtgaccataaaatttgtcatctaaactagaaaaggggttctagtaataactgagcaggaacaacaggtataaactgggactgccccaggcaaccctagatttcaacatagctcttaaataaatcttaattcaaaaccagtttagttttcgtaatattagagcactgaaagaatgtctgtgatttgactcaatcatctaacatagtttttgcctcttacaggatgcaactcacttcaccaaaatagataaaaacaatgcatttcttcttaatgcattgcaactttgaattcttaacgtgtattcctctttcctttaacatggatttgaactgaacccagtggtgcatgtaatcatataactatttcctttcattcactcaaataagaagtatggcaaaaagttgccattggacatatttaaccaaaaattcagaagtaagaagtgaaacattaaaagaaaatttccaaatatatctttaaactatagtaaaaaagtaaaaggttataaggtatcttttgttattaaattatgatctttctcttggtcctgactcaattttcaaagaactatatttttctctagttcagaaaggaaagatcacaatattccagaagtatttcctagtagagggatttcggttgaatcaggaattccaacatctctcccaggcgttcctttccactggtcttttcaccgctgatggtgatagtgctgcttgccaggaactattgcaccattcttacctctttagagaaagggtatttaagccttattcttagaaacccaggagaacttactcctataagcaccaagtttcctaagttaccacatagggatcaagagtccatggggttcgtgctggcaaagcttaaactgtgagtaaccatccacacagcaggaaggagagcacgaggctactcacggtcaggatgttcatatggcaaccagtggtgtttggtattctggtattcaaagtgggagtttcgctgctgacactgctgtgctctgaagtcctcaaagtgtttttggcattcttctgtgttacaaagctggtactcaaaattaacaccaggacaatcctgaccaccattgatgggcctaaagaaaagacaacatttaaaaaggccttttggcttctgtctagcagttgaagcttgcagacacagtgcttgagggcacaaagccaaagtttctgggctgccagcacaaagtgaatgaactcatacttcctaatttcagtccctttccaaagcacccttctctccctgctgggtggaaaaataaaacaaaacacaaagctcaacttaaatcagcttttcaaatcatatattttaaatgcatggcaaaagtgtgtaagaaaaaaaaagcatgtatattgaatcaataaaatgatattttgctaccatgtataaaacacacagatgcagctcaaagaaactttggtcatcgctccatggctcggttccctcatatgtaaaatgcaaataataatgtatcttcctttgaggaaaactgtgaagattaaatgagttgacattatttaaagcactcctaacaactctggctcataatgaactttagctgatcttttaatttttattgtctttgttacttctaataccaccatcatctcttactgggaaggcaggtatgtggcatcagatagtcttacaaaagacgtgctcagagacatcctgctgccagaaacagagagaaaaagctgctcacatattaaaccctagacaaggcagaatcctctaaatgtgagaattcagttgtttttttcttcgtaaagattgctgagcacacaatagggaattcagtaattgtagtctgagtgaatgaatagataactttcccccaacagtcacctggccttctatcacaatctttcttttgccttcctctgaagcaatcacattccactccctgaagagagagagtctgtatgcttggtaccgctctttcctggacactctcttgtttctggcagtcaatctcgcagtgcccatgcccacgcccttagggcacagtgacctactttccttgttcagcttcttaatattcctgaacagcaacttctttaaaaatattcaatcttcgtttgatcttcttcatcactgactgcttgtcacaagattaataaatggagatgtatcaaaaacacagactggtttatgaactgtgaacaatttattttcctgccctgtgttttacatgcactttataaaacagaatactaataacataatattgaagtattttctggtctctccaaaaataacaagagttacaaggatatactcacatgggattattgcactggcgtgttctgaaacgaacaccagttccacatgtccgagaacaggagccaaatttagtccatgacccccaattgccatcttgtttttgctgattagcattcttccacatgcaatgacccttatagcaccacttagaaaaatgacaaaaggtaattattaaaatcacgcatacactaaagctgaagttgttatacaagaaccatctagttgaagggctttcttactgctcttttttcttccaggtggagatgcatttaaaattatccaaaagcaattatgtcattaatataccctattaaagggtaatttagacttgtatttttcaagtagaaaattaaaatggaaaaacaacattcactcagacaagtttttaaatgatacattcaccagtaagcatcaaacactataatcaataagaactctttgagcacccagcttgcacagttggtaagattttacccttcatctgtcactacctatatcataccagaatattttgagggctacatgatctttttaaaaatgataaaataaactatgtcttggtttagataataatataacatgtctaaaacatatgcagctttcaaagcacttttatttaacttttaaaatgtttcattaacaatgattctgagagatagatgggtcatacatatatcatcaacaattagatgaggaaaattgaggcccagaaaggttcataagtagttgaaggccatctgaccaagaagtaattaagtggggctaccagaaccctaatactatagaggcacctagcttacagtgcctggcatggtgctcaagagacattagccattttcctctctaacattttgacttactttttcacactacgtacaataaaagcatttgttaaaactcaacttctataaatttcaatataacaccaatatatttaagaaagttgaatgttaaaaagttaattatataattttttataaagcaaaaatgaattaactcgttatactcttgtttttagtcagaagtttatgatattgaattttcccaaagcaaaacattgtatacaaggtgctttgcatagtgcctaatataatgcaaacacttaaaaagacaggttttattattattatgcatataatccctgtcacaagtacagtttatacacatttgaaattgagctttaaaagaagtaaatgccatataaatcttctgtaccaggttttggtcctgcctacaatttcttatttctaaactagtcaaagcttttcaacttgagttcttaacatgcctttgttttgggatctttgcccttatgagtagcatagcttggcactcagccaatttctgagcattcaatcctgactacacaatttgagatttaaaacctctgggcatccttccctaaggaacaaggccaaatcttctgtataagttcacatgactttatttctgggcaactttcacaaggaatggcatgccagcaagtcaatcagatcccactaccagggggcagatagtctgctgagttgcttcttcctattctgccaacagtgggctgaatggtagtcccaaagatatcaagtcttaatccccggaacctgtaaatgttaccttatttggaaaaagggtctttgcaaatgtgattaacttaaatattttaaaatggagagattatcccagattatccatggggtcctaaatgctgttacatgtatccttataagagaggggtagaaggagatttgacccataaagatgaggaaaacgcaatgtggccacagaagcagaaactggagtggtgcagccacaaatcaagaaatgtggggtggccaccagatgctgggagaagcaaagaaaagattctccactacagcctttggagggagaatggccctgcccacacactgatttcagttcattgaaattgatttttgacttctggcctctagaactgtgagggaataaatatccattgtttcaagccaacaagtttgtgaaaatttgttaccttagccacagggaactagtacactattttagtacattactttaataaagccttgcatactatggttttcataaaaatgacagtgcagctgtgtttaccattttccagacctttaaagatgataattatgcaacatatcttacatatttattgtgtaaatagatatactcacttttccagcagcacattcagtcccatcaagtggaggtccctttttagtcttacaaaagtagggattatcaggatggctacaccacagctgtttacatgggtcaaaggttcggaactggaagatagataatcaaattgtcagtgaactctcagctagcatgacatgcaccaaaaatatattctatacagtttcttctgtcctgtttcttggatgtgtttatttcaagttaatagccaatgttttgacatgttgaaaaaaaactgcataagaatttcaggtagaaaatacttttattctgcttttctaaaataacaatgataaacaatgatttgtctgagattatctggttgacttttaaggtttttgcttgctgtttttatgttttgtttttcaaatagacaatgttgaaattttctaaagacttagtaattatcatgaatattgtaaatatgaaaatataatggtttggcagctctcaagctatcaaaatgtcttttctttatctctgtaggtatcagatagatagttgaatataaataataaaagggctgggcacagtggctcatgcctgtaatcccagcactttgggaggctgagatgggtggatcacctgaggtcaggagttcaagaccagcctggtcaacatagtgaaaccctgtctctactaaaaacacaaaaaaattggccaggcatgttggtgcatgcctctaattccagctacttgggaggctgaggcaggagaatcgctggaacccaggatgtggaggttgcagtgagccgagatcaagccactgtaccctccagcctgagtgacaacagtgagacactatctcaaaataataataataataataataatcataaatacttataattaattgactaaaagcagaaaaaaattgtcaaactttctgtgtaagataaagtattctaggtacaacaaaatatcataatacattcatatagtttatgaaatattttccatatatttgattctcataccaatccattgctgagaaatatgggttacaagttagggctatagttatggttataagtaagacagcaacagcacaagactagagtcttggttttcatactcttcagaatggtttttattttctgaacacaccacattataatatccaaatgtttgtataagcaaacatgtgtatttgtgtgttctctttgcttgtttgctctttttctctctaaatgtaaacatcttaccaatcattatatttttaaaaatatcaaacaacagctaatccacatatctattgcctatactgctaattacctacatacacccttatgtgcatagaaatttttttattagtacacatttttagatgtgggttttttgttctaatccttattatcgaatgtggaaattccacttttccatgacattaagccaaagctttagaattctctgatttaaaacattaatgcaagtaattaggagctcacagtgtataccttatagacagaccaaatggttgtatatggaaggtttcaaacagcagatcaatttctttctagccccatgaaacacttacgttccttgctctaacacccaaagcttgctccaacatagaaaaaggccttcttttttttttttttttaatgaattactaaagaccaatgtggaaatttaatgaaatatacatctaatgtgaatagttacaggcaagactggctttaatggattccatttaacatatatacgtgcctttcttgtgctaagcactttaattatattatcaaatttaatcctcacaccaatcttatcagatacatactatcattatccacatattacacatgagaaagtagtccagagagattaaatacggtgcccaagtttatatatttaaaaagcatcagctgggcacagtggctcacgcctgtaatcccagaactttgggaggccaaggcgggcagatcacaaggtcaaggagtttgagactagcctggccaatatggtaaaaccccgtctctactaaaaatacaaaaaaattagctggcggtggtggtgcatgcctgtaatcccagctactcgggaggctgaggcgggagaattgcttgaactcaggaggcggaggttgcagtgagctgagattgcaccactgcactccagcctgggcgacagagtgagactccgtctcaaaaaaaaaaaaaagaaagcgttagatccaggacctgacccactgtcctgacccccatggtatgccatatgattcttttactagactataccagcacaatccttccctatggtcacacatacatggaatcctgccatcaagctaaagaaaagcaataaatctaaggcttaacagtcatcttctctgaaggtcacaaaaagcaggggatgcaaagaacatgaagatttgagcctggcagccttggtttcaaagtccagttcccctgtttaccagctgtgtgccttaagcaagttgcttaatctctaagtcttggctttatcttctgtaaaataaaagtacatcagctctctgctagtctgtcatgagaattaattaagacaatatatttaaagcatttagctgtagcacacagcaacacaatgaacacaaaataactgctagatattattatacttgcaccagtgagtctgtaaatctcaccaagcaggagctacacaaatagatttcgagctgcaaaatctacatcaactgtgagcaacataccgcggtgcacattttatagccaacaccaaaatcaaaacgacattgctcatccatagaataattgattccaggaagttctgggagtttaggccaatcatgatcaaaagggtcatcaaggagacagtcataggaactgtaggaagaaaaatattgcatgtagttaaatgttcacttaaaaaaatcatgtcctgatttaaaaaaaagtagtcttagcttatatactttagaatttcatcccagatcatacagcaaatttgcaaaaacatgtatttaaggttttggttttggttccatttagaaaaagactctttacctgtattcatgccaggaaagtaaaccaagcatgacttaggaatgtagtagagccacgattatttgagtcactaattaaaccaccacatggtgtggtagggcacatcctgacacctatactgtagagcacagctcgtatcatatgcagaaaccacatgaccatcctccccccatcctcaagtttgaccattaatcaaagattcgataacaatttactaaaggaaaattacattacagttaaaagtttacttatattctagacttatggcttcaagtattgtgactccatgataaaatttttgtgctgaatgttctaagtcataagaaaatgtttatcagtaatagttttcatttactgggaattttgctatgatcaagtcctaagagtcagtttcatgtctgtaggctataaaataaatactttcatgacatgcagcaggggacatactggatatatcttttcagttcttgaccactgcatcgggaccagtggtaacgatggaatgctgcttgtaccaagggagccatgacacttcccatagcagtctcatcaccacacctgttgccttgtccatcatgctccattcccaacctagaacacaaagagacctcagtggtaagaatcaggggctactgccttcacttaattttggttttgaaaataagccctgggaaataacgtatttttgagtcaacgtggctttcttgaagaagtcacagaaacggaaattgacagcaatctgacagaaatgcctttcttattctatagctctgaaaaccacaggagtgcctctgcaagccagtcactcatttagtttccgtgcatgacctcttctctgtttgcagctcttcacacttggcaaaagacaagaattgtatgctggcatgcattctgcccaaagaggaaacaatactgggagaagcaggaaagaaaagatctttttttggctttatagctgtcagcagtgacttacacatggcccgtttcatgggctactacaaaagcagatgaaaaaccatcctcatgattcagggtacaacttctcactggatgacacatgccggtgactggagcatatcctgtagagaataacaattacttttattttcattttatgagaaaacccattaagaattacaactggacttttgcctagggggaaaaaagtaaaagcctttcaggaaacaggggtagcattatttccctactagcattgtgtcacattctcttgggaaagccacaggtaatgttctctaaaaaggttcactgggtctgcattttctcctttcctaagggaaggaatggcctggggttaccattttcttctgcccaccagctaagccctgcctttctgttttagtaaatggtccttcatatcgtggtactgatgaaggaagccagaaattccatcaatgttaaaaagaaaatcatcagtctccttcttccaaagtccacatcagaatttattagataaatgtaagctgactttggaagaaagctctttggcagcagtcatttctcatggcatctcttttctcattccaaacagttagtggaaatcacactgcattttacagcaccccctccatgccccaaatgcacaatcactattttaaaagcaagtataatttacgatggtatttaagtggcatttaacattgagaactccacataagtcactgtaagcaaaagaaagaaaatgtatgcttggccggtgtgtggtggaaagcagtggtggagagcagaacatttgaacagactgcctgatttaggattactttttaaaagtcatgccctcaagtatttcttctacatattgacagcaataccttgcattccagcaggtccaaagtcttgcctggttaaaaaaattgcatggtcatggtgttcagagtggttgagatcagatctttgctgttgggacgcccagcgacacacattctccaagcttctggatgggtttcccctttctatgaggctgatggactaagtgaaaacaatatgttaaagacacacctgacaatttcccaaaggcttcgtttgataatttcctctgaagctgaatttgggattaaagtatttaaacaatgattcaataatatttggggcttattctgatatttgctttgatttgtgacttctaaatgcccatgaaggatattttaataataatcaattttacctgtgtgaaagtcaaatgataccatttatgagaatggttttgttatatttgagacagaatctcacaattttacctgtgggaaagtcaaattataccatttatgagaatggttttgttttgtttgagacagaatctcactctctcacccaggctgaagtgcagtggcaccatctggactcactgcaacctctgcctctcgggttcaagcaattctcatgcctcagcctcctgagtagctgggattacaggcgcccaccaccattcctggctttttttttgtttttttttgtatttttagtagagatggggtttcaccatgttggccaggctggtcacaaactcctgacctcaaatgatcttcctgcctcagcctcccaaagcatgggaatgtttgatactgagatttgctattgtgaggcaacttaacattaatcatttaggtaataattttagtagtctaaataatttctgatttggcttagatttcagtttcatagaattaagaacaaaaacattgagaaagattctggcatgtttttccagagatgtgaaggtataaaatcttagttaagatttttgtttattttttacgatccagaattaatcaacatgtggggagaatatgaattcttccatgagttgacaaggctgatgaaatcttagtctatggagaaccatcaaattatattaactttacactaaaaaacaaaaacaaaaactcccattttttttttaacttcatgctactgaagaggggtggactcttccagttctgatataagaaaataagttctttgaatgttgctaccatcacattagggtcaggagttaaaagttcaggggggaaaagggcccaaccttcaagaactcactagccacacttctcagagtagttctgatgaaatgaaaatttgaacttggaaccaaaaattagtccctatttgactgacaggcgaattttgttatagttcagcaaatgttattaccagtgtttacattcttaataaaatcagtttccttttttaatatacggatcacatacttttccaaacaaatgctttaacaaccaattggaggctgttatttccagctggagttaattcatattccttgttggcaatataaaatagattgatgacactctatcattataaaatgataagtggatgttaactgtataatgaaatgcaaacacatggatttttcctatttcctaaatgtacaacttcgttaatatttcataatcaggaggattaactatgggagagagatgtgtaattttaaacatcaagaaagttgtcaggctagtcgtttcctgtatgtttcctccttaaaggagctaaactcaattatattacatgaaatgcctactatgtgcatttttatccaactctttgcttttgaaaaaattaaagctcttttaaatgaaaaatattcactctgcaccttcctcttaagtggaaagatatatgtatataaaatattgtttttagcgaatcaagagaagacaaagatctttgtcttttttcttcattatatattccaagcacctagaaaatgtctggcacttagtaggcattcaatataatcccttctaatgaataaatgaaacacacactcgatgataacaataggctaaggaaattctctctcctcataatagtatccattcatttccattcataagtcacacctaaagtcagggtaattatctacctctttagacagaaataaataagcaagtggcagctgcacaaaaatcattcataatctgctcaaatttggaagtctccactcatgtggcagtttcttctcctcaatttcaagcaactaggggtttatatggaatatatctatgccttaagttagatgtagcttgaacaatttagtcttctatttgctaacccagtccctaatgtttataattcatgttttaagacattttacctttgcatatcccagcattatcatgcgcaccaggaccacatttatatgcactccgagggactcatcatggtaaatttcattcacctagcaacaaaaaaagataattgctaaaagaaaggaaacaccgaggatttcatgagatgtacatataagctgtgtaatcaccacaaataggtgagtaaattgctgtttttaaattgagtttaatagctgaactctgaaaggtagtcatttacttttagctttggtacaatgtgtggatatgtaaattgctaattttgtaaactccacagtaatatgaacgtacaggacatgctcaaaagggctttgttatactagtgcagtgttagaaggagtctatgtgtgatgtaatccaaatataacattagccaaaagcaaccacaggagggtaactttggcaaatcatctgctagcctgtgagttgcctgcaaccacagtaaaggaaaacagcaagcatttgcttactggggtgcctgtgtgacaaccaggggtgctacgtctggttgagagagccaatggctatggggtctgtgtgcaggagctgtggtagtgtatctgagggccagctagcaggtggggcaggtgaggcaatgactgcttgaaagtcctacaagatagaaatcctccaatatttaagttactaaggagactgtacgagtacctgtcagatgaatgtcagccctggatgcaactcagaagagcaaatttgagtcactgctttttatttaattttaaaaaattaggctgaaatttctaaaagtgacttggtatactttaaaatcatagatgttggaataagtgcaacctcagaggtcatagtccaattctgttttatacagatgaagaaaataaagcctgtagaaattatctgacatgcaaaacacagagtgagctactggcagatatgaatctgaagtggactgtaactgtatcttctcattaacctagtgcaaaattagtgcaaataaaaaatgctagcaggaaggagaaaggtggagttaccaggctagaatgcaaagttcttagaatgaagactcgacacttgttaaaaagactaaaagagggatgaaaaactaactgcaactcagcttcagatccaggagatttgaacagtagacacagcaacctgaaagctgcacagaaaagacaggcataatctcatagcgagtggctttaaaaataaatataactcaagaatgattgaagaatgctctaaaacaagaaattcacaaatcatagtattttgatttgccacactaaccaagaaaaagaccaagaagtctcaattgaattgtttcaagaatccaacgtgactgcacagaacacctttaaaaaaatcagggtcttgaatgtagactgaaagcatacttactgaatttgtagaagtcacaaacaagaaaagaacagcaaaggtggaagtaaaaaatctggctaagctagaatatactagagataacaaagtataacttgaaaagatgtgaagtccttttaagtggaaaaatgcatgtatacacacatacatttatacatatatacacatgcacatgcacacacacatgtactcacatacatagaatggtaagacccaatttaatacctgtacgagataagccaagctgtgaaaaaaaatctgcaatacaatcttggattgcataagtgtgcaggcagatagctcatgcacaagttgtcccactctaggctacagaaaacctgaagtattgagtgcatttttctgggctgtcttatgacagaggtgcttgacaaaacatgaatatatcctgagaagagctaacagcaaggaggccagaaaatgtgtcttataaagaagggttggggatacataatggttaaaagcctgaatgtcacacattaatagtctcagataaatcctggttcaacccctcactgcttgtgagacctttatttttctgagtctcaataaaatggacataataaaaataatatctcatagggttagggtgagaattaagagagttaactcatgcaaacaaatcgctaaaaaattttataagtgagagggaggaaagggttttttaaggatattagagtatgagaaatggaaaagaaaaacaagaattaatagccttcatatggaaaaggggtttgattcattgtatatatctatagaaaataaaacttaaaaccattcacattattaaaggggtaaatttcagctcaatataaagaaaaagtcaatgttagacaaaaagctgttgtttcttatgggctttttagtcatgggctgattctcttatcttatgccacacttcatgctgcctagttgaaaagtgaatcaaatcttccaccctcctgttctggattcattatctgataacatattcctaactttatagttgcaataaaagttaaaagtcaacaaccaggcctgtcaccaacacattcattcagagactcatgtctatcccaagaggcttcttgtaaggcagctgtttcaaattagaaacatggctttgcacaccaagttataacatgtatttagttcaatgaagttgagatgtaaaatgcactttgtgttaaaataaggttgaaagcaatgttagtaaataaaactagataacaataaaacaaaactaaagaaacggaaacagaaaaagtgaattaatttctggagaaggagaagtaaggaagagtaggaggcacttacagccaatgcatataacagtgacagctatactgtaacatatgtaatacatcaatgctataggaagctcctacaacagaaagtcttagaataataaaatgaaggaaagatgggaataatgacaaatagcttgtgatatttgagttagtataaaatgcacatataatcatcctaaattagtaaattcatttgtacttagtgaattataaaattaacacagtgtcaagaaagtacaatggacaaaattattaatctcaatagcaaataggatattataaaatgaataaaagagcatttttaaaattcagatttaccattcaccaaaataaaagtattacttaacaaaagtcactattatgccaggctaattagaaaacagggtgacccagtagaaaccaaaatcagtttaagaatgttctgagtcagcacacattttgagattcacaaagtatacataaattattataggtagaaataatctaatacaagggaataatatttttgcatagcacaaagtattatttcaatgtggcaaataaccagctgtctgtactgtacaaagcactgtatcttattattttgattttcaaggcttaaaaaagttcctccatattattcacttccaaaatatacttaataatttgactgcttttcatcttgccaggccctatcaattcctgagatgtagtgtttttatattgtgaaacacatggagtatgataagagctggagaaataatatggcaccatattattagatattcaaaaccctgggttctgttcccagtttggccacggataaactgagtgaccttcggttggtcatttaacctgagtctcgattttcttgttgacaaactctacttttacttgctttgtctgtttcacagtgttgttgctcaaaacaagcaagatcatacaactatactcggcaaaatacaaagtacttgagctcctatcccccatccatgcacaaagtttaaaaaaaaaattgtgagtgtattttcataatctacctgaaaagttcaagaaaaacaattgccttaatcacagtttttactgaaagggacctcaagattcttctatttgaaatttgttaaatctcaatctcaatgaaacatctagtttaaattatcaataaaattactgggaaaaatcatttaaaagctatttccagcagatggcagtatgcatgcttcagaggggcaaaggacaagctgcttcatacacctgaatgtgcttacataccagtcagtatgtcaatgttttcctatatttacacataaatgaaacaatctccttgaaattaaataagaattgtaaaatattataacctgagaaaaatgctacgttttaaatgcttactcatttgactcttaaaagcaaagaaaaatattgaaaaaaatcattatttagactttttaaaatgtcatctgattacaaaattacataggcataaggaaattctcatgatctggctgtttttaacactcaaataatatagagaaagaactaaaaggatatcatactaaattaacaatttgaatctgtcaagatgggctaaattcttattaggaaattcttaataattctaaataattcttatttattaagaaagtaattttacaacttttagtgaaaaggaaagtaatttttctgaagtaaaagcaaaatcaacaaaaaagaacagctaataatacagagagcttatcagcttccagacactgcattaaacactttacctatattgattcaactaatccttgaaataactttagagatattaactccattttacaagtgcaaaagctcaacatatattagagagctcagaatcctatagaggacagatgttctcattgcccagagaagttaagtaacttgcccaagtacaattagtacacgagcaagggatgaaaattagcagtctgacttcagggtcatagctatacccattttgctgtagttccacagatctgcaggccacaatgctgtcgttatacataggatgtggttttaaaatcatcaatagtgattctcaacctttgagtttaagaatatagtgtggaaacatattgagaaagaaaatgtaaaatttgcagcttcttttcataatcttctttaggtaaattttaagaaaatgaggagcgaggctctaaactgaatataaataaggatttattgatgatcagtataacagtattccagaaaatattgagaagaaataaagaggagctagagaagaaaaattaaataagaaaagaaataaagggtgaaatgtataaccagtgtttggggttgcaagaaaagcagtaagcataaacattctaagtgacgtatttgacactgcataatgcaaaccaaagtacatctacaaaaaaacactgagtatcttttcaccatgtgagccaacctattggaccatgggtagattttctgtgaggtgttcagggttgagcctagagtctttattaaattacctgaaagaaggggtaaacagaacattaattcaattttcagatgacctgatgttggaagagtttgtcaatgatgtgagggaggaaaaggtaaaatcaaatcaagtattcctttccttgaaatgaaaattccttccaggtttgttcccggacaggacaaattctcccaggacatttcgctggcaggacaatctgacctgctttgtctgactagctgatgaacagctttgtctggcttcaacaaagcaacactcattttttgttcagatgggtggatcaggtcttgagaggctggatagcttagcagtggagagcatgagctctgcgtcagactgcctggattcaatcttagttgtgtgatgctgggcatgttatttgtctctgtgcctcagtttcctcacctgtaaactgggataattacagtattatcctcataggattgttgaaaggaataaatgagttcatataggtacagtacttgatgcttggcccttgcaaatataaaaaaaaattagcagtaattactgctattattcatatagaagcaaataaacaccacatatatacaaaatttttttaaagagacttttgtataactgaaagtaaacaagtatcaacaagatagcctgagtgattctggctagatataaaagaatactgaaatggactgagaaaagtattactctgtccacaactatctcttacgtaggtaaaagttccaaactcatacctgcttgtattctcagccccatactcagtattccttttcctcagaaaacagaggtgtctcccaatctgccaactcttccctcatctccattctcatattaataataactactgtttagtgatatactcttatcaactatttattgaacagtggctatgtgcccaaatgttctgggggtggagaatggaatagtcaatacctttgagtctctgttcttatgaagcatagactctattgggcaaaacagcctataagcatgaaaaaaaatgaatgcaaaaagacatgcgggcaatgtcatttgaaatgggaataggtgtaataaagaaaacaaatatatgagtgacaagatagaggaggacaagaggagttaaggattgggtactatttgagattgggtagttaggaaagggagaaccatggacaggaaggaataattgtgtgactgtttagggaaaaagcaatctaggcaaagggaagagcaagtgcgaaagctcaacatatattagagaactcagaatcctatagagaacagacattgtcattgctactttataaagagactgagaccaagagaggacacacagtgttttcctcaaatgattagcaaagctatcaagtctatatgatatcagtgcttgttctcttttcgcaaataccttgctctatgttgtgttttgttgttgttgctgttgttgctgttttgtcatgatggaagccctgagtctctagacagtcactccaaaaatcccctccatgctgctggtttaatcgcttccttcctaggaattacttttcttctcttagtaacattctcaactttctttcatgaaaaaaaaaaaaacgatctacgatgttctgtgggatctggtactgtttaccattatattcttcaatgtcactattctgtttctttagcaagattagctctacagctctactttctctgcctaacctttacatgtcagtgttgctcaaggtttgtttgtttgtttgttttttgactgttctcctgatacatgtttcccctgcaatattctcttcactgctgttgcttcaaccagtatctataggctgatgaattccaaagtttggtttttttgtttgtttgttttgagatggagtttcactcttgttgcccaggctggagtacaatggcatcatctcggctcactgcaacctctgcctcctgggttcaagcaattcttctgcctcagcctcccgagaagctgggattacaggtgcacaccaccacacctggctaatttttgtatttttggtagtcatggggtttcaccatgttggccaggctggtctcgaactcctgacctcaggtaacccacccacctcggcctcccaaagtgctgggattgcaggcatgaatgagccaccatgcctggccccaaacttttatgtatctaacagtgattcatctctctcatgtgtgagggccatctgttcaactctactaacaggactatctatttggaagtatacctggatacctcacagcacacccatcttctctctaaaacctgtttttcttttctaaatattttatcccagttacagactaaatcatccttgattccttcttcttcaagtattagagtcattctactaccaagtaccgcagacatctgtcaaacctgtccacctccacaccaagcagcttagtaaaccaaccagctcatgcagactgttgcaataacttgtgaaaacttttgcaaatattttgtatttaggtgatttgggcacatttgagtagctctccagaaaggaagattgtaagggttgatggttgttttcaataaacatgagtctttccttttatgtgaattatgtcttacttcatttaagtatcaaaggagctttggaaagcccaagaataggcagtcagctgtgaggtcctacaaactcttgtgtcctttgtaacaatggacacatagcaaaagcccaggtagaactgtttacctttcctcaagattgagaaagatggttcgcacaggaatctataaactttttctgtgttttacaacctgggaaaatacaaaggttgtaacaaagtaaggaaggataaggtcagtctgatatctgtaacttaagaaagaagaaagtgtgaatttcacgaagggaatttggggctgcaaaagcaaagggggaaaggaagaggcaactgagacgcttcagtaaaaatcgaagggacctcttagtcagcaatactgtgtggatgttgtgttacgttaaggtaacatgtgatgtggggactcgcttctagagtgataggtcaggatattcctgggaaggtgagtatgtttttataaaaggtggctgaatcgacttgtgcttgatgcaatctgtctctgtgatctggtatgttcaatccacattggggaaattaagatagcttgttgaggtagggaagtatagtgtacacaacaaggagtttggacccagacagacactatgaacttagaaactatgtgttcatgttcatagcatagtgtgtaacagagtctctctcctccaaataattctaataatgcatctctttctaaaacacggactgatcaagtcactaatcttaaaaaccctttatgactcttgtttgacaagatgaaattcaaactacttagtatggcacttattattttctaaagttagccccagcttctctttccagtctcctcatctgccatctcccctaaatacctttcaattttaccatgcagaccaatctagagtgtctccaaagactccataaattaatacttctagtatcttgttacaagctgttccccatcttccaagacctatctcccctttttctagcaggaaaatgccagttgagttgaaaaagtccaactcaaatgacatgtcgtcttaggaagatttcactggccactggcattatttgccaaaccatatcctctctttttcaattcatgtttacatagtactttgcaactgaatcccttgaagattaatatattttatagatctctatcacattttattattatcatttgttgattggtttattttacctgctacaattagctccttgtagaaaggtgctatgttttattaatttttgtctcccaagaatctaacaggactttgcctatggtaggttatgtatgctaggtgaataaatgcctagaggattgatgtgaattcaaatgtaagaaacggattatagataatgactcaaaacagaaaactgctacatgatatgctaaggttgcatgaatatgtatactttccagataaatctgcattgcactcacattcaatgttttcaaaaaagttaaaaaatcaaaagcagtgtattgatataaccatcgttaagtaaccagtaaccacatatatttgctgctaactcttgaataagtccattaatactttttaaggaccagggtacggctgtggagtttatattttctttacaaatattggttagggaagcctgccctgttcagataacacatttatgctcgttcactgtccatcataagtagctaatttcaatatacaaagaaactgatgaattcactcaataatttataatttcgtagaagtccaagactgtttctttgtactgggaggcattcttttaaatgaactgctttcttatcatttaataaatcctgagattaaggcataaattctatttacagggccctaaaaatgttaaggcacattagacccagaagaccatttcatagatcttagcaaataaaaaaagatacctttgacctgtcacagacagcagagtgttgctgatggaaaatatttggtacattgaacgaaaacaacctaccatcttaaccataaaaatctgcctcatcagcctgttagaatcttaaactagattgctaactagtttgattcaatcaggtaactaactgaattctcatttcaatgacttgaatcgtacaaacaagacacagaaacagataaaggaaagacatcagagttttatctagcaagagatatataaaatgcctcaactttgtaatgagaggcagtgaagtttggggaggaagagcttaaggctcagaaggcagatatagatctgggctcaggtcctgactctgccatactaactgtctgaccctgggaacatcacctaacttctttcagcttcaatctcttcatttgtaaactgggactaaggctgaatgcatcttagagttggaaagtattaaataatgtacataaagtatttatcagagattcaggcgcaaagagctaaaatgttagtagtgtaagccttcactattaacattaaatcttcattttgaatctagacccaaaactagatgatttcaaataccttcaaagatttcatcaacaaccttaattctccataatctgtttttttattgaccaactcatctacataaatggtaccattaacaaacagaatgttcaagctaaaaaaacgtataaattatggtagattcatctctttccctcagcccatggattcaatagcaaatcctactgattttaccataaactatctattattactgcaatcctcattgtctaataaagcatcctctcttgcctagacatttatacccactttccagtagggtctgtcttcattgtccctaggcctcttcaatttttctttacaaggccgagagaagcaggaaccgaccctcagtggcttttattttgtacttaatactgcatttaagctcctcctatgacctgaaagatgcttgccttcttctcctagctctgcctgactccttacacactaaatttgagccacaatgaccttttagttactaaaacgcatgcccttattaaatggctggatcttttactttaagtctcaatttaataatcaattcctgaaagaaggttttcttttttgttgttttgttgttgttgtttgtttgtttgcttgctttttttttttttttttttgagacggagtcttgctctgttgcctaggctggagtgcagtggcgcgatctaggctcactgcaagctctgcctccagggtttacttacaccattgtcctgcctcagcctcctgagtagctgggactacaggcacctgccaccacgcctggctaaatttttgtatttttagtagagacggggtttcaccgtgttagccaggatggtctcaatttcatgacctcgtgatctgcccgcctaggcctcccaaagtgctgggattacaggagaaagaaggttttcttaatcatcatgtctatgtataacctctatcacccatttgctctgttattctctttcccagaaaactgtcagttccttgcatagttcttatgtaacctatgatgtaattatttgatttctccaccagtctataatctcgctgaggtcaggaaataagcttattttatgttaaccaccatatacctggcatatagcattaaaatacttattaaaagactgaatcgatcaaatttttattgcatgtctaccacacggcagacacttttggatataattatgaggcttaataatatacagtaactgcactcaaggaacaatcaacctattagaggactgctcctgttgaggtttgggttgataattatggaccaggtcaggaaattaaaaattttaaaactctactctcttgaagcttggtggaggattcaggccagctccaagagggtcaacaatttttatcatgcttattggaatattgccaatacctaaaataggccttgcacatggcagacgatgggtcagtatttatagtatgagacatgccccagagctgagaaccactttcccagtaaatcaaccatgttacaagttagtaaaactataaacatttcttgatataacaagatatgatatggaatcctaagaaaggcttaacatatatgacaaatctcttatttgaaacattaaaaccttggatatgttcatatccatgtgtttcttcttcatataggaagcttggtgaaatgtcaagatctacaaaatagaaagaggttaaaaaaagcagatgaaagacatctgattattctccccattgcttcacaaaggagtggggatgagtagagggtatccttcctttcttaggaagttatatcgaaatcatctagggtctgctcaaacttgttcacttgacccttaagccccagagaaaagtgttaacttagttaaccaaaaatagattatggagaattaaggttagtgatgaaatctttgaaggtatttgaaatcatctggttttgagtctagattcaaaataaagacttaatgttaacagtgaaggcttatactactaatattttagctctttgtgcctgaatctctgataagtactttacataaattatttaatttatgcatccaaacacccagatttgcatggcaacacctacagaattttaccgcattcatacgcacagtcattactatcgttaggaaatacggccctgaaatagattaaatatatttgtatccaaaaggtggacaacttgcatggctaatttaaaacaacagataaaccaaagggatttaatattactagtgacatataacagtaaatactgtgtgttaagtgttctcattacacttaaattatgattgagttaaaattaaaaacaacttaaacgttctaagccagtttctcctcccagtaacactgtctttttttaatgattagctttaccaccttatcattacttgagactgttttatgaactgtaaataattttttaaaatttacctaaatttcattaacattttcaaagtctctgtttcctttggaaaaattgtaataatttccatcttgcaatatagttggaaagaatatatgatacccaataataattgttaatttatttcttaaacactgctcccattatatcattgcatttggcatctatttcctcttgttttgagtccaaaatttctgacttcctcccaagattgttcgtgatctacctctacattatttatattcatttgttcttctttcattaaatatacatttaacacttaatatacgagctcttttcaataaaggaaagcatgacataagaaatataagcttctctttaaaagggaatcccatttaaattaaggcgatactctgaagcaaattacttggacctaaaggtattcccttaattcagaaactatcatctcagttctgatatggaaatgaaattgacaaccaggtaaatggaagagcacatctgctgagcagtcaaccaaggcaaagttgaccaacaattttaaaggacagcatgatcttctctctaccatagggacacctttcacactaatcaatgcaaaaagatagaattttttgctgttagctttcttctacagtttctctccaggaccctatctgacatttcatctaagtctctgtgtctatgtaggcctcaagcctggtgagccataattttagatgaccatgagaaatcataaagcatggccagcaaaggagatagttatttgaacatcgttagagaaaaactgaatgttcctggtcttgaatttccatgaggtagcttcattacagtatcgttggtttctctttctgcttctcattctcatttgatgatgaattggaggaaaaggaaagagcctgctcaggtcagtattttgggtctaacaggctacaacagggcagagggtatggaggagaaggaagacttaagtcttctgtctgtcttgcctaaagttgtctgcctgactccagggggaaaacctgaaattatccagttggagagtgatgagggttgggaataagactaatttagaacaaggtttctaaatctcagcatcgttgacattttgggccagataattaaaaattctatgctgtgtagggctgtctgttgcgctgtaggatgctgagcagcatcccaggcctctgtcgctattagcagtagcatccccctccacccccgccccacccaccagtgttaacaataaaaaaagtctacagacattgccatatgtccctgggaactgacgtggacacaaattatcctcagttgagaaccactgatttagaataatgaaaaccttgtgactatacacttaagtatatgcaattgtatgtgcaattcaggtctcatcaataataaaactatttcattcttcatctgtgtgatttccatgtctatctttcagttggtcatgaagttggggagggaaggggaggagtgttattcttacctctccaaatctcttacctgtattaattacttaaaatgcaactaatatattaagtattaaaaaattattttctctcccatagctccattctctgatactctatttactttagaataatttgtatttgagacagagtcatagtctattatctaatttttttaatggacttaagaacaaaagtcctcttgactgtttttaaaacataaaatgcatcactttgttattcctttgacactctcaaaatcatacttactacttactgtctggtgaatatactgtatccattcctacatagaagtcctttacattttcacatgtccttcaaaaaacacaaacaaggcaaacaaaaaaacaacaggaaatctctaaaagcagtttaactcctaacttcttgatgaattacataactaataaacttgttgaatctttcaattttgtaatgatgaaaactaagtcctagaaagggacatgatttgtctaaggtcacaaagccaactagtagtatgactaaaactaaagccttaccctcctaagtcccaatttaatacttttatcacttcatgattggataactatggtcacatctccattttctaaagtgttatagcatttatgatatactgcctataatatggcttaataatagcatgacttttattgtttacgttttttccttctaattttcccatgtatttattttttctcctctaatagttataagttctacgaggacaagaccatatcaaaatctctattgcattactccaaaagccttcttattaggcacatttgcaagccaaataagtctgtactgattgtcttccagatagtagaaaaaaagtagcccagggacataatgaatgacgtaagaataacatctccataggaagtttgaaattttagataacttatgaagtaaaatttggcatagagaaactaaaatatgattgtctatttgtgcatctgtatatggcactgtaaataatggatgacttgtatttacacacttcatcctctcaacatccctattatttttctcaatatgccgataaagagacagaagcaggacagagagtccaagaagcatgccaaagttacataactagcaaaaagttaatagtcaaaaggttaatatgaaaagttcatagtcaagagttgaaaacattcatatgattcacaaatgatgatcctctgaacacatctattgccaaggctagtaatttgttttctgtgtgttgtttggtcttcataacagaaattagtgccaagaacaaataaaaatgtgtttgaatttctgtactcattttccatttcacagagatatggtataagtgtaattttataaattgctatctcaatagaccaaaatataattaacagatattagcataaacaaaatcatgtttcatgaaactaagaatttttctccttcactatcattgcttgaaatctaatcttaagcatgggggaaagaggtaaactatagatatccaagaaattatattaaatatcaaaagttgtgaggggggagggtgggttgagagatagggaaataaaacagcataggcttaggtaataaatttgcaagatcaatataatatatatttcatattggcatgaggtaacatatatagagtacatcaaaatctcaattatcttttagaagtaggtggtttacgtattattatttctcctcagttgttctctgccaatttaaaaagaaagaacacaagtttcaggatattgacaaaatttcttctgaatctgattaaggttcataaaagagaaataaagataaatttaaagagaccattagtggttgctgtgcagcaccgtgccaatagttgtatgctttgtattaataaatatattaccttcagtcttataatgttgaaaaaaatcacatttgttcaaaagctgtaataacaagaatccacagagttaccaggcataaatcattctatatcatcctgtgaagcagagtgattctagaaagaactatttcatccttcataggcaacatgaaagcagatggacaaagtcctgcgagttttgattatccccagaacaaaataaaaattacaattcatgttttaattccatctcattatggctttttaaatttatgattcccccttgacaacaacggaaaactacttgatcaaccaaaagaaactttcgcttcatgcttcctttattttagcattcctgtactttaaatatgtagatcaataatttaaatttaatgccatcatgcacatattttggcacagtcatggaagttctcacacagattgccaaagggtaccaacaaataagagaagtgaattaaaagatcaaaaagctttaaaaaggagtcactactcacaatgttcattagggtcaggaggtagttttggacgtgctctttgccatggaaacggaccacagagtcatccactcccagcagtacctcgatattgtaatcgttttctcccgcgtgtctgcggcgtctcattgtttcattcagctgctggtggatgttgccataaacagtacctagatcatcaaggccttccaggtccgactctaataagagacaaaaggaaccaggaatttcagtttccctaacaggccttccaatcacttcttagaaaaaaagaatcttctcaggggcctatcagtatcattcataatcactgagatgttgcttttcagtttattccttaaataatacgcatatgcatacgatcagacagacctgctacaaattgaacatagaagagcaacactgaaggtaaaatcatattattatacagggagcggtgccatcatggcagaaggactattctgtaaggatagaagtggttcagtttttctcccagcaaagagtcaaggcagtgggggtacagaatacaggctggctatgtagttattaaataaattgagattacaaataaaaataactccagtatgtttacaatgattaagttcctgtagccatggagtatagaatttgtgtcacataaatttaaattgctcctctttccagtaaccttaatttaaaaattaaattatagcagggcaacacaacagcatctagtgatatgattatcagtcactatgtattgctttatttcttctgagtaaagttttctagtgaatgctgccagcgaagaagtggatatacagggtatatactatatacataagtgtgtgtgtgtgtgtgtgtgtatgtgtatgtgtgtgtggataagatagtatataatatacaggttatatattatatatatatgccaataaaatatacatatatgtgtatatgcagggatacacaggaaaactttagtgctccacatttgcactggccatcatttggatggcaagtcatttcagttgctatatatctaaacctgagatatcaaagtaagaagtcagtcagaaaataacttttattcaaagaaaaataaaagtaaaaataatttcttatttaatgcagttcaagaaacttacatttttttactttccaaatgaacatttcatacacacatacacacacatatacatacaacatacctatatacatggaaagaaagaagaagagagacaccatcaggttttaattacctaagttatctgttttcagatgactatattttttgagaaaaaaagttttagtgaattaaaaaataaaatctatcatttggattaaaattagagagtattcaaaactgctggtacataaaaaccaaaaatattttcatctccatttcaagtatatagaactcagaaaggattttattttataagctgccttgatgtctaaaacaaccgtatatgtaaaaacaagtttgacagaaccagctctgactcatgctttatatgatggtttatttcatgctgcactggggcttgttagccatttgagtcagcatctgacattaataaataggtattgtcctctccacctttgtggctttaataaaattaagactgggaaaaataggtgtcttttggctgggaaggttgatgaccaagccctagccaaaaaggattagaagtagtgaaagtacagatcctgctcacactttttctacctttaaaaaatatatagaaacaccaataccctcccttacaagtagggggacatggtctgaatgtgactactcaggtttaaaagctctactttaattcactttgacctaagcccaactgctagctcattagctgggaaaattctcctcaccaaggaattacattggctccacaatatataaataactctcaccatcatccacatcaaacagaaagctttcctcaaaagttttcaagagctgcaaaccctcactgaggttaagagacgactacacctgcaaatagctttaccattcaacctcaagtctttttcacacacttagaatgtgaaaggctgtgatagctagtgtacaaatataggaaattcagacatgagctctcaattctaaaaatggctcctgttggcagaatgctcagagaaaacgtccaatggaaatataccagcaatgttattatatcatgaagcttgatgtgtgaatgaagtaggctgaatacttatttcagagaggcagttcattctgctttaacacacctttggtttggcctttgcaagcctctttaaataggtagttttctggtaaggaaacagaatctctctttttattgcataagaaacctgggaaagaagaaggaagcctttgaaaatcaagaataatttgtccctactttcctccatgctgggcagtgttctttccatgtttcctaaaatgcacaatatcaaatatttcaaagaaagacagtaggatagcttctggcactttttacttatactcatcattataattacagactgctctgaggctgtgaaataccttcattcataatgaatttgtcttagtaaaactgcaaaattatggcaaagctatgacaataagagaaattgacatagttgactccatcttgcttctcacctccaagctgttcttggttatttctgggcataggccaaactaactttgagaggagtttattttatagtttaaccttaaagcaaggatgatcatagcccttcccacaactaaactgcctttgtaaaactaatgaaaggccactaggttaggattatgaatgaggtttgaattcttttaagacacaggcataataaaatgatgaaccgctattgttccagaggtcacaagattggaaatttccccaattacttttttttttttttttttttttaagacagagtctcactctgtcacccaggctggagtgcagtggtgtgatataggctcactgcaacctctgcctccccggttcaagtgattcttgtgcctcaacctcccgagtagctgggattacaggcacacaccaccatgcccagctaattttttttctttttgtatttttagtagagacggggtttcaccacattggccaggctggtctcaaactcctgacctcagcgatctgcctgcctcagcctcccaaagtgctgggattataggcgtgagccaccacacctggccccaattacttctgtagatagcatcactattgtggaatctaagattgatcttttgagatattttttagcctgtgcattctgacaaccgactgaccccaaccaaatgcatgactcatgactcagctggtactgtggccccaccaagaggtggacttagcatatgacgatcattttccaacacctattgaagtggcatcgttgtctggggtaaagacccaaggtttgtcatcttgcaccaaggaaattcagtatgcagacacacacaagaagtgggtttaggaacagaggtttaacaggcaaaagaagaaaaaggagaacagctctctctcctgtgagagagaagggcacccagatggggcttccagcccccagcagagtacactggattttatggacaggctggaggtagtaatgtctgatttacataagggcccacagattagttggaccaggtgtaacagttacatagcatgctgggaagctggccatcccaccctaatcttattattcaaatgggctttccacctggccagtgccatgttgtctcatccttactgtacatgtggctggcaaagagaagggaagatggagctgccatgttggacatgcctagcccccaggtaccccctttcctattggcacaactgccagcattcacctagcaagtttctagcttgcctttctatgtctgccgctcaattttacaggctgttctttgttagaaaagaaaatgatttggggctgcttttcatgaaaagaaacatgttaccaaaaacttccctaccctcactacccacctagataatttcttctttactcctatatcaccatgatcgtgtctcccaacaatcagcagcacccattaaggaatgtgtcccctgcctgccaaaatatctttgaaaaacaacctttgagcctttagggagacggatttgagtaataactccacttgccatgtggcttcaatggtgctagctgagttgggcagcagagagtgatttatgtgacaacagaattagcagaaaaaaaggaaaatccaggttacagagagctttctaacaggtgtgttctcaactgatcattcaaaaggaaaaaaaaggccctgcaaaaggtagagcagtgttattaatctcatgcatcattccaaaaaggtgatgctcacagtgccttttaagcttctcagaaatatcaaagtcaatcccctcttagttcttagagtgagttttcttttttaaaactttttaggaaaatgtacgtttttgaaggttaccttaggaattactgatgtgcattaattaatattttggaaacattttaattgtatccttttgtgcaccccctagtttcccaattactgtataggaatttgcagaagtgatcattttactataaggcctattttatcagaatgaatttttgagaggcatataggtgttcaatcaagtcaaaataaatacagttatttttagtgttaagtataagattatcagtatcaaatcagaattttgaacttactaaacagataaagtagaatataactttctttgctgattatggacactaaggcttgaaatatttttaggagaatgacatgttcatatgcttaatcatacttataggaaatcaaagtataggattagtgaaattgctccctaccccagaaaaaaatttctatggtctgaaaaaggacaggagacgaaggtaaaattggaaaggtacaagttctgaatctaatacaaatacatttggggttggaatgcaattataagcatactgtgatagagcctgtgataaaaccatctacccaatattcattctctcttccctaaggagcagaatgttaattttatttgaaataataataaacccagcaaaaagtcactcccaatctccctgtgactaagggttacatgtgactaagtataagccaatgagatctaagcagaagtattgcttatatcttgatggcttatgactcctcaaaggaagacaattcattccagtaggtgcacacccctttggccctccactcaatcacccaatattcctttctgctgcctagaatgtggacatgatgtcagcagttctatggggtgatcctaggataaagggacatgctgaatagaggagagtctgacactttaaaggagtgtgactccccagtgactgtagactcaccataccagccctggattacctaaaaacaaacttcattacatatgagaggtaacacttccatcatgtttaggtcacccatctaatgagttttttcttgtatgccactgaatctagtcctaaaatacatgacactcagaaattttaattttgttgactaggttctcccagtactctttactccctatgagaatgcaagccaattttcatgtgaataagtgaagaataaaatacgattcatgttaccaaaatgtatcatagtagcattctctgtagtgcatcatttcagaaaatgagaaagcatcatattgttttacagtaacaatgaatacagaatgaggctatatgtaaaaatcttgccttcttcatgaacagaatactgttatgaaatgaagtaactggaatactacaggctggattttccaagagtaggtggagatcctataatcagagctaaaaataagtgtaaattccaacaaatgtcatctattaacatcagaagcagagagcagttaacttaaataattgtgttaacctgtttgtatcatccaatagtgatttttaattgacatctttttaaaaaaatttaaagttatcacttcctaaaaggatacagtaacagcatctccacatatgtggaggcactattctaccaagatataaaatgtttccgtgaaaaggagctctatccttcacaaactgagaaattccataatgatagttcaaagaactatattcaggtcaagttatgatgtcaattcaaaagtttcactaagtacctgttgcttttattttttaaagacataaccattgagtgaatgtcagtttccgttatttcttttccccaaaagttctaattctaacatccgtgtgtttgcttttgtttttactgactactttatggaataacatgacattttttagatgggaaacttcttaccttttaaggaaaaaaatgttttaatgctttgggtttgtgattattagcaaatgaaattttaaaatcagtttaatatccaaaatatgaactctgactggcagtaaaaaacttctatgtcagcgagaatgtttctaactgcaaatcaagaaaacttagtgtcttcagcaataagtaaacatactagttcacgtaacaagagttccagaggtatggtgattcctggttaatccatcaataggtcatcaaggattcagttcttttcatctttccatatcctgccattcttggtgtacaaactttgccttcaaattagctcctttgattatttcaaaatggttacaccaattctagcatcaaagccatgtccaacagattgtgtcttcctgcattactttcttaggaacaggtaaaaacctttcctagaaactctctggtaacatttaactccatgtttcagtggccagaattgaatcacaggggcttgaaataaaagagaaggaaacgaatgttgtacaggttacccaccttgctgaaatctttttcagatcttcctcttccctcatcccttagtaacagccttccactggtatcttttatacctagttttcaataatgcatttcatgtttaatttcttctattataatttgtctagagataacttctgcattctcttggcctcaatattttttgaaagagatagtccttcatttccatagtagtggattctcataattgttgctcattcagtcccattgcaaccatttaatttgatttcatttcagtggtttattgctgaaacatttgggtgtgggcaaggttgtcagataaaataaagtattttttgttaaattaaaatataagataaacaacagtatttttactagagatatctcacagatattgcatgagacatatttaatactaaaaacctactcgttgttatagctgagattcaaaatcaaatgaaaatgctatagttttatttgctaaatccagcgactctaggtgtgggggaattatcttttgccaggcagtacatgcagttacacgaacttacaccctcttcatctcacttttctcctctacacttccatcttcagctctagcagtgcacattcacctggcatggccaagtagcatatgccatttccttgactccagtacttggttaatagatgttcaaatggcttaaattatgctaatgaaattgtgaactaggacattttaatttggagctactaggaaagaaaagttctcattattaagctggaaactggaggaatataacaatgtaggtgtttacggctagtatgagaatagttgttggtctaagtttaatgctagaagaggaaagtggagactactaatagagaatagactacactccaatgatgagtatgagcctgtgaattcacccactaatttctgaaaacttggtcttttcagtttcacaaaccaataaactaccaccacctcattttcttattttactgctttttttttttttttccatttgctaagacagtttgatgtaagttcccgacaggcaggtgaagctaagagcagcctgataaataagcccatttataccctttctctgctacagtcatcaatagtcttcattttccttctcattcttcttctgtagtcaactattcttaggctacacagtgctctgaaaaagactacatattctgttttatttcccaatttgtttattttattctctcggttctattttaaatgaataatgttgttactagtgatttgtttcttaatttcttttattctttttcagctaaatcataactaattttgggagacagcacagtttttaattttcacattttactgctctaaacatttaatagcattttcattaacatttctcttcctcttgactaaattatatattttcttatttatggcttttgtagttcagctctactaaatcaaggaggtaatagaagagtagaggaagaggtcaccacacccaattactagattacattctagtaatcttagactgctagaaattaaggttttctaaataaggtcaactacatagaagagaggtgagattccttttcacagctgccgtttcaaagctcatgttacttccctcactttccacctatatgcaactttagtaaggatagaaaagctcttcacctcaaacttctccagaaactctacatttgcattctaaatcactccaatatggaatgattaataaaaatgtaaataagtcattatagccaaatgactaatatgttaatattaatattaacacttgccatttattctgtgagataaatatttaaaggctctgaacaccactttatgtcacactgctctaagcactgggaatccagcaatggacgagacaaacatgttgcttaccctcatagaacttacatcccagtgataagaactatcaactagggtaagaagagtaaaacaggaggaagggagtaagagggacaaggcgagggaggcaaaattttagataaggttctcaaaagaaggcagcaaatgggctgagatcttgcaaagtgatggagtaagccacacaaatatcaaagttatatttgactcagatatatgtaaactttttatgagcatattcatatttatattacagatttttcagaaagaggttgtatgatataatacaaagaaaatcagaataggctcaggaatgcagcaagccgactttctaaaatggccccactaagatgccctgccctagtcccaagaacctgtgcctttgatgaggtatcattcctacgattatgttatgttatatggtacaattgaccataagatagaaacattatccaggtgggcctgatctaacttcatgagacattaaaagcagagagctttatctggctgttggcagaagggaaagtcagaaataatgaagcaggaggaagtttgatgtaccattgctggctctggagatggatggattctgctcctggacaggagagaggtatctagttgctgacagtgaaccacagccaacagccagcaaggaaatgaggatctcagcttgcaaaaacaaggacctgaattctgccaacaacctgaatgagcctggaaatggactatttcccagatccttcagataagacttcaatctggcccacaccttgattttggccttgtgataaattaagcaaagaaccagtccagccaccttagacttctgacctatagactgtgagctaataaataggcattgttttaagctattaaattaggggtgatttattacacagtaatggaacagaaaatgataaaaagagaactgagttctagttccagctctactatgatgcaactctatgattttgagaaagaagctaaacttatctgagcttcagtttcctgaaataaataggctgagctagctgatcactaacatgttctttctggctaaatttccataattaataattaggccacaatttcactaaattattaaagatggttattattgttatggctgtttgatcatacatgattgatcatacttataaatttgatgctaaatccttcgtcaaggatacaaccatcgttaaaacatttttacatgaaaaaaatgtgctacactaagagaatctatattatgatataaaatacttcataacaatataaaagtctagtaacttatcacaataagagataatctgaccattctcccatttaacgagcacagtgtccataaagtctggagacattggcagttatacacaattttccaagaataccttaaatctcttctctaaaaaataaaatgttgcctattttttttcagattttataaacaacctcggttgtctaaaaggtaacacttagacattttttaagtattatgtattcacagtacagatcagaattttatcctgattaaaaatttacttcatatctctttgttatgatgcaataaaattttgttaacatatgtatgctacttgcaataaaattttactgaagaagagttccaaacatggaattaaaatgtatgttattatcgcatcaaattattgaagaagcggtcattctacatttttaaaaatctaaagtgcttttgcttatttgaataatactgatcaaacagttttgattcacgttctgattggtcagtttttatatcatacacagttaacatatttaagccacagtaattattgcagatttaagatagatctatgacagaacaacgtttgctatctaatattattaatggaatactataattcctagtccacaaataatattattcaagttaaatttaataacaaaccttttttgcattcaaacaaaattgttgagccattcctaaagtgatttctgctaaagacacttatttgccaatataaaactattcttagtctaaggaataaaatatgccagaagagagaaacactgttactacattttactacataactgtgtgcctgtaatatattctctgaaatagtatcgaccatatggatggaaaataatgggcatttttatatcttctatgttttctaagatgtataaactatagatttaatgattgctttaatatttgtctttgctaattctaacatattttgtcagttctgtgttggtttggacagatttatttttctcatcattatgggttgcattttctggcttctctgcgtagtcagtaagtttagatgggaggtctgacattgtgaattttacccttttggctgctggatatagttgtattcctataaatattcttgaactttgttcttggatgcagttaaattacttgacaagtttgttcctttcgggtcttgcttgtaagatttattaggtggggtcagaacagtgcccatctacagctaatgactgaccaccactgaggccagacccgtctgtctaccctccactgtgatgtgaatcatgagatattgcagtctggcttgtggaaacaagcactattcccagccccatataagcaccaggcactgttacctctgattttttttaggtggctctttgtcaggcttcatgtagtttcctcacatatatatgcgatgatccggactcagctgaataccagagggggacctctgcagatctttagagttgtatctctgtatggctcttctcccattctcagtcctgtgagctctggccaccttcctctctccaggctctcagctctggcttctcaactctgggaatttgttaggctccacctgggttccccttccctgggattcatctggaaaccctcaagacaataagctggggcaatcctgaggctcacctcatatgtttctcatctctcaggatcactgtcattcactgcctgatagccaacgtcttgcagactgttgtttcagacattttgtccatttctggttgtttaaagcaagagagtaaatgcagtctctcttattctatcttgatcaggagcagcagttcactaaatttggttttgctgagaacatatggtagtttagaagcttggatttacaggcatgttacagggtaacatgccttaaaatttcaacagccatttagcttgccctaaatgattttctatatacatgtacttggacttgatgaagttaggcagtagtgaaatatacagtgagaatcctgaaaatgtccctttaattaaaaaatgtacttttatgacacattaaatctcctttagtatgtccttgcaacacacagtatcatatgtaagaaagtgcaattaaggttgagtagcatttaggaaatttccaaaaaaaaaaaaaatcacctttctcataaaagaatgtgaacttctttgttcattaaaagctatataagccaaaaggtactgtaaatgtatttacgggaagaaactgtcttccaagagtagcaaagaaaaaaaaaagtgcttgttaactaagcacaaacatggagggagttcaaaaaactaaaaccttagcaaacatggatatcaccttacagtccaaagaacatgatttttgaaatattcactgaatatgttttgctctgagtttttcacaaaattacaagctagggttttaaaaatcatatttagatgatagaaaattggggtgaacttcagaaagccacgttacagaggtaaaggcaagaaataaattttataaattagcgttcattgttggcaatttctcaaaatcaacaagggtaacaacaagcagtatgaaacagctcactcaaaaaaaaatcatcttgtgataaggaaagtggcacaatggcgattcatggtacagtaggttctgttatatctaagttcatcttcttagattttaaagattatatgtttttagtccaagaaacctaaacatttatatattcaattcaaattgaggaatgacatatttgaaaggttatccggatgtagtgagaacactttaccacgttaccaccagtggtatacagtggtattgattttgtatgtcatcaaaatcaatacatacagatattttcttcaaataccaaaagggaaatccagtctacaggaagcaagtctatttctaagaaagaatgtgattccacatctcaattcattcagtggttttaaagatctaacaaattggtaacacaaggaaaaccttcacatataaagatgttagaattactagaaaaggtttattacctccttcctggaaggacatcccctcacctttctttcctctctctcctcccatccatttatttcaaaacatttcttgaacaccttttcagcacagaacctaatctggctcctgcaaacaaacgtgaataagctgaattccggtcatcaaggcggtcacagcttaataggaaagaaggatatgtaaacagatattttcatgcaagatatttgtgtaactgaggaagaatcagtttactctaccaggaagaatctgagaatgtgtcaacagaggaggtgacatctgaaatggattttaaaagatgcacagatattagacatggagaaatagggtgggcccttccagacaatgggcataatgcacgcagaaagactgaaaagtattgaaatgttggggaaatagaacttcaaagaggatggagcaaaactaagtgaatatttacactgggaaatgcggttactaagagaggttgaagcaagatcatgaagaatcttaaatattttgtaaacaggcttcaggccagatttcctggggcaattctgtaccatgcttactatcttggcatcaatattaggaatgttttcgttcattctcacgtgtcctagtttgaacaataaattaagtggtcattctgtttatgggcctttcagttctcaaaatatgatttctagaaggcagggctgaatccacatgatttctttttgtgtacttgtattcaatgataacaaagaaattgtagcaacagggcttccatgtccttgttacagtgattatcttagcttcagaagctacttgggagtcatcattcgttctaacctccttgtggggtgcactcctgcagaagttggaactatagtacccaatgtgcttgtagttagaattccacatgagactttggttaaaccaactggatgaactcatatgagatttggaactcagaatggcaaatatggttatggagacactgtaaaaacagtggctttctgtagcagggtcctatgtctagttgctagctgtgtggatgctgaaagaaaggtgcagtttcagttgtagctgtttgttacccttggataatatcatcagtagcaagctggagtcagcaggtccagcagcagctatctccacctcccattcccagattttagcagaaatagcagctaccagggtgggccatcttctgtatcattctgggaactagtcctgaaccccaagcctagaggctgtattttcaatccttccaaagatttaatgtacacttaaatcttttcattgaattctttcatgcttaaaatggctagtgtggtttcaatttcctaaaactgaaccttgacatgtatatggtaagttatttaacaaaactgggcctcaaattcacatccatgtaataacaaagttggtctatccagtgacctgcaggatccctcctacttctagaattccatgttgtgattctttactgttgtggagtttgcctaatacccccatttttttctcctacatccctcaggaactgcttccaatctggcctgtaccttactgttccatataactgtttcacaaaatcacctattcatatatttttagtattcagaaagtgtaccaaaggcattggatgtggataagacgggataagagttcacttattcactggacaaacatttattgagcacctactatgtatcaggtgcttccaagtaacatattattaactatttgacttagtccaagtgtttgtttagataaaatattcctagaagcacatttatcttcatctgttttccaatttaataagaagtgtcatcctcccaacctgttgatattcctcccaacccctctccagtctaagcttcagtcagtatagctgctcctttacagatactgacttgagtcaaatcaagattttttcccttctttctagaccactctctccatttttaatccttttgctttcttcaacagagtgaattatcacacattttctttattgattcagtttttaaccctacttttcattcctctccactctgagtttcccagatgtctcttcaggtggtcctttgcaagatcttgttctcgcctgctggctgagcatcactttaaggccctttgctttttacaagtagtcccttgggcaaatcattcaataatagagttttaatgcatttttgatcctaaattacacatcctgagttacaggacatttcaacattgacattccaatgtcttttcattgttattctcaagtcattcgcttatctcaacataatatatccttcaacagtcttcttgtataacatttccaggcaatcaaaaccctgaagtcatttttattttgcttgtctcatcaggtcattgccaaattctgataattcttgatacacaacaatcttatatttgccattctatctgcatttctatatccagtctcatatttcaggttctagacactggattgtgtcttctctttcctcatattctgtcttctacacctatcctacattctgccacttaaattatcttctataaatcttactccaaaagcttttggtattgcaaatttccttcctttttacattaaatttcaaccttttggcattggccaaacatttaactaactaaactatatatctcttattgtatcctagctttattttttctctagagtagttaatcttgttatttttcattatagtctactcatttttttttgcaattttacctatttcatcagcctagaaagttgtttacctgaacaaaataataactaaaaaaaaaaatcttttaaggaactgttcagattcttccctgaaccaagggaccagctcacatttcttcatttaaatataattaatatattcagcagttccaaagtactttctatgagtctgttaagccaaaacctcaaaacaatgtgggggtggagggtgctcaaaggtaaattcatgtattacatttttcctcttgttcaatcgacatcagagaaaattcttgatagagcaaagaaaagctgcaatataaatcaccacagcacataagatcttatcacaatgctcatattgaaacttaatactcattgtgatggtattaagaggtgattaagtcttaatggattagggcagaaaggacttgtggaagttggtttgccctctgccatgtgacatcatagtattcatcccctcgtgggtttcccccatccatcatgtgaggatgcagcaacaaggcaccatcttggaagttgaaagtggccttcaccagatagcggtgttggttgcttggtcttacacttttcccagccagcagaactgtgagaaataaatttatcttctttataaattactccatctgtcttattttgttataatagcacaaatgactaaagagaaacaacaaggctgaaagctaggtatgctctccatgatattcatcatagtacagctatactcatactaggcttatgatttgtggaaattagtatgccttcatcctatctaccatggacactccatgatactgcagacagagggacatatataaatggttttgactgcaaaatacttttgtgattaaaaaactccggtaattaattactaagtccattaaaacaaaaagggaaaacatgtcaaaaagttgccaaatgaactggaaatacagcaagtgatcaataaatatttgttaaacaaatgagtgaacaaatcagcaggtaaatggtttagctttagagaaaataatttataaatggaaaataatgtgtcaatatgcaaaatgtagaagaatgaaaaaggaaaacataactagctgttgctaaagtttctaacagtattggaagtgataattaaaaaaaaactggaggtaattcatacatccaagagtaggagtatagttgaataaactatatcttatcataatatacacagaggcacacactattatatgatattctattctatctcatatataaatattaaaacaagtaatttttattatttatggattttgtatttgtgagttcatctagttgttataatgtttttgtaatccctaaatcaatactcactgtgctttcacagtcttccatagacacgtacaaagtggaaaaacaaaacaaaactcaacaaggctataaaataaaataaatatgaacgctgatttataatgaagaaataaatgttaccatttccagataattgtttagatagaaattctacagtaatctacatattaatttttataattaataaatgaattaagcaagtcattgaatacaaaaccaatacacaaaattacttgcattttttatattagcatcaaaacatcatttaaaagactataaaatagtttctatgtttataaatttacaaatatatgctagacctctacactgaaaactataaatattacttaaagccaaacattactgagatactgagctggaaaaaatattcataatacacattagagaaaatattaatatctaaaatatataaagtactcctgccaaatgataagaacaagacagacatcccaattttttaaaatgttcttagacatgtacttaataaaaataacattctaatagtcaataagtatatacaaagatttttaacattgttaaacatcagaaaaaaaatgaaaaccagattaaacatacccactacaatggctggaagacaatatcaagcactgaatgatatttggatcacctgaaattttcatacagtgcaggtgtgaatgtgtatggagatgctcctttttaaaaccatttggcattagcaatggaagttgaaatatgtgaataccctgtgataaaacaattctactcctatgtaaaaacgaagataaatgaatgcttatgtacgcccaccataatacatgtacaaaaatatttgtaactatttataatagcagcaactgaaaaatagattatagtaaattacttattactataagatacattacattagagtaattttagacaaccaactagcacgaagaaataaaaagaacaaattactactacatgcaacaatatgggcacagctcatagatataatgttaagtaagagcagccagataaaactgagtaaatactctctaattcaatttctattatttacatatacatatatgtgtgtgaatgtgtatgtgtgtgtatatataaaaatacatatacatttcatgaaaaggccaaacaacactaggttgatagaactcaaaatagtaattacctttggtagggtatatggtacagtgtctgctttgtggatgctggaaaaatttaactcaatatgcatgatggttacatctgtaaattttcaatgagtgaaaagtttatgatttgtgaaattttactgtaggaatactatcgatcaagaaaaagttaccaaaaatccacaaaaagatttaaatataaatctattctatcatatgccaatggctttgtttgatacatgaggatagaaatatgactttgtagaacatccaaaaaaattccagaaagacattatgtagcaatctaaattaatgagaaatgatttatgcaaggatggctaacagcctcccacaaagactgccttctcttctcccaaaaaagtgatttgataataaaagcactgtaaatcaatccacgaaatttacttcctagggggtggaatgcctggctaatgtaagcctcactggagtacacaggatatatgccagctttttgccaaagatgcctatgagatcattctttgaaaggcctcccctctatactcttgacatgatataaactacttttatatttatgtatgctggacactgctttagtgtactttatagatctttaaataaaaccagctgtcattccagctatccttaagagaaaaaaaacaaaaactttgcctgctacacttttgtgcatataagaaccacctaattctcagggtctgcaccagactttttactacactaagcctggagactgtatttcaagaagcactcctgcaggtcccgaaacagctagtttgggctgtacatatataatatactgctttttactatcgtatgaactattcatttttcgttgatctgcttgttttaaaaatatgatggctttactctgtgtgatctgaattaccttggacgatagaatcaaatattataaacaataaactatatatattcctatccttcaaaaacattataaatcttttatctgccatctagatttcacttctcttagtccttgcaatgtagcaacattatgtaaccattgcataatcaaagaaggaaagtagctaaagcaatgacttttcatatttattaagaattatgtatgtaaaatgattcttcaccaggtaaactcttaatttaacagagctacctcagacttggataggagacatctaagtctcttataatataaactcagggtcagctgaattcaacaattttaaagactaatgtgcattactaaagcataggtgaaagattataaagtgataaacttacctaggctgagtgaaaggcagagaggtatgaggccttccaaaagaaacaaacacaaagacagaaaaaagaaaacataaacaaaacaaagaaaatcctgagaaaaaagctgaagagactagagaggaataaacgatctgcaatttaaaagtcgagagtgagtagataaaactcagaacattcagattgttttaagtgagagaacaagatcttctaagaatccgtggcataaaatagaagatgcaacattcaacaaaattaattttacaatcagacaagtaacttcctaaataagcaactaaacaaactgttgaccatatcatgagccttgcaaaatgtccttgattagcttgcttctgcatttctataaaatggagataccacccatgagacctattctggacctcaaggtattattgtacaaataatgaactaaaggtagtaaattgttcttgagttcctcaagatatagtgtatagtaattcagactattgtgcttttaacttttattaattaatgaaattatatgagttaacattttaataacatttaataccatgggcatgtaaaattaaggaaattcttatagtgaaaatgtagtatggggaaaaggccatgaaatataaatggctaaatatttcagtgaaagaacacagttacattttttcccccagactctggactccatttgaatatgaaggtgctagaaaccctaacaccttgtttggtttaataacatttttgaggatattacagtaatgctaaagaaatgcatcctatctatcaagtacttaaaatgttaattaaatgaatacacactgattattagtaattacatcaacctgaatacacattaccatttaatgtattaaactcatcactgagttaacagcatggttttaaataaactaatattttatttttaagaaattggctaaattaataaattatactctaacattaagtattatcagcattagaattaatttgtatataagtacacttttcattataaaacattagggataattattcaaataagaggaaggcagaagggtgcagaatatcattatccagcggcctatatggaaaaggcaattgtggtttgctgatcttaccaggttgctgatgttggatgatgatagttctcattttaccaattattttttcactaggataaggccatatagttgtgtaatcactcagactgctttaataccattaacttgtatttacccacaaatagtccaactgtgtgcaacaatcttagaacgatgccttttacaccataggaggtttttcctcgaatttcctatccctggactgtgacctgacaggggcagtgtagtcatgacgaagcttaaatcgagcaatgtcacagtctactgaaaaggacacaaattctcgacctgaatgcctacggtctcataaaattctacaataattaaccaaaggtccaaaaaaaatttctttttagtgatttttgttctcctaattttctgactgctgcttgactgggcaaaatagtaaatacaagtaaacttatttgttttcattttcttcattttagtaaagacactttttatgagagactaagtaatgaatggttttttttgaaatttacaattttacgtaaatgaacatatattaccaaagagaagattgccagtgatttctgtgttatggaaacacatgcacatatacaacccaaatacgaaaaggtactgcaacatattttgcttattggcattgactttcatacctaagatattttcttttgtcattttaaacattaatatttaatacttataatactttccatttaagctattctttcaaaatatatcttaaatatttatactaataaatatctctatattctctcttggtacaaaacatgcatgttctatatttgctgcaataaaatatcttttaattcctccctatttttccttatttagtacatgtgatttattccagattaaaattttgatatgtgtatgttgaatatttgtatatgctacaagtaaccagtggttctggaaactgctctacagtgctcttggcattctcaggaactctttcggggttatcggaatgagcagattctggctgtcttcaaccagagcaaccctcttttaagatgttttatgtgtttatgtttccaggtaagctgtcttcaaccagagcaaccctcttttaagatgttttatgtgtttatgtttccaggtaagctattaaacaaacaatggaaattatacattttttaaccttcaattccccttattgctccatttcccaagctggtgcttcatctgtaacaatgaaaattatattatctcacaaattgttatgtgaaataaatgagataatgtattacaaattatttttatataacaggtaataacataaacacacatactcataatatgtcttacaaaacatggaagaagataagcataagtgtcttattgacagattgttataatggcaataatatcaaattcttaaataagaaagacaggtgtttattagtgagagagggtcttctggtaacaagatctttacagtagatttattttctataggccttaagaagattttatttctgtttttgtaattatggagatttgtaaagtggcattatcacactaaaaatccaacgaatagtttgggtcttgatacatccatatattcctattctttcctgcatgagcatgctcctttgggccaccattccaatcctgcaactttagtcttgtgacccatgatcactgcaaaacacaatgccctttccttctgtatttttatcccagtcagttcacccctggtcaggtgttggtcctgtatgtctctaacaatcatcttatgcttggtataatttatcataggaaactgtacagcctcctacaattaagtctacataaattacaattattagcaaaattttaaaatttacaacactaattttaaaatttctcctgagcttcagactcatatttccagtgttttgttacaaattctgtatgcatacgtaactggaactgcaattgcaactgcagaatgtccaaaattatataagttatctcctctcttccccattattctttttctaatttggaagtctcaagtgttattaccataatcttgtcagttacccaggcccatgatttcttgatcattgaagcatattttaatattatcaatgtatctggacagacttcgtctttctactaattgttaagttccatgacgggagggtaggtgccctatttaagtctgtattccacattatgacaaatataatatttaaatagaaggaacacagtacttccagaagcaatgagaagtcaactggtcataagagcctttgctttacacaactcttaaagcaaaatctgggaattctaaatgtgtggcagacagtcttcctaaggactctaccaggtgactagtcatttgttttctctgttcaaacaaagagactatattaagttttataacatggtatcatgggaaatttaaactcttcatttagatattacgaaagaatacaatgtcaaagtagcccttattatcagtagggacatttccattttctttctggaatatcatttcaaaatgactgttactgaaaattttctctgcagactatcatttatatactttaggaataattaatttctgatatcacagcttaattataaaaatttctagtgatgactgacactttggttccttctaacatttctttcctaagataataaagagatattttggaaaaccttaatcatgatcactgcctgacaaaagataatgcatagggttcaccttttacttttaacaacagttgtgaaaaaagtcacactgggcctaaagtagtaaataggtcatatatttttaactcaggaaattcaaataactgccatatcccaagcccaaatggttatagattgtactgaagaagagggagaaaaaagatactacactaaaaataagattaaaccaaacactttaatttttttcaaaagtagtctgccagcctcaaaaatatcaggtatatgaatgacagtaacagccataaacccaggaactacaggatccaaaatgcagcatgctggtgtatataattcaaggcaaggacatgaaagttattctcatgaatgataatgggaatacaaaaatagtagcataaaattgccttaaatgcaagaaaatagaggaagaaagtcaagtatggtctcagattattttacataaagaagagatggcaaaaacatatataccgctgatgatcccctacaaggagatagtatggaaacataacacttggtaaaatttgttggaaaattcaagaaataagaagtatgaatttgaaacggatgaaacgtttgaaatataaagggtataaagaaaatgaacagacttgtagaatatatcaaaactaatttacatagttagatataccatatgctggataggaacactcaatattgtaaaataagagataaaaataaaaaaggccatcctccctgaatgaatgtagaagttaatgcaatgtcaatcaacatcccagtgaaatttttttgcaatttggcaatgtgattttaaaatttatgtgtaaaaataaatctataagcgcaattatttaggtttttgtttgttttgttttcaaagatcaaagaatagtctgggaagcccaggcacagatctatgcacaagaatctgttatgtaataaacggatacctgtaaacagtagtgaaagaatatactttcaataagcaatagaaggcctcataccaaacgttataaaaaaaatacctatataaagacttaaataggaaaagaaaaaaaaatgaagccagtatacagctagaagtggaaaaatatttaaaaccttaagcgtgggaaaggtcttccaaagccagaaatgtagcaagaattaattcagtgaaagtttgccagatacgacgatgatgatggtgatggcgacgataatgatgatgatgatgaagaacaatgtaaagaataaaacaaatgtctcaaaagatctccaatatattacatgaaaatgatggctaccctttaatatttaaaaaaacacattattttgcataagtagaattagcccatcacaataaaatattagcaagggcatgaaaagtcagggaacctaggaatcatccagtccatagtgatgaatgaagaagtatagaaaccaataaacatgaaaaattccaaattcaaaacacagaaccatgcatgcatgtacatgtacacacacgcacaaacacacaaagagagaaaaaacgacaatagaaggacatacactaaaaaatatttttctttttgtttacttttccaaagattttaaagagtattattataattagaatataaatcagccagatgcagtggctcacgcctgtaattccagcattttgggaggccgaggcaggtggatcacctgaggtcaagagttcgagaccagcctggccaacatggagaaaccctgtctctactaaaaatacaaaaattagccaggtgtggtggcacacgcctgtaatcccagctactcaggaggctgaggcaggagaatcacttgaaccgggagatggaggttgcagtgagcagagattgtgccaccgcactccagcctgggtgatagagcaagactccgtttaaaaaaaaaaaaaaatcaataaatgttgttcataagaaaacaaatgaaaaaaacagagttatgtgcaatttctcaacaatgtttattaatgtataaaggaatatataccacctccagttagttcatgtttgtttcttaatttttaaaaaaatgttaaatagagacaaggactcactctgttgcccaggctggtctcaaactcatggcctgaagtgattctcctacctcagcctcccaaagtgctgggataacaggtgtgagccaccgcactaggccaaaactttgaaaaaaatatagcactatataagtacatgtatcttgcactttctatgctatattataagtttctgtttgttttgcttcccctattaattcaataaaattattgaggacttgaccatgtttcattcctgtttgcatctgcaatgcctacacagtacagggcctggcacataaggaggcactcagcaaataatggttgaagaatttcatacttgcatgagtaacgaaaataaggacaatactatcttctaccatatctgaacaaaattgtttcagcaactagtacctgccagatatgatcttataaatgcagctatgtggccatgaaggagaacaggttatcagctggagaaatgagcagacatttccagcatggatggaaaatcactcagattgaattccacttccttgtgtttctggtaaatattttactcattcttgataacctcttgctggaaatcttttgcacacttccacatcatgacacccattatgttttctaaaactcttcatgcatatctttattatcagtataatcaagctgcagtagagtattatttgtgattaagtttttttggcgatactgagagatccctgaaggcaaggaatatgcattatatatcagggccactgcatacagtcctgtaggttgtgcactgcacaagggcatcatgtctaagagatgctgtacacatcatgaatatcataaattggtatatttataacatcaattttctgatatatgatagtaaagtatccggaacatagagaatcctttattttctaatatggaaaatccctggaacatggatggtactaaaaaatattcatataaataaacacgtcaagaactgaaccaatatctgatgcacaaaaattaatgtatagaattttggttttatctttcaagttgatgtgtggggaaaaataaatttaacacggcaaataatatcaatgaaaacataataaaattacagatcttttggtaacaaatactgatgaattttatggttcgaaaacatgcaaagtaaattctctctaaaaagaaaatcgtaagttctctgattacactccagcactaatgaatgctcccagcattggacactgggtccatgaaattgctgtctcacacagtgcttataagctttaatgtcacaaagcatggtaagcacttctatttagctttaagcaaatgacgttttcattttcaggtcttcaagggcacagtattcaagagacctataaatggaatgaaaggcattggcaaaaataataataaccacaaaatagctcacatgtcttggctctctattcttccatttaaccagtatgtgctgagtacttgctttgtataaaataatatgttgagtactagcattcttgaagcagattcatcccaccaaacttctgccttcaaaagatgatggcttttcattatctcgctattcactattgtattacggtagaagacgatgtgaagttttcaaatataatcccaggttgccagaggtttaatacagtttaatctagttttcagttgggctctgcttagaataaaagagcatatccagatttattatgcaaaggtgatgaatggagatgtgattatttgttttcccaagctatgctttttagggttccttatagtaagctcccttcacatttaacatacgctgttatttagaaaaattattatatgccatatctaaggggacttcattctactgcataaagcaaggaaagcctaggtcttggtggggacattagtcctcttcaggacattaaagcattcagaaagaaactaatgtgtctagccaaaattttctagataattgcatcctcatgaagaaatttttaaagggtattttagtgtcccaagcttttttttttttcagtcagatgactcataaagttaattaacatcataactgaaagccttaggggaataaggaaagtctgaacagagtttgtatctactctaaataagtggttctttcttttctttctctttcttttctcattcctcctcctctctctcttttctcctttctctcctttatcctcttttgctctcctctcatctttttgatactgatttctgtgaaattagaatttacctactgccttcaaaaacatatttaaaaattatactctgtaatgaaaagggctggtagtttgattttaaagacacatttttcagcaaattctgatattttcagaatttcttgaaaacatctatttcagaaattccacattgtacagctcaagtagttagctttaagtttctgatacttctctaaatttgataaattctttttaggccaccaaagcatttttttctattatccagagtggcaataaactaatttcttgtcttctaccttagaaactgaatctggttatctagcccatagcttactatctatactgcttggacatctgccatctttttagagagcttcatttcaatattgaaaatataaaattatattaacagcaacaagttttgtcaaacaagtgcagatttatttattgtgtattataaaaagcaccatataaatacatatgtaacacgtacatatatatatacatacatatataaaaagtacttattatttcccagtgctcagagggaagaaagaagacatttgaaaatttagtagcatgatgaatttaaaatatacatttttaaagacaactagttccagcactttgggaggccgaggcaggcggatcccaaggtcaggagatcaagaccatcctggctaacatggtgaaaccctgtctctcctaaaaacacaaaagattagccgggcgtggcggcaggcgcctgtagtcccagctacttgggaggctgaggcaggagaatggcgtgaacccgggaggcggagcttgcagtgggcggagatggcgccactacactccagcctgggcgacaaagcaagactctgtgtcaaaaaaaaaaaaaaaaaagacaactagttgggagtctaacgttgcaattgttttaaaatgtcagggtgattgttactcacatgtttttaactctttggatgttatatgcataatgtaatttaaaaaacaataattatacgcactgtgacatatttagtaacatgaaaatatatgaaaacaaaaatatagatactcgtaaatgtttagtgttaaatgtcaaaatgtacgctaaaacatgttctcatattcatgtatagtatgtagtcatatttacacatattattaagtaatacaacttcaaaacttttattaaaataaatttatgccttcgcttaagctttaataaattacaaaattgagatggctttctaaaatattttgaattcaatattactcccgaagccattagttttcgaagtgtggtttcaactcaggcacagaggaaagctaaaaccatgggtatgccagtgttagtgcaaaatcacttatcttttggaaatatatcttagaataaagggctactggaggtaaaacaatgaagacttgaggacaaggagtacagatcgaacattttaaaaaaagaagaaattagtagttccaagaccaattatatacttaattgatagagtctagattctatctcaattacatgcctttccatagtctcaacatggcttcccaattcttctaatgttgggatgatctgaaataaatattttgaagaatacaggtatgctaataaactgagaaaacaaaatgaatatcatggttctgacatgcagctgattagagtggtcctgacaaatgaaagcaaccacaattcttaaaggaccagtgattgatgccaaaatgacttcagaacaagcctagaaacacatgttttaattctcactttctaccttgtaaattattatgaaaattagtcacaagtaatctagataggaggacctagcatttacacaattctaaagtgtactacatatgatatagagtcatcatatgaactttagaacatcactataacaaaggtattatttccccccttttgcagactaagtaactgaagctaaaacttgatagcacttgtctgactgtaaaattcatgctgttttcgctacactatactgactctaataactagcactgctttcatgcaattaaaatttattgagtatattctgtgttctcacaaatggatagaacatagttggtacaaaacacacagattgcaaagaataggatgaaaaacagttaaaagtagatccgaacacttacacatgtgatagaaacactacgcatggtgtctttacttcgtatataactaatcctcataaaaaccttatgaaaagcaatatcaatgtcctatttttataaataatggtaagagaaattaaaccccttacccaagaacaacttttcaactagtaagtagttaaactgaaactcaagccatctatgttcttttccaccactttccactgctttgtcaaaactttataggagacacttgctgccaactatggtggaagaatttgcagcacagcaatgctcctcttataacaagtactaaaaaaaatgtgaccgggcgcggtggctcacgactgtaatcccagcaccttgagaggccgaggtgggcagatcacttgaggtcaggagtttgaaaccagcatggccaacatgatgaaagctcacctctagtaaaaatacaaaaattagccaggcatggtagtgggagcctgtaatcccagctactggggaggctgaggcacgagaattgttcgatcctggtaggcggaggttgcagttagccaagattgcaccactgcactccagcctgggcgatagagtgagactcagcctaaaaaataaataaataaaaatgaaaaaaaaaaataaacagacaaagtacaaaaaaaaaaaactttgaaggtgttagagaactgctaagataactaagacatgacacaaaaacaagaaattgtatagcgtttaactgacattcttaaaagcaggctttttccttggggtatatgcatataaaccgaaattcaagccatctatgttcttttccaccactttccactgctttgtcaaaactttatatggacacaaataatggtcaccaggtcccagaatgggttgtgtgagcccttgaggccttcatccagcgttgtttctgggaaatctctatttcaatctattcccatacattagttattgaaaaataatagacaatcgcaaaaacaagttgacctttttgtgttcctagagcccggtcattttatggccctcgagactggaagtcatgccaaacaactcattaccaaaagagctaaggtcccagcctgcgccgaagatttatgagacctctcctcatctgtgaacggaccagtggccgactctggtgcccaggctgttgcttcccagcctggtggtgaatcctccatagtctggtgagtgtaaatatatatatctcttttcccttctccccttcaaattgcaatttgcttattatatcatttgcttattatatcaatttgcttattacattaatctgcttattatatcaatctgcttattgtatcatttgcttattatatctgcgctgccatttacatgggataaagcttgtttacccttaatggtgttgtgtgtgtgtcttttattttcccctcacgcatttcccgtacagaacagagaccagctgggccaacatggcgaaatcccatctctactgaaaatacaaaaaaattagccaggcatggtggcgcacacctgtagtctcagctactcaggaggttgaggcagaagaattgcttgaacccaggaggcagaggttgcagtgagcggagatcgcaccactgcactccatcctgggtgacagagtgagactctgtctctaaataaataaataaataagacaattagggaaaaagttaagatggtaggtataatcccaaatatatcacgaattattattgtgggttgacatgtgccccctgaaagataagtttaagtcttaaatcccagtacctgtaatggtaatgttatttggaagtagtgtcattactgatgtacgcaagatcaagtcataatgaattagcgtgggacctaattcagtgaatgatgtctttagaataaaagagaaatgtagacatagacacatagagagaacatgtgaagagagaggcagagaccagagtgatatgtctacaagccaagaaacaccaaggattacaggcaaccaccaggagctaggggagacatcagcagatattttctcatactgccacaaggaaccaactctgctgacatttgtatttcagacctctagccaacagactatgagagaataaattctgtgtttttagtcacatagttggtggtactttgttatggcaactttcagaaaccaacacaattacattaaatgataactgattatatatttgaattaaaaaaaagactgtcatgctgcataagaaggttaaaataaaaaaattaatgcttacaagcgacacatcttaaatactaaaatgcaaaagataaaaaatgaaagggtaaagaaaatgcaccaagctgacactaaaagtaaataaataaataaataaataaataaataaataaagtagatgcagctataacaatattagataagctaccctttaaagtgagaagcattactaaaaacaaaaaatatatatatttataagattaaaaaactcaacccactgggaagacacagcaattgtaaatttgcatgcaactacttagctttacaatatataaagcaaaaattatcagaactaaaattaaactgagaaaacagttataattatagttgaagatttcagcacaacgaacactaaagaacaaacattttaaaagtcagtacatttctagatgatatgaataacgcaattaacaaacttgacttggtaacaaacagcattgtactcaaaactcacattattttcatgtgatcatagaacattggtttattgctggataataacatttcatgctgggccataaagcaagtcatacaaatttcaaaaaaaaaaaaatgaatcattctgtgttctcccaacatgatggaattaacaagaaatcaaaagcaaaaagataattagaaaatcttcatatgtgaaagtagcccacaatagtcataaaccatattgtcaaagaaaacatcacagtggaaattaggaaatattttgaactgaagaatattagaatttatgtgatgcacgtaaggctgtagctagagagaaaaggtatagcctctaatgcctacattgtgaaaagaagaacggatcaatatcaactttctaaatattaataagttagtaaaggacagaacattaaaagccattaaactagatgaagtagaattgcagaaataaaatagaagcataaagaataaaaaaaatcagtgctggcaaaaattgaatctgtgggaagaataatactatattagatgacttctataaagattgatgagaaataagtacaaattgccaatataaggaatgaaaaaaccaatattattacatatcctgaagatagaagtacatcataaataatgccaattaattttaaaatttatgagaaataagcaaattccttgaaaacacagcttactaaaaatgataccaaaaaaggaaaatatgaactgtactaaatatattaagtaataaacttacaactaaaaatctttccagaaatctaaaataatctattgacaaactgtgagaattaataactaaattagcaagaaagatgggtataaagtcactataaaaatttgctttttatatgctagatatagaattttttaaaaaaatataattcacagtaataccaaaaacatcagataactaggaatatagctaacaaaatatatgcagtacttgtatgctgaaagttataaaatgctattgaggaaaaaaataggaaaaacctaaataaatggaaggacacatagttttatgtaaacatttcttgctattcttttaatttttatccaaaaattacggcaatcatatttcactttcagtagccaaatataattttgctgacacatctaaggaaaatactagaatcccccactttaattccatacatattttggaaaactcattattataaagatgctaattctcctcaattttaattttatttatagatttagcataatccccgttaaaattgtgataattgttcttctgtggaaactagaaaggtaattttaaaaaattacatggaaacggaaaggtcaaaaacagctatgggaatctttaaaacatagcacaggtttgaacaacttacaccgcatatatcaaaagctaccataaagctaaaatagttaaaacagagcaacattgatgcacacactgacaaaaaagccaacagaagagacggagtccagaacagacccacacacatatggtcgcctcaaatacaaggtgagactgccacgcagtgggaaaagaatggccattttagtaaatggtgccaaaatggaaacaacccagtccattaacaataaaatgaatttaaaaattgtggtacacttatacaatggattactattcagcaataaggaagaataaactatacctacacacaggaataaattttacaaaataatttgattgaaaaagaaacagacacaaaagatcacatactacatgaattcatttatttaaagttaaaaatcagccagaactaacttccaatgctttaagtcaaaatagtggtgaggggctgggcatgttggctcacacctgtaatcctagcactttgggaggccaaggtgggtggatcacttggacccagatgtttgagaccagcctgggtaacatggtgaaaccccgtctctacaaaaaatacaaaaaattagccaggtgtggtggcacacacctgtcatggcagctatttgggaggctaaggtgggaggataacttgagcctgggagatcgagtctgcagtgaaccaagatcacaccactgcactctagactctgtgtcagcaagaccccatctcaaaataataataataataataataataataataataataataataataataataggaaagtatctgaggtgttgataatgttgtaggtattaatctaggcacaggcactctagaaaaatataaggttatgtgaggcactcatgaataagactaataattctctctccagctttatgaataatatgctagaataagcatattgcctatttcttcatttccccagacagaataaacaagtttttgaagcttacggccattttagcaacataaaaaagtacacactttgtaactcattctatagcttttttttcattgtgacattaaaaacatgtatttaatttaaaaactgagttgcatcctgtttgttctcctgcatgtttgggagtaactcctttttttttttttgctggtacagaatactctgttattatcttcttgctatgctttgaatcacccaagccaagacttatttttagcattaagctgctaacccagaagcaaagaaaaccagtcacaagggattatctctttcaggactgtactcgaattattatacatgtgaattatttaagaatcagataattttatgtggcaaaaggaagaagaaagctatgaatagaagaaagtacaagttgtcactaattattaactagtcaatatgaaaataaacccttccataaatagatttttatatttttttccttacactaaattttcttccacttctgtttcttccatcctgtccacattggtggattatttattgctatttcagttatacatttcaagagaatgaggtgactgattatatttttgcatagtttcttggtttaaaatactgtgaaaggaatttatttttaaatgtggaacctgttactatgacatcaaaaatgacaacagaaatggatagcaaagaaatactcttaacacctttaattctagtgactataatcatttaaaatctcttgctcttgatataagcaactaccacctttaaatgaaagtaggtatttctaagacattccaaaagtccctacctaagctgtattgcttgtattgatccgtattctctttagaaatgccttcctatctcacaggttattacatgatgggagatcactttataatcttagctgctagccttgaaatatttcctctctatatatttcttcttaatctcaatcttcttggctacctattttattaccaattcctccattccatttctagcattatctcacccttcaggctttatgcgaggcactgtcttccttccccaaaactatgactcagtaaaccatcctttggcaacccttagtaaatatgctatttcatcctggtgaggcagcaaattggcccagcaagccagactttaccacaaggaattgcccccaggccgccaaagcatttctgggagttctgtgtatccaattccacaaatatttcctgagtgcctactacgtgcccagcactctgccaggtgctggaaagaaaatgatgagtaaaacaggctcctggcccttcaagagcttacaatttaatggaaaagacagagcttaaatgagtaactgcacagatacatgattacaagctgtgatgagtgctgggaagagaaagtactcggtattctgagagcataagatgcttggcctgattcagtgtatggagtcaggaaagatctctaaggaagtgacatcagccaagatctaaaaagtgatcatcaggcaggggtcatgctaggcaggaatttgcatagcaggataaagatctgtgtacttaaaagaggaggtcctttctattggaaaattattaaatcatcaatcaaaaggaaggagggggagaactctgaaatgtacacagcaggaataaacttaaaatgtattcctgtgcaagaattatttcactccaaagaagaaaaataagcatccttatcttgaactttgctaggagtctctcttatatatttaaaaaagaaactgaaaagtacccagagctataatcagggcattatgtggaataaaattctaaaaggaaaaatacagatgacgcagaagttgcaaggtgagataacaatttatatggagaagaagaaaagggcaaaatgccataagccagtagcagtacagatatagggaaggcaggtttaagatgaggatcaaaagaggaccaccaggtagttgcaaattctcaaatacacgtgcagattatgtggaagtgctacatacatttaaatataagtaaaatgtcaaagaataatgccttagtgtgtttggtctgctataatgaaatatcataggcttggtaatttatgaacaatggggatttattgctcatagttcttaaggctgggagagcccaagatcaaggttaatatctggtgatggcccattcctcatagacaccttctatgtgtcttcatacggcggaaaggtagggcagctctttggggtttcttttataagggcactaatcactagcattaaccatcacagactacacacaattgttccaaatcagcatggacgttcaataaatatccattattgtggaggtagaaaggtaaaatggagaaggcccaggacttgtgtcctgactgcaatgcactgaagatctgaatcactgacctgtgagtttctaatgttagaatgcatttgaagcacctggggagcttagtaaaccatagactgattggtcccagcaacccccagagtttgtaatttaataagcctttgttggggcctaagaactgcatttctaactagttctaggtgatgatgatgttgctgattgagaacctttgttccaagggaactttcctcatctgcaaagtgagacattactgtctccaaggcccaacctcacaaatttgttgaataaaatcagtatacactttgaacatataggctgttccatatttgtcttgtatttcactgccaaggatggtatttttgagtgactgaacgccttgcctatattttctgaataaaaagacactgtgtgagtgtaagcctgtaatgatcaaatatctaagaattctgcataagtggcattcactgaagtggcatgaataaacagaaatttgaatactgaaaaagagagagaataactgagaagttatgtaggcaatactgtaaacatggccttaccagatgttaaaatactgaaatacttccatgccagatggcatatagctatgtccaagacacaccctgagtactgcacacccacaaaggcaactaaaaggaaccaccaccaccctgcttgagctcctgtaccagtgtgtattctgattgttgtgtgtcttgcctcactggtaattaaatgttttattacccttagaaaggaaagagaggatggaattgttgctagctcctcacaaacatctacccaaatctttccaatacaaatcctggacttagcagtcatgtttgttcttcctctgtatctttatttagtccgtgtaaatgaatataagatgttccaagagaaataggggaaaacggagaaaggagaaataccaaagaggaaaaaggatttaggattatatgtcattacagaataactccacttgagcactgttaaaacctgctctgaaaaatcagttcagaaaggcctatctagacggctaaaggagagaagacacagtagtcccagtatgactggtctatatgtgtctctctgttcagcattttccaaagctgcgtaaactttccttctgcagatgctaaaagtattccaagttgccaagtggcatgacatagttccgttgccagcaactctgccaccttgggctgcttaggtctacagccttgatgatctaagtggcctttgatgttgccaggcattggatagaaacaaggactttatactttggagctgggtcagtgttgtctctatttgtgctcagaaaaagggcattttctccactatctgagctaaaatttcttagctccaaaactgggattcactaaccaagaactaaaaactggaaaatcagggaataacagagtgtgagcactctggatttcttcacatgcttttccctgaatactacaaactgagctcattctttctgcatactcggagtaatgattagttaaagaaagcatgcttagaattataaaaatccttccaggaaatgtttttggcaaaaaatactcttccttagataaaattgaaatgcataatgtatgaacaatcccatctcaatttataaaatttcaaccacgtgaaaagacatgtttcttgctaaaattccttcatcagtttccattaataaataaatggtggtgctccttgcatctaccttaactgcaactataaaacactaagcctatgaatgaagcatttaggaaaccataatccactttaaattggatattatcaattcagcacaaagagtcaaaatggttactttcttccttgtattcattagaaaatacggtagaatggagaatttgtgggttctgtttgaggttcaattacacctaaacattgaccaattagtttataacagaaactatttatatcaatgactattttcatagttatcatattattgttatgattgttattagcagaaacttccgtttctgagtacagccacatgaaaccatcttagataggccgttagtagtaaacttgagcttccatgcaagaggtagctttcattacatgctgatagaatataagtgcttcctttcacatcactgtatatgatgtttccaaatcaccatcaacatgacttgaattttttttttttgcagtcacagaagttataatgattatcactattcccattatcttatctttctattgctacagaacaaatcacaaagttaggagcttaaaacaacactcatttgctaatttacagtcttgtaggccagaagatggtcaggcctcaattgttgtttttaattcaggctctcacaaagctgaaatcaagacgtcagccatgctgagaggggttttctcctaaactttttctctttcagattctcgagttgttaaaattcatctccttgtggctgtatgacaggtcgcagttctcttgccagatgtcagacaagaatcactcagctgctagagactttcctcagttccttaccatgaggtcctgaacagttcccaacatggctgcttactctcttctaggccagttagagcatgtctgtctaccacttcactgtcttttagttaagtcctctaactaggtaaagcacacccatgataatctcctttttgatatcccagcatattcacaggctctgcccacactcagggggaggggctattcagggcgtgtacacctagggatggagatcttgtgaatggaattctgcttatcacagcaactgtcatgaaaattttgctcaacagaactccagtgattgggttaacctcttcccccgaggccacaggggcaaggcaaagcaagtggttgagacacatctcttcttgcatctacttcacgcgctggacttccaagcagagaattttccttttaacaaataattatgtagtaaataaacagtttgaaaaaaaaaaaaaaaacccattttggactagataaatcaattagagaccatccagtcaccaaaatctcttctggcactaacagtccatgatttcaaaagaaataagttcaagtcaatcatagagctatagttgacaatttatgatagagtgaaaagaacatttaatttttaatcataaatattggattcaagttttgcatattccaattatttattctgtaattctgggacatctgtagtatcactatgccctttagttttctggcaaatctgtagtatcatacacttcagtctccatgcttagaaatgatgataatcattacagtaataataaaaacatatgtcttacaggattactgtaaggaccaaatgaagtagtgcatataacacaaaatagtatataaatgtaattctgatttatattattactactatgaagacttccctaccccaatcaagttgtttaatagataaccattgtgtttaccagctcaatacctcttgctctagtgaatgtctcttctcattcatcatatacattctgtatcatttagggttcacataagcaacataccttgttgctatggaacagcaataatttgtgaggacagcaaatgcttccggggtctacatgtctcaaagggtattatgtaattctaatgtgaatgcattttactgtaggaccaatgggacacgcaaacacatagtatgaatatttgtaatattcttgagaatatatttaagtggatatcctaagaagctgtcagaatccccagactcccaaattaatttcctggctgtggtacaagagctattatgagagcaaagaccaagtagaagccactgaagtaaatttttaaagacatctctatcactattgagccatgcacagaaagtttaaacccaaagacctaaaaggattcaagggtgatgattcctgtcacttctccatttaacactccactttgggctagtgcagaagatcgatgtattttaaagaataagaatgattttttataaaattaataaggcagtaatgattattatggctgcagtttcagatactgtttgctcactggatcaaacaagcatagcctatttcatctaacatgcaggtttcatttgataaaggtacttttccctctattctggtaagacaagaacaccactagtaaacaatttttacctgacagggccagcagcatagctttgacattctgtcttaaggaaatatcgaatttctcacacaatctcacaattcactactctagtctacaatattaaatacatattgttgacaggttctagagggcagaaagtggcagtcatctcagagatttatataaaaaaatgtgtagcagagattgagaaacaaattccatagaaatacatcatcttgacatcttagtaaagtgcttaaggatccactggttcagagcatatcaagatttttttccataccgaaaaataagttgctatatattgtatacccaaccactaaaaaggagtaggaacatctaattaactaatacgactttggaggtgacatttatcactgactcattcatatgattttaaaaagctcccagttttaatagaagtccaggtcaaagcaaacaaacaaaaaagttcttcaggtttcccaagatacagtgcaaattgttctatttttagtatttgtgacaagataatcccatggtgtgtaaagtggctgtgtagactggggtgttatatggagattgtgacaaattctaataaaaaatcacagcaaaacctatgtgcatttaatagtatagtaaaaagggcaagtacttataaacaaataacctttttttattttttaagatagtagctcccagcttcccactggtctctggtagaactgaatgcctaatcaatgaatgccagatagccatgcaacttgatattccattcttacatcgagtgctattggattaattttgcaattatgtcaggcaaatccagcggcagtccacctccattattcaatgaaaataatctacatggatcaggtctcggaggcacaaattgtataatcattttgtttacaggacccagcatgtatgcctgctcctaacgtatttcaacttctctctcaactgacacctaatgtgatcctgggagttccttttcactaaataactgcagatgaagattctatagcctgtcttgcagatgcatctataagatatacaggaaccacccagaactggactgcaaaagtgttatagccccattcaagaatggagttataaaacaatgaagactagtccagaaggtggctgcatttaagcactatataccattttgcaggagtacagcccaaggctaggatctacacaccactttctgagttgtctggtgaagtaattacaataatataagaaataaattgaaatattgataaccaggaagtttgaaagaaaagttgggatagatctttgggaatgggatcaggatctgaggatatatgtataccataggaatgctcaccagaagattccctgcagaagaggttctcaattacacggacagaataactccttctgcacatgtcagtacagcgaagtgctatggtggcagtaattgaggctgtgcatgaaatcaacaacagaaacttaagctctacaaggctatctgaatatcagttctgatgatttcttaacttgtcacgtaaggacccatccctgctatgaagccttgaaggaagacagcttcctaatatattttatattatggcacacatagttaatgataaaatcaagatgttgaatattttaaaattatatctaatgactacatagtagtcatggatataattatgtcatataattatatctaatgactacatagtagtcatggatataattatgtcatataattatatctaatgactacatagtagctcctcccataactctatgatattgagttctgctggtttggatgctggaaaccatgcagagaaaagggtgggaatgtaaatttggtcaacccccatggaagacagtatagagatttctcaaagaattaaaaataaaattaccatttgacccagcaatctcgctactgggtatctacccaaaggaaaagaaacagttttatcaagaagatacctaaacctgtacgtttactgcagcactattcacaatagcaaagtcatggactcaaactaggtgtctatcagtgaactggataaacaaaatgtggtatatatacaccatggcatactatgcagccataaaaataatgaaatcatgtccttcatagcaacatggatgtagctggaggctgttatcctaagtaaaacaactcagaaacagaaaatcaaataccacctgttctcacttatacatgggagctaatcaatgggtatacatgaatctggaaacaatagactctggaaactacaaaagtggggagggtaggaggaaagcaagggttgcaaaactaccggttaggtaccatgttcactattggagtgatgagttcactggaaacccaaaccccagcattatgcactatacccatgtaacaaacctgcatatgcaccccctgaatttataataaataagcacataaataaaaaatttaaaaagaatatcctgtgaatagaaagattctcctgtttcaagaaggaatgcttttttttttttcttagtatttttatttactgctggtgacatcttccacattccaaaataaatgacagcagttcacttctgggatggttaagtacttcctctccaaccaatcctcttgtagataactataaacactaaataaaatagaaaaaaaagcagctttctgaagtcattggagaatgaacaaatgcagggagaagctagagaggagctgtcacttggaagaatgaaacgacacatgggtgagttttctgattgtatggcttttctttctgaggttaagtctatatgagtggctgaaatatgaatgagaaccaggattttactggcataaagaaccaaagtactgagtttgggcatcacatacttggaagtttggggttgggtaagtgcagtggtcctggaaaacagaaagtcatagaaggtgacttccatattctgcaaatgcactttccaacaacctctggctgacccctgaactatatgtgttcgaggcggactctaagcagcccagctaaggctaaaaggaatgcagaggggttacagtttacaatctgataccagccacagtgtcggtctaaaacaaacaagtaaaacaaaacaaaaagcacactatctagaggactaccacataatgcaacatctctacaatgtatcattcaaaatgtttaagaaacaattcaaaattagatacataaagaaactttttaaatgtgatccagaatcaagagaaaagagaattaactgagagtgaatctgagatgaatcagatgttagaattaggatgcaaaattataaattcttcaatgatataaagaaaaatatacttataacgaatgagcaagtagaaaagctcaacagacaattaaaaataactaaaaaatacaatactgaatactaataatacaataaatatatatatattttaaaaatcaagtggacaagtttaacatcaattgaaagtgacacataagggtcagtgaactgggaaatcaataaacagaaaatatccaaaaagaagaaagagaaaacagtttgaaaattataaacagagtttcagttatctgtgtagcaatacccaaaggtatgacatacatataactggaatctgagagtatagaacaagaaagaattaagagaaaaattatttgaaatgattatggccattttcaaaatctgctagaagacatatatttacaaattcaaaaagttcagtgaatttcaaacaggacaaaaagaaataaaaccacacatgggcagtttttagtcacattgttaaaaccacagataacagaagatcttgaaaggagttagagaaaaatagcatactatttatgggagaataatgttacgagttatccttgacttctcatcaaaaacaatgaaggccagaagacagtagaaaaatgtcaccaaagtgctaaaagaaaccaaaactttaaaaactaccaaatttgaattcaaaatctattgaaaattactttcaaaaaggtagatcacataaaaacattttcagataaataaaaattatgatgtaaagcagaactacaccacaaaaattcctacagaaagttatttgggctgaaggaaaatgataccagataaaatcagatgtccaggaaacaatattgaacatcaaaaagaccaatatgtgggtaaatataaaatattattttctattcaatttctttaaaatatttacgtttaaagcaaaaaatatatggtgggatttataacatatgtacagataacacctgttataactatagcataaagaaaactggggccgggtgtggtggctcacgcctgtaatcccagcactttgggaggccaaggcgggcggatcacaaggtcaggagatcgagaccatcctggctaacaccctgaaaccccgtctctactaaaaatatattttaaaaaaagaaaattagccgggattggtggcgggcacctgtagtcccagctacttctacaggctgaggcaggagaatggcgtgaacctgggaggtggagcttgcagtgagccgagatcctgccactgcactccagcctgggtgacagagtaagactctgtctcaaaaaaaaaaagaaaagaaaagggggtcagtcaatgaacctatgtgattacaaagttttcacattttacatgaattggtacaatattaactctaaggacacctgaaaattcaaggatatttattatagtacctcagtggccattaaaaaaataaattattagagctaaaaagctggtagagaagctaagatggaattacataaaatattcaattaattcaaaaggaggtaataaataaggtacacaggtacgaagagcaggtaggacaaacagacagtaaactgtgaaacattagacctacctccaaccatatcaataattacattaagtgaaatgctccctccaaaaggcagagattataagaatgaataataataataaaaaagctagctaggccaaactatatgctacaatacagataggttgaaagtaaatatgtggaaaaagagatagcatgtattaagcaagcataagatagctgagtgactgtattactatcagacaaagtaggcctcaaggaaaagtttcactttggaatttcctaattagttaaaaacattaattgagtactatactcactacctgggtgatgggttccattctaccctaaacctcagcatcatgcaatatacccatgtaacaaacctgcacatgtaccacctgaatctaaaataaaagttggggaaaaaattaattataaaataaataatttgggtattccaaatttattaggaaggcataaaaatcaatgatttttttttccttttaattacactcaaacttcattgagctaagtgatttccatgtattttttttaggcgtgttaagaaatctataacctaaagttagagaagataacatttctgatttccagccatcatctatatgggtatatacttgctatggagttatatcagaaagccaataagttttcatactgaatttccttgaaaagcttccatactcaggagatctcactcttggtaaactcttcaaaatgtctcggtaccaactgaatcatttcctaaaatcagtaaccaaaattttctttcacttttttctttcctgtttttctctttccatccaaatttatgtttgtatgtatgtgtatggatgcacatattcacgacatgtgtttatatatatacactcttatttttaaaagcacatttcatccatctgtgtcactctagcaatactgaagttaaattgcctagccaaaaatattggcaaacaacattttgcaaaaacacattaagcaacacaaagcaaggaatctgtgttccttctctctcttttttttaaagtaactataccatcagtgcaataagggagaatcacatctaaatcatatctaatttttttccaaatctgtttttgaattttacattaaatttaagggatgggggaagagagagagagagagactgaacaacactgatgagtctcagggaaagcaaccagacaaacacacagagcaccattgcattttcatgagctagacataaactaaatagtagataacttttccaacactctacatctattgagtgtaaagctaggatttaaatctaggtggtcctactcaagggcctgctctttaagcccactgaactattccatcaaagataatcaaggctttaacacactgtgatgtttttaagggttcataagaaagtagattctcaccatggtaaactagcatttttttaagcaatcttactcactgaccttcctattttaaaaataaggtaacataaaaacagaataattgaaacattagagttaatttacataaataaatgctcttttcaatagctaagactatccaaaatctcaaaaacctattcttcatctgttggctgttaaaggagttttagaaaaagaaagctaacaaatttctcaaggtgagtagacattatcaaagcaaatcactgattagaatttgttttttacattctgactctactccctttagagaactaaatctgttagctgatgtaattagatagctaaaattcatgcttttttgtatgaacatttcacttattcttcataacaattaagagaagcaggtataccctgttatcagtcacattttacaaatcatgaaacagatgtccacagagatttggtctctctccaaagccatatgacccataactgtcagaatacagatgttcttaagcttgtgatctaaaccccatactcaatcaactatgctagctgtctcttacctttatcttaaataatcacaaaaattcttaaatggtaaatacctttcacagataatgatatgccaaaccaggtactattcaactgccagttcttgtgttgaatttcctaattaaaaggagtcaagctacctagcaactgacacctttggggaagggagtcagcttggaggtgcatattggggctatcctgagtgagccttatctcactctagatatggggcacaaggctaattagcaaatagaggcatctaaagttttggggtgaacttcctatattgaatacagtactatcaaaattttctcttcaaaattgacttgaatgaggtgcctaaggcaacataagtggtgctggtcaaaagataaagggatccatctcttcctagttgattaaaatgctcagactcaaagaatgctatttattgttgttcccccagtatgtaattaacaaaagacaaaaaaaaaactttctgcaagttcctaaagagtgctatttagcaacattagacactagagaagtagttttctaagatcaaagtataagagcataaatccaggtaattaccaagtaattactagcagccaatatctgtcttatttgtcagtgagatggtaagaatgactgaaaaccagactactttgtaaagaggagaatattaaaaactcttccattagcataaggtaaaaatagggattcttctcaaccataaatgctgatgtgacaaatcctgttgctgtcatgccatgtgacagacacaaccgcaaggcttggaccccagcccactgattatgccaggcaaaaggctggtgctcccaaacctcaggtcctcatctggcagcatgggtctggggccagtattataccaggtcataccactattgtgttttggtctatgataggccaggagaggaactggtacttcactaatcatgcagtttaaaagtaccactgcctgtatattgaggcccctcttccaaagtctgtcatcaagacctactagaattatgtgtgcttccctacaatgcaatgtgccaacaaaggggccacgtcactacccctggtgctgctttctcaatgcattttctccagtgtgccccagtagcttgtgcatgtgctgcttagccattacccttgtgagacttatcttacagtttcaatttctggactatgaacattagaaaaaataaataaatgtcttttctgttcaagtcatagcgtttgggggagctctttgctgtagcagtttaacctcattccaatcaatccacaggctatattctgtcagcattctccaagaccacccatagatttgatgactccttaggaggattcacaggactcagcatatagtcctgttcatggttaggattcattacagtgaaagcatacaaagaaaaacctgcaaagggaaaagtcacacagggtgaagttcagaggaaggccagcacaagcttccaagagttctctcccagtggtgtcacacagaacacacctaattcctctagcaatgagttggataaaacatgtgaaatgttgtctactaggaaatctcattaaagactcagtgcctgagattttgttgggggctggtcacgtagccatcctcggcctagcacaaaccaaaattccagattcccagaaaaaattaggtgttcagtatcacccacactgtttgtacagttttggcacagcaagccacccttatcagttctgggaatgcgaacccttctaaattccagtttttaatatgccagccaatgaccaaccttgcaaggaggcctttccgaggataacagcctcaggactgttatgttaattctttaccgcacaggtatcctaactaatattttatataaatccagcaaaaataaaaaagaaaattcagaagaataatctgtttcaaaatttgtgaatgaccacccctcaggaatgacagagaggaaataaattagtggtggggctttagccatatctgtaacatttgaaacatttaaaacaaacatggaaaaatattgatagctgtttaattgtatgatatacacatgtctataattttatttttgttcatctgtataactttgaaatgtttcatttaaattaaaagatgaaaaaaacaaaaaaaaaaaatcatacaaacaagaaactatccctcatgaaagtatatcattaataacatttagaaaggactatgcagtggagaaacagctgcgaagcaactcaaatgtgccaacgttaagagaaaattttgtaaggtccaccagcgtatgtcacaaattaagtgacttttaaaaaaatctcctgaaaaatattttggaactataaagataatgggtaccataacagaggaaatctgggtttataccaatatttaatagccatcaaccagtcaatcaatcaatcacaaatgctccacacacaccactctaacaataaatgaaattacatagaactccaatttacaatagttgtttagcttacaattcacttatatttttctaatgataaggagagagagaaggaaaagaagagatgaatgtgtatacacacatataggcctgcaagaatgagagacagaaacgagtggagaagagggcaggaaaaggagaggggaagcggaactgggaagaaataccatgaatacaaatgagagaaaatctatttctagtttccagcactaattcaggtattttcaaatctcaagtgtactagaggggcaaatgtctttaaactacatttaaataagtaggaagcactagaagagttacagaataatcagaaccctatagtactaatttgagaaggatggcataagaatcacattacaaaagattaaccatattaactaactttaaaaaagtctctgggattcttcatgactacttttagttaaaataataataagtacatttatttgtgatgacggcaccaatgatgctattctaaatactttatcttattaattctcaaaagaacccagtgaggaagacacttgtctttccccattttacatgtgtgaaaactgaggcacagaaagttaaaataaattgtcttagatggagcctgaattcactcaggcagactacatccaaagcttttatttttaactttactcattttgacacttcatttcctattatctcatactttatgaaaacataatattcaactaaaaataactacatttcctatactgattactcatgactttggcaaagcaaatgttattatacaggaaggagcaaaagggtatgtttctcctgtgaattaagagaaggcttcagtagcatttctcccataccagtattccaaagcatagcaaaaacacctgtctgggaaagcgctttatttcctaagctgttctataaatacctgaaagctattttaaaaacaaaaataaaacataaaccgttcctgaaaacttccatgcctttctaacttcccaatggtgactcctttttcctaggttcctagaaaaaattaaaaaaaaaaaaaaaactggctaaactttttttttaaagcttcttttatattctgggaaatgaaaaatgattatgagcttactatgagctaacaaccctagataattgtactgatggatttataagaccccaaacaaggaaaatgatcttcccactgcagtttgcacattggtccacatctgtgacactatgtttagttacgggtaacatcactgaaatggggcatttggaataaaggaccaggttagagggaagaaagggtagttagagggaagaaagaataaagggtagttagagggaagaaaatccatctttttgtgtaatttgtgtatattgtatattacgtgtatattttcacttctaaaatactaaacatatttactttgtgtatattgtctctctcccattgctcaaattggtattagccaacccaagctacagagttgagagatggagaagaacaggaggaaaaggagagtgtttttggcaaaagaaatggcattcccaaaggcccacactgaagataaagcttagcagtccaggcactgaaatttcagagcagctggggtgtagacagtgaaagaaattggtaagtgaaagcccttgtgagtcaggacaagaagggctggatgggaggtcaggggagtcatgagaggccaatgaaacattttaagcagggaccaaatctctgtgactacagttagataataaactttacttgcgccatttgaaattgttaatattcaactgttttagacctacaaaaatggcaactacgcatcatttaactccattaaaaccttcctgaaaggaagcaggactagaaaaccagggaagtgttcaatagtgaaggttaaaaaaaaacaaaacccacaatatggtttcagtgaaaatattgaaaatattgttattggagcagagtaacatgatgacaacctgtcaaggctattacagatgcgatacttctgcaggaaaaaaaaattaagaagataacctacaatctgattttaagatcctgaaaacgcgtagaaaacacaataacaaattctaaccaccccacgctatttttacaatttaaaaaatgctgtacttttactctttctcttaaaaaatatgtatgttccaggtgcgtggccctatgctgagcacatgagtataaagatgtttcgaggatcttaaaacctaacatttccatctggatagtggctgcaagtgcaacagagaagtgaccccttagacctcactgctaatggcagaatgaggaccagaactcatattccctgactcctggagaccagggcccctcccactgtaccatcctgctgatatttcataggcttcacctgagataggcagctgtgtctcttagtctacacattccatctcgaaacaagaggaagggcaagcatacataattaatgatggcactgtaactttccacagcctttatatttctatatctattttctccatgtatagccttgtccatcaccaccctatcccatcacaaacttcctacatatttaaaaaaaatccacccccttaatccaaagtagtgggaatattatatgcatacatcatagcagtattttgcacttgaaattcattgcttcaaagcatcttgataatttttcttgtctctacctgaccctaaattgcactggggtaagatgctagctaggtttaaggcacacactagttttcttcaagaacagttctttttaaaagaggaaaagaatagaagagaagccaaggggatagaggaatataaattttttcactgacttctttgcctaaagaggaaaagaatagaagagaagccaaggggataggggaatataaattttttcactgacttctttgcctaaaacaaatttttttcactttatttttactctaagttaattcaaagataattggaaatagctgacttttagttttaggaggaactagaaaagaaattttgatgtactctttgtcttcaaaagagtatgagtaaaaaaaattcttctacccatcggattttttttttttttctttttttttttctgagatggagtctcaccctgtcgcccaggctggagtgcaatggcgcaatctcagctcactacaacctctgcctcccaggttcaaatgattctcctgcctcagcctcccgagtagctgggattacaggcacctgccaccacacccagctaagttttgtatttttagtagaggtggggtttcaccatgttggtcaggctggtctcgaactcctgacctcgtgatccacccacctcggccgcccaaagtgctgggattacaggcgtgagccaccgcgcctggcctccatcagatattttgcaacagaaatattagtttccatctccttccttcatataatctcgatatgttagattaggattggagtctgctgtgggatattatatagacttggaaccagaatagataagataacttggactaaaatgcccactacttctctcagactaacacatttcctctttgttgttttaaattttttccaaatatgtaagtaataaatgaatacataattgaattttaaaattcatgcaataaaagatgagcaaaagtcttcccttagcatcccacctcccaattactatcccattcgcaaaggaagtcagtatctgtgctatcactgtcaccaattttgtcattaaaaatcaagagctaaatcttgttaccttcaaacgtaatattttgacatatgatgataacatatataatcctttccatatacagaatatttaagtaaagtcacaaccaggaaaataaaaaagatgtagagatcacttatatcattttattaataagatagtatatacttacttttaaatacatgtaatgtctgctggattaatgaactgatgatccaggctaggaaagaaggttaagaacaacagctcttcagcatctataactagattaaattatcagcacaaaccatgtattgaatttctggaatttgttttattaagaaactaaatttgaaaacaagctgtactcatgcaaaggacagtagaagattaaaagtaaactgtctaaacagtctatatctggatgtaaataccagctcactcttttctttttccacactgattttcccacaggaaggaacagattaaagagtggattacttcaagcactataaaggtctctagactgaccccactcttagagggagctctttcagaggaataatgctataaagaacagtgaaagccccaaaaaacccacagctgagcccttcagagggccccattcacagtcaccattgactgccctggcctctctgaggggattcaatataattcactgcccaccagaatactgaattcacaacagagaggaaaaaaaaaactgatggtgctgctttgcatctgtttaaatttttacagaaatgttaagggagttaatcttctacaagtccagtcatgtgctttcacaaagggccaagaaaggagtcccaaagctcgccatgactcaacaggaagctctttgtgtcttcctttctacaccatgtctgacaaagaagctgtcttaagttcatgggcctctgtctcttgcgtgaattctgaagtcagtgaagcaacaatgatgtcattgcttctgaagaccactgttggctgagataatgaagatctcttcacccaaaacattgccatttctgcagcatacatttcctaccctttcaaatacaaaagtattctaccgattgaggggggtgatgtatgtttattttttgcattattcaaaagaagtcatactgaagcatgtttccctctcaccaaaacatcttctaaaactgaactagtaaataccactacactaaaatagttgattcatacacttgaaaggaaaccaaaagttatgcttttgaaattagatatattattcaattaatattctgatactaaatgtccagtagtttcataggcaacatatggtatgacgtgaataaaatccatttctcacccttttagtctccaacatatacgcacatttggctttttttttttttggagatggagtttcactcttgttgcccaggctgagtgcagtggcacgatctcgactcactgcaacctccgcctcctgggtgcaagctattctcctgcctcagcctctggagtagctaggattacaggcatgtgccactacacctggctaatttttgtatttttagtagagatggggtttcaccatgtcgatcaggctggtctcaaactcctgacctcaggtgatccacctgcctcggcctcccaaagtgctgagattacaggtgggagcccagctgcacatatggcaaaagcaaattagattatctaaagaatatcaaatagtttaaaggcagttatttccacaaattttaaaaatgatagactcctttgaaaacaactcaaatatggacatattcaactcatatatccatatatgcagtctagcatgtataaggacaaaaaaaggcaaggttaaaaaaataagtgtttaggcaattggaagttcagcagaaccaaaataatgagtgtatactggggagtggcgtcccttatgaataatgagataaaatagataaactatggaagtaccaggcaatggaggacaaatataaaaaatttatattttatccaatagggagttgggagccactaaacatttttagattaataaatgacaaagtatttcagtttacaacaatgactacatcttcaatcaaaagcagcaatctccaaagcagagattgcaaacacatacaacaacatttactggagtatggggaaaaagaatctctatagttctctttattacagtcttgaaaatttatagctccatgaaagttctacaatacataggatgcatgttccataatgtataaatgatagtagtatatttgtgtgtgtgtgtgtgtgtgcatatacacacgcatgtgctgtggatacatggtccacaacatttggtaaccttctatctcaaaatggaatagagggagataggtttagaagcaggaaaacagtttaggatactgctgcagtatttgaaacaaaaagtattaggctctgaacgaaagtggaaacaacagaccctgggccattttcttgagagctatctggatgtaaaatttgtgggtactgcttaccaactggataagggttgtgaaaatcaggaagttaactgggtggatgttggtttcatttactaaaactggaatataagaggaaaggataaagaaggagtagtccagaaactggtggagggttagaaacaaactcaatgttagccagtctgagtcacaggtatctgtggaggaccttaaagagaggtaaggtaaggaaaaagcaaatgtaacagcacagttttctcatcaaagattttatttattttgcaagtaaatcagataggagaagctaaaaaacagatttcaatgaattaagaattaaaaacatgaagtaacataataacatggtatatgacaaagtatgaaaatcaacataacttgatattttataagaactataaaatatcaggaaaaaaactttcagagaaaaaaaagaaatgatgacacccacactggataatgaacactaagtggaggtgacaagaagacactgcagatgcagaagggaatatgactatatttacagaaagaacaagcaggggagacgatgaggaagcctagctaactgcatcccacactacatcagagcaggcatcatatgctctcttttccttccataaagatggacacatgacattacttttaaagcacattatgttggggtatttataactatgatgtaatgacttaaattttaaatattctgctttctggatttacaaaagtactaagtaatatatataaaacaaagaacccttatttttgctccatttctgaatcttatactcagagattaggtaggagtcaggggatagcctacggaatgctgttgcgcttttattttaaaatttctaaaattaaaagtgaaatggtcataatgatcatgaacaacctcaagttaaagcagcccccataaaaatgtctgccctgattcttaaaatgggctcagccaaatccactcctttttcacattggagttgacacatttcatgccctcatcacctctcacctggattagtactccagggaaaaacactccaagctcttttccctgcctctactctctcactcctctctatactccaagagtgtattctgcattccacatgaatggaagacagattttctaaaatacatattatagtacataacttctgtgagtatatttttttaaacttgtaaaatagggttcttcataatctggcattaaccgttcttacccgagacaaatataagaaaagtatatcagccgggcgcagtggctcacaccgtaatcctagcactttgggaggccgaggtgggtggatcatgtaaggtcatgagttcgagaccagcctggccaacatggtgaaacctgtctctaccaaaagtacaataaattagccaggtgccgtggcgggtgcttgtaatcccagctactcaggaacctaaggcaggagaattgcttgaaccagggaggtggaggctgcagtgagctgagattgcgcaactgcattccagcctgggcgacagggtgagactctattacacacacacacacacacacacacacacaaagaaagaaaagtatatcaactatagttttggctgtcgtaagacaggaaaaggggagaggaaaacaggagagaaactgtgagctgactgcccatcttgtgtagggcaccatatcattagcagcatcttgagacacacagaagtttagttttatagatgaggcagtgatatctaaagaggcttcctaaagttctgcaagtgacagagctgataattgcagagctgtgatttgaacacatgtctttctgatcacaaaacctatactagagaagaccatggatattcagtgaacatacctgaagctacaaaaagagcatcccttgtaaactatgtaggatacaatttaatgtaaaaaaaaaatcactactgcattgtagaagaaggagacccaaaacaactgatcaaagatagtaagggataaggagcctacactgaggttatcaggagacaaaagaaaatttaaagaaacaatctgctatgaagtgtcatcatgaagaggaccaggaaaataagtcctgagaacaacaatctgttgaaatttttaggtctctgcggaaaactatttatataaattgctgaggatgagagccatgttgagggggagctctataacagataaagggtgcaaaacaaaaaatgttctttagagaaatgtggtaacaatgttgataaaataaaagtatctgccaggcgtggtggctcacttctgtaatcccagcactttgggaggccaaggcaggtggatcacctgaggtcaggaggtcaagaccagcctggccaacatggagaaaccccgtctctactaaaaatacaaaaaataaataaataaataaaaataggtgggcatagtaacgcacaactgtaataccagctacttgggaggctgagacaggagaattgcttgaacctgggaagcggaggttgcagtgagctgagatcgtgccactgcactccagcctgggtgacagagtgagactccatctaaaataaataaataaatacatacatacataaataaaagtatctacaaaggatgaaaggacccaaattcaaccagatatttatgaagacaaaggacacttttatcatcttgaagactcatgcacatctttatgaaagttcataagatgaaaacaaaagagaaagaaacgtgtgacaccagtgactaagtaagcaagttctacatcctaaatctggaggaccccacaaactacctcttctgtgctatgcatcccactcctgagtcccattcaacccctaccctccaacagtgaaaagaatacagcccggagacttcattacacagtctgggtttgataaccagacatctaaggtgataagtgcaatttcagattacctttcttgtaattttcatctacaaattgcagagaatctttgacagtacaggccttcttctatgtcacactagttgttctacttcatttttcaccttccctaaaaattttagttgagagcttttttgttcagttttaaaagtacttgcaaagctttcactttattatctaattaaaaatgtggagaaaatgtttaagttatttttctggccatgcgtgagccatcagaatctgagcactttgtgaggctttggtgggaggattgcttgagaccgggagtttgagaccagcctgggcaacatagtgagacctcatctctacaaaaaaagtaaaagaaattagctgagtgtggtggtgcacacctgtagtcccagttactggggaggctaaggtaagaggattgcttaaatccaggagtttgaggttgcagtgagctatgattatgccaccgcactccagcctgggcaatagaacaacactcttctctgaaaaagaaaaaattatttttctcagcaaggttcttaacatttctgagtatcagagtcactcatcattcatttgttcaatcaatatttattgaagacctaccctgggctaggtactgtgctagacccttgagtaagcaatgttgaacaaaaaggaaaaattggggtaattccacctattttatataattcttgggagactcaaatgaaataagttttcaggaggaacttagaaaactgtcaagaagttatatatatgtgtatatatacacacacggtgtgtacgcatatgtgtgtatatacacacacggtgtgtacgcatatgtgtgtatatatatacacacacggtgtgtacgcatatgtgtgtatatatatacacacacggtgtgtatatacgtgtgtatatatatacacacacggtgtgtatatacgtgtgtatatatacacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacatggtgtgtatatacgtgtgtatatatgcacacatggtgtgtatatacgtgtgtatatatgcacacatggtgtgtatatatatgtgtgtatatatgcacacatggtatgtatatgtgtgtatatatgcacacatggtgtgtatgtatatgtgtgtatatatgcacacatggtgtgtatatacgtgtgtatatatgcacacatggtgtgtgtgtatatacgtgtgtatatatgcacacatggtgtgtgtatatatacacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatacacatggtgggtatatgtatgtgtgtatagatatacacatggtgtgtatatatatgtgtatatatctgtgtattggacatatgtatgtatatattggatatatatattggacatacatatattggacatatatatatatacacatatatatatgtattggacagtgtgggtctaggtgtacacacactatggtgcaaatcctagacccacactgtccaatacaggggccattagtcgtatgcaactatataaatttgaatgaattaaaattcaataaaaataaaagttcagttcatcagttacactagtcacatctcaatagctacatatgaccagtggctaccataccggacagcactaatttagaacacttccatcatcacgtaaaatcctattggacagcagtttcctaaaagctgggagtagaaacatgaaacagaacatctgaatgatgccagggttgagcagtaaatgatactatgtgaaaatatgctatgggctgggcacggtggctcacacctgtaatcccagcactttgggaggctgaggtgggtggatcacctgaggtctggagttcaagaccagcctggccaacacagtgaaaccccgtctctactaaaaatacaaaaattagctgggcatggtggcaggctcctgtaatcccagctacttggtaggctgaggtaggagaatcacttgaactgggggggtggaggttgcagtgggctgagatcgcgccactgcactccagcctgggcgacagagagatactctgtctcaaaaaaaaaaaaaaaaaaaaaagaaaagaaaaaaaaagagtgaaagaaaggaagaaagaaagaaaatatgctacaaatcacatgctcaaagaaagatggctgataattctttataagattataaaaccatcacaaaggaaagatgtagttgtgatttaagaaaaaaagtcagagataacttattgacagcttactaagaaactaaagctaattgctttaagtcaatattagatttaatccaaagaacaatgcttgaagtaagcattattattttctctgccttgtagatgaggaatcgtaagcactgataggttaagtaacttgaccaaggttacaaaactatttaatggtaagcctttgaaataaactctactaaaagaaaagaaatatttacgtaacaataatatctaagacactgaatcgatctcattgaattagttattatgaaaacagcatcaaggtaatatatcactatgtgcttttttactttcagtgattaagagttattgataataatattttcaccatactatcaccattagttagttctctaaactttgtcttctttccttgtcttctttcctcaggaatggcctcctttctcccagtcattgtatcttgaatcaaaacccaagcatctttgaatattcacatgaagtccctaaaacacttgagccttcactgttatctctaaagtcacacaacatatattttctagatcattcactataatgcgaattgcacaatgatttggttttaatgccaatctttactgaagtatgctatactatttgatgaaagagcatatactgagcatctgataaataaatgataacaataacataccttgcatcaagaataccataggtgttcatctaaaatttatcatttgtaatttaatattgtcttcacagtttttgaaggcataaaatataaacactcagtttatctctaataagtgctttagttttctcatgaattagctgaaacatgttagctcttttttcctttctgtaatataggaaataataaagattattaaagagatatatgttagatagtcttgtatcaaaaaagtccatgcttagattcattatttctttagtattataaagacccagaatgaaggtctaatctcaaaactagctgaagagatcagattcaaatgtcggaatctgtttttacagaatatccttggcaaagtttactctaagaaatgtaacacagttggactgtcttcctttggctataaaacatctttcataggaatgtccattaaggtctgggaggtggtgtggggggagtgtctcaatgcaaagtgttcttacgttaatcaaaatatatttacggaaatagttgcttatacctaggtcttatattttagtccctatacctggaaataccagggggtattcccaaaggactgaacactgagcacttatggtttctcatcctcatttgtttattagtttctctgctgtataacacagtcaaagtgttctttaagctttagtcactggaactgggtacctaaagtaagaaactgccatcatgtttggtcttaatttttcctttgtttttgccaagaattgaagaagactaaaacagatgatctctctatttgtactgagtgaggcctggacatggtacttctgtcacttttctatctctggataaaaagttagaaaaatctgcaaaagtaagtatatggcttcatggtgaccacattaatactatctactctctgatgtgcatagataaccctaagcagttttaacagtatcaaaaataaaatataatgtttctatattcatgaagaaaatttgattcctttttactcacacataaaattctgtggaatttgggataaaactcaatatctgcagatattagatggaaaaaaaataagagtcaagtagtattaagatcccaaatttggatatacagacaatcagaaaactgaaaattccaaggttctcctagttacttatgatgtcaaagctatatttgtgatgttataagtgaaaaatcatgtggtaaggtgtgcttgagttatgcagaaaaatttattttttctaacattaattttattcttaacactattttttgctattttgcatttgacattttatcattcctcatcccaacttagagataaaaaaattttttaaaataaaaagctcctaacaagagtcctttcagcaacccttgaacacatagggtttctgcaactgtaacaatttgaaactacaacaacgtcaaccacataaatattagaacttgcacaatgggaataattttggaaaatatttctccctgactttgtgtgtagataacctacttaataatcagccctcagaaatggctgggaggctttgagtcaatggagagaaaagggaagggatggagaatattacatactagaattcttgcatgaagaataaaaaagaaacaaataaatagaaagacatcccatgtccatgcgttggaaaagttattgttaaaacgtccatactgcttaaaatacccaatatgacctacagattctatgcaatccctattaagatgccagtggcattttttacggacatagaaaaaacaattacaaaattcctgtgaaaccacagaggacccttggtagccaaaataatctttacaacaaagaacaaagctggaagcatcatactatgggacttcaaaatctataaccaagcaaccatgaccaaatcaatataatattggcataaaaacagacagactaatggaacagaacagacagcccagaaataaacccacacatatatggtcaaatggtcctccacaaaaatacacaatggggaaaggagagtctcctcaatgaatggtattgggaaaagtgaatatacacatgcaaaagaatgtaattgaaccctcatcttacaccataaacaaaaatcaaccccagatggattgaagacttaaatgtaagaactgaaactataaaactcctaggagaaagcaaaaaaacttcgtgatattgatcttcacaacgatttgctagttatgaccccaaaagcacaggcaacaaaagccaaaatagacaaataggactacatcaaactaaaaagcttctacacagcaaaggaaaaattaacagggtgaaaaggaaacctatagaatgggagaaaatatttgcaaaccatatatctgatatgagaataatatccaaaaaatctaaagaactccttcaactcagtagcaaaacaaacaagcaaacaaaacacacacacacacacacacacacacacacacacaaaacacacaaaataactcgattaaagaatgggtgaaggacttgaatagacaattcttctgtgtaaaacagaccaacagacatatgaaaagatactcagcatcactaatcagggaaataacaatcaaaacagaagtgagatattacataacacctgttagaatgcctgtggtaagaaaaataagtattgaggagatgtagagaaaagggaacacttgcactgttggtgtgaatgtaaatagtgcagttcctagagaaaataaactatgttgaggctcctgagaatattaaaaaatagaactaccatatgatccagatatctcacttcagggcatatatccaaaagaactgaaatcaggaccttgaagaaatatttgcaacctggtgttcacttcagcattattcacaatatcgaagatgtggaaacaacctaaatgttcactgatagatgaatagataaagaaaatgtggtatatatatacatggaatattatccttttaacaaaggatagatctcatgttaagcattcttaacacaatataaaaaaatataaagagactcaatattcagctcctggattcaagtaatatttaaaaaaaacagatttgtaagctaggttgtgttaagagagaaagaattttcttaatacttagttctcacacagtacattaatggtaggcctggagactatatcacaaactttttaaatttgttttggttttgttttcctgttgggtagagaaagtcctgtttatcataagtcttagtcattagtctggattagtgaagaaaaagcatataattagaagaaggaaaatacaagcctagcccttttggtcttaggatgcctctggatgagggaaataaacagaactgggaagacaatggttgtaatttcttcccagttcccttcaaggccaagtctcagatggggagagataggattaagcatacaggattaaaatacaggatttttacatacagattcaagggtcaggcagaggttctttaatttggattaaagaggctaaaatatgcaaatcatcaaggaactgtaagagccaaagccttttctcctactctgttttggagattctggaagaacactttatgggcggctaggacatcactctgttcacaatctaagaagctgtgactccccacaattcttgtgcaacaagaacagcaatgtctgagtctcctggggagcctgtgagagagggctgctgaatcagtgtcaatgtgggtcccataccagaagctgtgagtgagtggatcatataggctggacaaatagcagtcccagccataactcagggtggtttgctgtactaatgacagcagactatatagtcaagctggcagtaaataccaacagggctagcagataccatgcaaaaaagatagccagcccagcaatgcctacttggccagccacaggaacccatactatggttaatataggataatttcatatagaaattttaatagacataagatgcattcaacattgtaagataacggaactactttttcctgtttttttctttgttttatccttgaacatttgtaaagaattaatatgtaccacaatgaaatccttttattaataaaatgactgttcattttgtagtctctactacttatagtaaattcttcgcttcccatttacttaattcctatttgaaatataaaacttgaagttaattcaaactatctgagttagttgctttagtgtagttgtcattaggtagtgaaaggaagaaatgggaacgaatgatgcttttatgtacactgcaagtgggctgagcaaatattcaggtcctgagtctcaatataatgggggccacaatcaggaaatatgacaaatccaaataaagtagggtttttattccacaataagaatccaggtgattgttataataattttgtccaatttatgtgtttcaaactgcaaatctataaaaatagtcccaatatgtttcagagatgcccattaataatatgtgtaagtctgagctggcagcattttagaacactgcttccacatatttaagaggaagggtgctggtgagtgacaaaatgataccctgcagagaacttagatgatagcaacctaaggtgaaccacacaaacgcttctactgatttttcaaatgttgggtcaccaaagagaaagggatattaaaggagacaaaaacaacatatcccagcctgattaacttaataccttctttaaacataattagaaagatccatttactgtacatagtagtgatgtccacaagggcttcccatgagacctagaagccaaggccaggcatactaaatgaggaaagacaatgtatatcttcatatattcccatactggctttccctatatgttatccaaaagttaggtatgatgaaattaaaaaaaatggttctaataccccaatttccattagtagaagactctttagggacactgtattaatacaagtatcatagaacaggacataaagaaaatctgcttttattatttgtttcaccttttggtgagacaagaacctctgggcttagacatggcttttatccctgtagcacatggaataaaacctgacgaaacttgaaaacataaaaacaaaacctgccaaagtgctgataaagaggactgaacttagggagcaaaatattttagtatccctgagacttgacaataaaagaatacatagcaatttgtaaagcacactagagagaaccaaggccttccacaggaaatgggtgataaatgcttagaactaaagacagtcctgtgagaaagaatggccacaaagacttaagatgtttgatattatcagagctctcaaataaaaaatatctcaggtcaaaagcactgaacaagttagagtgggggcatgtaagtggttacagtagttctgaaagatgaaaaaacttcttttcattcagacttgtaaaacatttttttcatatacttagtaaggtgctgaaagtacaggaatatgctgtatatagttggttgtttatgacaatctcaatacaatcttattgagggaaatagctccaatcattcctgaaacaaatgcttccagtatatagtcccaaattcaagaaattccactgagaagttttaaatttagatatttagaccagacaggttacagttgaaaattagagtaaaatttctagtatctagaaagaacaaaagcaagtattcagctcctgttacaaaattatgcattaaaggagcatttgttttagcctatgtgtagttctcacatttaaattgacagtaaactcatgtaaactcaaacaattttcaaataaaaatattatttcagagccacatttatttttcccacattttctttttctttaacagacaccatcaacctttaccccatatatcaggaagatgcccggtagaagactcatatgaaaaagatcctctgaagacagagggtagtgagaataacctaactgaatcctccacagagacataggaggtgcacacacacacatacacacactcatgcacacacacagacacacaatttgcaaaatcctaaatgaacatgttcaagagtggatagtattgattctcataaataaatattatgtttaaagttaatgcttgatgatccagcaaggaaaataaaacaatgacaggaaaataaatgacatctaatttatagaaaattatcttttaaaaatatattcagcacctgagttataaataaaaatgatgaaacaaaagattattaaacctccagaaacgtctggattcctaacacaaatgcttcccacttactaacatgaaagtttataaatcattgtacctggaaaaaaaaaaaaagaagtacaggctttaaaatgtggttaacgtggaatactatgcagccataaaaaaggatgagttcatgtcctttgcagggatatggatgaagctggaaaccatcattctcagcaaactatcacaagaccataaaaccaaacaccatgaacaataacaacacatggacacagggaggagaacatcacacaccagggccggtcggggggtgggggcctaggggagggataacattgggagaaatacctaatgtaggtgatgggttgaggggtgcaacaaactaccaggtcacgtgtatacctatgtaacaaaactgcaggttctgcacatgtaacccagaacttaaagtataataaaaaataaaataaaataaaaataaaataaaatgtggttaaggaggcacgcttggcatgagcagagtcaaaatgtactcaaaatttttcttaaaaaagggtctatccctcctaagcaaaagcagttgacatgcgagaaagcaaacactacattttgataatagagtgtgttttatattgaaaaggagcaattacattttaaatactagcaaagctttttcctggtatgaactgcttcctcatgaatcagtaattgatacagcttttttctgagtaggcaattacttaatttaagaatcaagatctggcccaaattatctgaattggctttctaccctgatgtatgtttactgccttcaatttcacttcagtcagtcaaacatatttaaaacctcccagttctctttctccattaatgcaagatcaagaactaaatagtaatcctgagctctgaagtctcaacacattttgcgtcttttcatcttcaattctttattggaaaaaaaaatatagagttacatttgtaacactttaatcctggtctatctatctcctaaataagctcttttcattgaacctattcatacagagacagaagaaactcagtaaggcaatttaatgaaaaaaataaagtattatcctttatgtttcacatatgaaagctctttaaccttcactctgattcctattttatgtaataagtcaatcttcatattgccttcattttgtcaataattgttataaataccccaactgtgaaacatacaaaactaaccagacaacagattccataaatatgattagtatttccacatgaattcaatagtaatagccttgacaaatgattggctgctaaataagatgatgcaggtgtaaaaattttgtaatttaacacttacccaaaataatgattgctacttgatcttagtaatttagtaatattatgttccatacttcatttactaaaaaatgtctgctgaaattaatttctattgttcaatatttgtgtgggttacaaagcccaccaatgattctctttgattagggcataggtcatgagaacttccaaatacagcaggttagagtatatactgacatgtctacagattcaaggaagggctctgggcctaggaagtccctaggagcaataaaataagaaataatcttctcgtttttctagttcttgtttcatagtttcattccctggcaaccagcagcaactcccaaatcatttctgacttctacatgtttcccacctgggacaaaaacacgccttcacagcaccatgacaaccacaccagcaacacaagcactcgggttcatgcaggaaaatgaaaatcctgaaaggaagctaggagataaaggctcactattccttgtttcccactggtaggatgtaattacaaaaattactttaacacaaagcttctggtgaatgaatagtgggtaatttgaggggagaagcctagggcctagggattaaattaaaaatgtaaaatgctgaatgatgtcatacaagttcagccaccttcccccaaaaaagtagactgcctaaagcaaactccttaatgatgacagagtaaacattcttatgagataggcaggggtatatttttttacatgagtttagacaaatgattgatttaatagtagaggtgaaatttatgaccctttaatttttattaagtatattgttaccaattagagtttcaaatataattttgtccaaattaaagagtttcaaaatgtcatttccatgcccctaaatctgaaaaagaagcaaattaaacatgcctaccatgatgaagtagacaaatttctttgtcataagcatgccaagtttatgttttttgtgtaatgaaaaggatgctattcgtttgctagaaactggcagtgctatgtgttatgaatacttgccacttctgcactagaagacaccattatttatattgccaaatgtaaaactgctttagatcttattctttaaagagtaattctaaagcagagcactgcatttttgacttaaaaaaacatatttttaaacaactcttcatatgtttcacattgtgaaaacaatacaacttttctattaagagtcaaggaagaagaatccgctatatatgggattgattgattgtttttgtgttgttgaatcgtaccatatgacacattatcttaacagtttcaaagctgtgacttttgttggaaactcagctgaatattcttaggtgacaggaaatagaaatagatattttcatttggtcaagcggaatagcttagggctccagagtgtgggagaagcacaatttttgttttgcttctagttttaatcttgttttctggagacataaagtcctccttatctatagcaaatatctttcataggctcccaattctgtgcagtgtataccttcagattctcagtgatacacctgagaatgacagagtagaaggcaagaaggggcattctaaccatcaacgagccaataactgctacctcactctcaagctaatctctacccatccctaccacaagaaatgtttagaaggccattcatactttgcctctgggacatgaatatgaaaatacaccattttgaaaattcactcagtgttctaaaagatcatctatcctaatctactcaaattggaccaacttatcatcctcctttatcaagcctatttctgtttctcattttatatacctgaattctggaaagagaattctctagtcttctagattagaattctgagtcctccttaaacaatctctctctctttccccatgccctccaacatctatcccatcacaaaactccatcagttttccttcaatttctacccacttggttctatctctccatcatctagttcaggtcctaatagattttaatgtataacacttgcaacaaactacagaactcaaatgaatggcagttctgaggaactaaactgccaaatcaagaaatgtagctagccaattactgtgacaactagcaaaatagggcagaatattacatgggccttactgatgaaatcttgcagggtcagaaatggcttgcttatgatcaaaactcctactgatgacttgctgtcagagaaatgtatggagaccatggttctcaaacacatttcattccatgtaaggcttagcttatggattttattcctcttcctaaataactcattaagaaagacctcatatgtttcctaaaataaaatcttgaattaatccagaaaaggcactattttatatagtgctttggttttcatttataaatcaatatatcttcctaaacctaatttttttcaattttaaattttaaaataatggaatacattacaaaaatatgttcttaatttacagttggaaggtatttgatctatgagaagacttggctctccatcttgctaccaagaagttaaaggaagaatttgaaagttctgaatctgaatcacttgttcccctaggcaagagagttgcacttctaacatatatggttacaattcaagattctcaaaagaaggtaaattcatatcacccacaacttaattcaatcagaacttcataaataagaaggtgaagatcattaagctcatattaacgtttatcatggaacattttaagagaactgaatgattcaattttgattcaagttttaaggtaattgagaggtgacaaaagaactccttttgctctgacccatgaccattgaaacttgtctcaaaatatattactctagttggtggcctacttcaactataattgcaatcttctattcatgactgaaaaactcagtcttcagtgtctgcattattaaaaagaaattttaagtaaactgagtatgttgatgctattgaaattgacattttaaataattttctaaagcaatgtcccaaatttctgtaattccatccaattcctttgtatatacatacgctgttaatttccctattctatcatctaaaaatacaataagtattaaacataatatttcttgtaactttattacttcaagaaaaaaactcttcttcttataaatatcagactaatgaaaagtactagggctaatatttatagaaatagataccttcaggaattgaaatgtagtaatagggtacagcctgatgaaactacagttatgacagatggacctgatgggaggacagacacagtaactgatctggcttccagttctcctatacaattccatagcatgtggcctatgcgttcctaaaaaatatttaaccattgctttgaaagaggtattaggtattagtaatatggaacaaccaagatttagatattagtaatatggaacaaccaagaaaaatcactctaacctactatcttttccttaacataaccagtcttctgatttagaataacattttaagaatatgaaaattgagtattcacatgaagacaatgactaatgcttcaactttaacaaaactcttaacatgcaaaccttctgcaaagatattaaatattaacaggcaattaaataacagctagcattcattaagcacctatttttgttgaatactaccttcagcaatttgcatatacatctaatattattacaactgtgcaatatatattacttcttttttcattaaaaaactgaggctcagagaggttaagtactaatctaaggtaacagaacaacttggtgtgcagagctattattactcataccaagtctaactgcaaagcctctacagtgactctctaagctaggcatacatttcataatactgtatttattaatatagtcctgttgtttcaaatgagaaatttctttaaaattttcaagatatgttaactttaaagttatcttaaattgcactattctgttcataaataattttaggggaagttagtagcatctgaaaatcaaactaatgactaggtagcaagtctcaaaaggcaatctagaagacaaattatttctaaattacttatatttacttatatccatgtcatttccctaaaagaaaactctattcttcattaagaaagttgtcttggcaaatgtaaagacttcttgagatttggttaaaaaaaaaatagattcctaaatttttttttctccccaaaggaaattttatatccaatgtataagcatatctccttaatagtaagttactttcaggtttcatttaaacaaacaaaaatagaaaactttgatgcaacataatttacttgactttagcagttctagcctaatttgaaataaaattccacagaagaatttcattcattgtctcctccatctagtaaaagttttgccaaatagattttaaagacaagtggcatattattttcaaatatatccatcacactggtcttaaaacaaaaagcaactgtttgccatcctagtatacatcctttaaaaggtttaaaataacagtgataattcataattaagatacttctgtaaaatacaaaccacaaagattttcaaattttaacataagctagagaaccaatagttttaatataaaggtattaaaagaagtcatatcagggatatataacacactggaataaatatctgtaacatatactctatgcattttttaaaaagcaagccacatttcatgatttataaatgtaaacttctttttctatctccgcgttatacaagagaacatggcaatcacattctcttacttgatgggagagttgttttcatcatatcttaaaattatatttcattattaagctttgtcaagacgcctacctctgtagtggaagtctttggacatgtctatgggagcctgttctacagctgatctcttgtagacaacatgaatccttcctttttcttcctccatctgtttacctctttccaagggttcaatgaaatactcttcattatcactttttatcattccagcctagagaaagcacaaaatgtgttaatttaaaaaagaaatatctatcatcttcagctcacaagcacatctttttaaatgtcaagaatatgacttgtgaaaactaacgctttttctttccacatttggccataacttaaaatagttttattaactatcaataattaattcatataaggtagaaattcacatatgacagaaatgaaaaattcatattaaggtattacggaatacaaaatttacataggataagaatagggaaatcatacaatgtatatattttatcaaactgcaaaataagtgcatttatatattctacttggtattttatatctagtaagaatcatatgggacacataaattcaaaaaatctctaatttcccaaaataacccattgtggagcagtggtccaaacgttacatacatttttacttatttacatcttcccaccaaacaaagtggcatgagagaaatgagttccatgctaccttcagtatgtaaagttatttctttaaaatagtctcattaagcttctgtggaaatccccatttctaaagtttattcatttgaagaactaactcatatttgtcctagcttaatctaactttatgatttaaattataactttaatattatatatatatatccccctcaaactgcatcctttcacactgaaaagcctactcttgctttcaattccttccatctctctatttattgttttctgattctgtttcatcttttaattattcagaaaacaccagggctatagccagtactatagctgaagaaaaatgatgtttttttctaaaatgcgatatttcttaaacatcaagtccacattacagtcaagtagttgtggctcgtgtttctactttaaacatcatacaataatacgaaatattaatttaaatataagcacatttatttgaaaacaaaattcaaacaaataatgtcttagtgtggaaactgtacttattttggaaatatatatcagatttagagatgccatattttttctcaaacctttaacttattctgtattttcacacaagaggtcactggctctcatgtaacacagacaagggaggagtttcttactccttcgaactatgttgatgtctttgccattatgctatcaagcaacatagaaataaaagggaggtgtcctttaccaaagagcatatgttttcagcaaatataaatataaatatatatattcatatatgtatataaataaataaatatatatatatttagcaaatatgcctatgactatagcttttctgtcacactcaaatctgtccttttcctttctgttctgacttctacacctgggtatagtatttcccttctttccctttgtaagcctcacagggaattcttaaaagctatgccatctccatatgccacttctacgcttgcctttatgatgtgcacatacaaacagccctggaacctatgcgaccgtgtctcacaagaaaacattactacaactcttctactattcttggcccataccctctggaacaaacctctagctttcacttaaaagagcattgagctagtgggtacttagtagtaatgctgatcttccagatactccaataattggagtttctttccttatctgactaattactttatacttagtcatgtactatgaaatgcacatatttttcaaaagttatataattattccctattcagagttgttcctattggttaatggattcacctcttctacaaatataatttccaacatcttcctcatgctttcaaattttaattttaatctattctatattatggtcatattattttatctcctattaccagtactttcaacactcactgctattggccttctcaggcattaattaattaatgtccataaaatacatccaaactaagcacaaacacagtaaatgtataaaaagttaataaaatgtataaggataaaatgttatctcatccctaacaccatctgctggtagcaaaaagcgtgaaccggctttatcccagaaagataggtctgtttaaatatatggaagtttataaggtgaagtgcatcagcatgggagtttcagtattcatctttattacagtcttttctttgccccaaatccgctgtcactgcattctgtaacatctacattattcgcccatcctcctaagtccactaacatttccttagttataaacatcatcattgtttattcggattacagaaactccctatcttaagattttccaaagatcataatgattctcccagatgagtgcctgactcagggaagaaacagtgccactgaagcggtcagcgactctgagcaatgcgcaatggctattgcagtcacttgaaagtgatagggagggcagtgaggattagcccatgggtcttttgaaaacacttctccatacctgctatggcaaacattcaaatttcaggccacatgatgttattttaccccactaagccacaggtaaaacaaaattcaacacaattaaacatctcacttagaaagcaaagaaaatttaagtcaaactgagtcagtattagtgacaaggcaagagttggatcaagtgacatccattaactccatggacccaaaatctgaaagtcggcccttttatttattaatttaagtaaagtttaatgaaagaaagtacttatataggctgggcgcagtggctcacacctgtaatcccagcattttgggacgccgagatgggcggatcatgaagtcaggagatcaagaccatcctggctaacacggtgaaaccctgtctctactaaaaatacaaaaaaaaatttgccaggcgtggtggcaggcgcctgtagtcccagctactcgggaggctgaggcaggagaatggcgtgaacccgggaggcggagcttgcagtgagccgagatcgcaccactgcactccagactgggcgacagagggagactccatctcaaaaaaaaaaaagtaagtactttatataaagcactgtactaaatatactaataaatgagaaatcctgcaagacagttcatttgtcctcatttgattaaatccagttgaataaataaaatacatgcctactgaaattcaatgagtatgctatggaaagtgcagaaaagtaattgacagggcagttgatagtaaaatcaagtaaaatttttttcctccataatctcaccagacacagaaaactgttagtaggaacagttgatttttcactcgaaattatctagtatctatttcaactgaaatgttcctagtccacatcacaataaaccttcgctttggccactgttactgtccacatgatctacatattcacatagtgtggcagccaaaattgccctttaaaattatcatattaaatttggacaaatctgaatttggtagcaagtggagcaagcatgtaagggctcaaaacatcaggtgcttctttctcactcacataaagctcaggatggttttggattggccaggaaaggtttctactccacacaatcatccaggagtccaggttgacagtggctctatcatcttaatataagcttccagtattcctagtcaaaacaggaagcagtatgagggagcccacatgggaaatttttatgagctagccctactcatggtattcaccatttccacttactgccacagataggatacagttgcatggctcacagccagctgcaaagagggccaggaaatgtaatctggctgtaagcccaggcagaagagacaaatggattttgatgaacagatggaagtctcaacctccaaaaagatcatgccactcctttgcttaaaacactttaattgcttcccattgcacttaaaactgcactcattactttggcctttaaggcccacgtcatctgcgctgcccaccatcctcaagtttgccattctcagtgtcctcacgaggccccaacctcaggggattttgttcaattttctttttctttttctatttccaaggtccttataacatcaggtctttgcaatgccattcattctgcttaaagagccacaccacacttccctaagctggctggtttttattctccaggcttcaacttaaatgttatctccttaaaatgattttcttactccctcacctcacaaaaatgaggtgcccccgtctaaattagatcctctcttagccaattattctaactgaaaataatgtgttcttttctctcctggtccttaacacaaatttcaagggtgtattcagctgaatgtgaaatttatggttctctgtctcccctgtggaactgttagctactaaggcacatatatctagcttagctcacctttgagccttaagctccatcaaaattgctcgcacaaaatatgtattcaataaagttctgatgaaaaattacatgaatgagtgaatgatacaaatgagggaatgaagagcttttagacttttggtgattttccaaatatgggagtattgctatagtggggatagaatagaaggaattagaggtgaggccgttcagggtggagcaaaggttctaaagcaagcttgtccaacctgtgtcctgtgggccacaggcagcccaggacagctttgaatgcagcccaacacaaattcgtaaactttcttaaaacgttatgagattttttgtgattatttttaagctcatcagctgtcgttagtatgagtgtattttatgtgtggccccagacaattcttcttccaatgtggcccacgaaagctaaaatactggacacccctgtaagtacaaaaactcctggcacacatgtggacagcaagcaagctattcattcagggaagagttcatgcaggggggctccaaaacaatgccacggaggactattagtactatcttgggtcagaattttaacatgtagaaacagagacccaaaaaataaataaataaaaaagaatgttgatcggatggactagaacaaaatactattttcatatttctctgatgattaagtgccagatggaagcaagcaagaagctaaaataacagtccagatagcaaaagtggcaatgggaagagaaaagggcaggggagtggggaaagaattaatttaaaagtgatttcaggaaaaaaaaagtggtaccttttaaaatgtaagctcctctattcaaaactttcgaaggtctccccttctcacctagattaataaccaaagttcctaccgagtccacctaggccctccctcatctcagcatcactgccttcaagactccatcaccgccttcaagactccaccacctctccggcctcatctgctcactctcttccttgctggcttcactccagccatgatgggctccttgctgattcttgaatacttaaggggtgtttcccctttaagacctttgcactggctctttcctctacttggaatcctcttcccctaggactatgcatggctaacattttcacctcctttaagtccttgcttaggtgttgcttctcaaagagcatacacggactacccatctgcttctcaacccagcaccccaagcctctttctctacactgttgtttccactgcacttactgtcctccgacacactcgatcacttaactgcctatcatgttcattgtttattgttagtaacccaccactgcccttctggtcaggaattacttcttggtctgctttgttcagcttgttcaactatttatctcaagtgcttaaagcaatacctggcataaactagacactcaataaatacctgataaatgaaaaaacaacaaagaaggaaggcataatctaaccttagttttgaagttggatgactatgaaattaatgttttcattcacagaaacagaaaagccaaaatggcaagctgactggaaggcaggagaaaaagttaatgcgttttgttttaaccattttcttgaaatagtgatggaaattcccagcattcagtggagaaatacagaattgtaattaagaaaaaaaaaagtcataaccgcaatggatttgggatacatcttctcaggggcaatagctaaagctgttaacagaaatgaagaagaaaagttcataaagagatttgagggaaggtcaatagagaatcctaggaaatgtccatataacgttaggaaactgtcatataggaaattcctaaaatctaaactctagaccatggcctataaggccctccatgtcctagccttgtctatttttctggcttctaacactttatgccttgctctttctgctctagccacatggtcctagtcccactggtactaccccacttatatcaattagcatcgctttcactctctatcctaactttttcccttccagcatggctaggtgattgcctggcccaattcagtatataagcttcacatgggcatgggctttgccatattcactgctatgtcatatcccagggtctagcacagtgcctggctcaaagtaggtgcataacacttgagggagcatgggagaagaaatcaatgtaagttatggacaggtgaaaataaaacaccttagatttagaaggaagctgaaaaggaatgatgagagacatgaggaaacccaagaagagtgtcatgggcacctaagtaggagagagttttgtcaaagaaaaagtaactgcagtgaagaagacgcagagaatgaagtctgtgagaaggaaactagacatgtaaaaacatttaattagagtagtgggggctgaagagatattacaaggagttacagaaagacttaagtgtcaaaaccacatgtttttcagatcccagaatattcacagccattagaggtagattcttctgcacctcttcccgtcacactatattaatatttctctgagtagctatcaaaattggagtgactatttttaaagtacctgagattttagacaggactgtcctatacatacttaagaaaggaaaaaaatcaccagtactaataactaaatagtgaaagttcttttatccactagaatgcccatttaggtagtcatgcattcaacagatgttttgagaaactcaaagaccatgcactgtcatacataacctcaataaaaaattcacattcctgctctcaggtctgcaacattttatttcacaggatacatttagtacatatgacaatgaaatgacttacaggaataagtgtgcataaaattctaagtactactattatttataatgacaccagaaatttatgacttagaaatttttagaagtgtcatgcctacaattatatattctcctgagggattatgtttaaaaagatgcaaccatttttaattttcatccttaatctcaattaattggcatacaatatcaagataatgttttataaatttccctatataacataaagtccttcacataaagtcctgcattgatatatgcagagattctaatctctgcaatgatacatgaaatatttagtttcccaaactattttccaaaatttaacactaattttttttaaatatttatttttagtatagcattaagcacattatgttaaacatattttattttgctttaattcttcatataggccctctgacagcatttcggaggggatatttataaaacaatgatgtatgctaaaaagccagctgcaaaattcccctcatttggtcaactcttccagctacatcactcaactcaaacactgccaagagttcagaattaagtcagatagcctcagatgatgaaaacagcgatcacaaaggccacactccttactcactaggaggggtcctcacagccatatttgaagcccaattataataaactaggttagatggttttctaattctcatcagagcataaatggcaaatgggaacaaggggtgtgggatatagagagtttcagatgagataatgtctatgaatgccctttataaactacaaagtcctacaagaaatgtaaaacactagtttttatatgtctataataataaaaatcagtcatcaagagaagactaaattgtgtttaagacaaaaattagtctaagtgacatttttaaaaaagttccatcaaaaattacaatgttttcttaaaattctgtgccaaatattctaaaaaacttatgccatggacaccttccatttctaactgtgacaactaaacgtggttttattgcagttcttctcagatccgctaaggaaagagaatagagatgggtagctttttttggtgcctcatgaaataggtaccaatcatttaatatagaattgcagctgaaactaaatatttatcattttgtgctaaatctgttacaaccttatactagttcatagcacagaaatgcatagtaagttttaaatgtctggaaaagatgctgaaaaaatatatatcaatattgtgtgtgtaagacggagaatacatgtaaatataatagtctagtaagactatcattataccttagtggtacaacaacattattttagttcgctaaggttctctaaaaacacattctgtgaatcaccgtttcactgttatttcctcaaacatctgttctatcaatgttccaagcaaacacattgtctaattccatttacaatgagaatggacagatttttttttcttttttttcttttattattattatactttaagttttagggtacatgtgcacaacgtgcaagtttgttacatatgtatacatgtgccatgttggttttactatatgcagatgatttctaaatatttcctgaatttcaggcaacatttcaatggcctctccagaatttctgcaaaggaaggattgaggaaggtaaagtggttgagaagggctggaaagtagaatgactagtattgatctgaagctgtattcgcaaaccaaaagtactatctctctacttaaataaaagaaactcaactattgagatgcatttagacagagtatataaagaataacagtagctggaatagcccccaagccatgccttcaatttctataaagcttccccttattttaaagccagagggaatttttatctcttttgaactcccagaattttatctatatttctatggcatttatcactgtcaactttgtattacaattatttatgttaactgtgctgatgcctggaaattaagagatgttaaataagatgttaactgtacccaaatataaacctgattaaatgccaaatttacatttgagtttagctggcatttcattcaataataacccttccagatgctttctgttatctcgaaagcatctcctgcaaatggctagagtcctacgttaaagaaaaaaataaacgataatgccatctgaacccacaattcaattaattgctaaagcaaatgaatctaaccttaaccaggaacattagacattaccatttcagttccctaatgagagggcataacctccaaccctctgctgcctggttcttatcaaaatacaggcggcaaaaaataaaatttgagaaatatttcctgaaggctaaaggattttctatacatccattctaattcctctaattttccctaatctccattaccaaatcctgcttccattaagccaggccacagttatttgggctcctaatagaattgattttattcaactatactaaaatgctaaaacgcctgcctagaatgaacatgattacacaaaaagagccctaggaagctcattattgtaataacagtgcatttgtcattgaggacctttctcaatatcataccctgtttgttacatgagagtcttgggggaaaaaaaatcacagacttcagtaacaggaacagtttttcttctcccaagaaactagttcatttttattacaaacactgaatactacataactaatcagtatctgaaagaaaactcagagtcaaatctgtatcctacttgtaggacagtcttgtgccataaatccttggatactaactttttattggaggttattttttcttcttttattttctcttcttgctgacttattatattgtcaatattttattgtatgaatgtataggttgctacatattctttgtcatattgaagagggtaggtacttgttgaatgacatataagtcctatatttcaagctaaagctacaacagcattatagtttaactgatgtgaaacaagaaagcatattcttccagaaatttgtgaattatgggattaaatgtattagcaatgcttggcattatccaatatttcacaaatatatgagtattctcagaaaaagttgaggaagcataaattattatttgtattattcttaggaaaatgacaattcataagcctaaatcttgcttttctttaatttcttaatgattcacactgtccaatggtcacaaaaatataaaatatataaaacatttatttttaatttgggcatttgattctttttttttatactttacattttagggtacatgtgcacaatgtgcaggttagttacacatggatacatgtgccatgttggtgtgctgcacccattaactcgtcatttaacattaggtatatctcctaatgctatccctcccccttccccttaccccacaacaggtcccggtgtgtgatgttccccttcctgtgtccatgtgttctcattgttcaattcccatctatgagtgagaacatgcagtgtttggttttttgtctttgcaatagtttgctgagaatgatgatttccagcttcatccacgtccctaaaacgacatgaactcatccttttttatggctgcatagtattctatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccatcaacagtgtaaaagtgttcctatttctccacatcctctctagcacctgttgcttcctgactttttaatgattgccattctaaccagtgtgagatggtatctcactgtggttttgatttgcatttctctgatggccagtgatgatgagcatttattcatgtctctgttggctgcataaatgtcttcttttgagaagtgtctgttcatatccttcacccacttgttgatggtgttgtttgtttttttcttataaatttgtttgagttcattgtagattctggatattagccctttgtcagatgagtagattgcaaaaattttctcctatgctgtaagttgcctgttcactctgatggtagtttcttttgctgtgcagaagctctttagtttaattagatcccatttgtcaattttggcttttgttgccattgtttttggtgtttcagacatgaagtccttgaatctgggcatttgattctatgttgctgtggattctgtttatattaataaatgcacatacccaaactataatctcactcatcttggcagaagacatatctgaaccaaaacagcatgctttctgttatttatttcctttcattgatttgtaaaatataaaagcaaatcaaacaacaatataacaataaaaaactaaattagcttggcgaagtgcttcatgcctataatcccaacacagtgagagaccaaggatggtggatcacttaagccaggagtttgagaccagcctaggcaatatagtgaggccctgtctctacaaaaataaacaaataaattatccaggcatataggcatgtacctgtggtcccagctactgtgttgagaggctgagatgagaggacttgcttgaaccctggaggtcaagactgcagtgagccatgattgcaccactgcacaccagtctgggcaacagggcaagaccccatctcaaaagaaaagaaaaaataaaaaactgaatcaaagcagtcatccactctacttctttctagggtgatttttcctaaaaattaaattaggtgggtggaaaaaaggatcagccctatattgtttttctattgctgccataacaaattgccacaaatttaatggcttaaaacaacacaaacttatctttcagttctgtagatcagaaggctgactggtgtcaaggtgttagcagggacaatttccaaaagctctgaatgcactggtactattctctttcaacctaacttctcacacatgccagttccactctttctcaacaccccttagatcccattgaattcattaatcattcccaggctacactcctcccaattctaatgtaactgcagagagcctaagctgaaagtttcaagaacttcctacttgaggtgggagagtggggtccaagaaattccattacattccccttttgagtgtcaaacacttctttccaagtctctgctggtatcaaccacagccagttatgtcaatgacctttttattcagctgattatgttggaggttctcaggtaagctctctgttccatgcaaaatgacatcatgaggaatagaggtaaggcacaagaatgcatttatcagggctctctgctgtaacaccttggccaagaggaatagagaaagagatgagtaaagaaaaccaatctgcaactcagagctggaaaacagcagaaggaaaaaaacagagacaaaaaaagaagaaaaaaagaagagaagaaaggttagttcaatcaatctctatgttccaaattcagagggttggcaaaatggaagagagaaagagcacaagtgagaggcaaagagacaggacatgaacttctgaggagttcttctgccttttaccgcacagtaaatatccactctaacccttctcctctcctagtatgttacatgcctattgtagatgtgctgcaacacacacaatatatctgttgctaaaattccataaagaaaggtaaaatattgaaaaatgttaacgtacagaaaagagtggattttttcttttgtgaaagaaaatgaagtttaaaaaaatgaaattaagcaacagtttaaggacctttgtcatttaagagtcagtttattaactgaacacctaaaaaaacattatgggtactgtggcttacccatcgctattgtacttgtgcaattacagggggaaaggatggggacacaagaagtgaggaagaggaagaatgttatgaaggaaattgagtttgaagatgagttgaagtagaggttccacctaccccaattttctgaaagtcttaataatctctagtaaaatgcttttcgtaagtgtttgacatttatgaaatccatggcatataaaattttattcattaaaaaaactcttagctacttttcataaagagtataaattgttgcttactgtatctgttttagtttttcatgttgggcttttcatgttaagatattttacctagcaattttccttagtcatgatgaggtttattaggatgtgcaagaaaacctctatgaaaagacttatattggatggctaaagccatagtaggatcaaagactgtaaacaattttattaacctagtcaattcagcaaaccaagaactgctgattaaatgctcatttttttatgctttccatattaacatacctaatttccaggctaaaagataagattaatcctccttgtttttggcataaaggagaaaccctagcttggttgatacaggatttgggttctggtcacagctttgctattaactagcattacttgtgaaaagtcatttaaactctctggagctcagtttcataatctaaaaacttaaaagagttttactagataatctctaagatgtctcccaattcaattactctattatttaaattatattctaatattagagctcccaagacatgaatttgaaaagctgctccctgccaatatcccgaaacccacttattcccataataaataatttaaaagatgattgtaagactcatatacttaactccttaagaaagtaggtcgcaaactttagtgtgccaaagaatttaggtcccaacctcagagacttttccatgttccaactccagagagtctgattcaaaaggactgggatggtgatcagaaatctgcagttttaacaagtacttcagatgctacaaatagtagttgcctggaaatcatagtttgagaaaaactgccttaaaattaatgtgccaatcaaaatgaacttttggatgtttattcttttgctccaaaatgaattttaagatgactatttaaagaaaacatgaataaatggaacctatgaattcaactatatgtaataatcgaaatacataatagtcatctgctaaagatatagtaagtcctatatacatttcacagatttttacaattttatagaataactcaaggtgtcttaacagatattttataaaaaacgtattctttcattcagtagaaaagcgatatctaccaacagtcagttgttataggagggaaaaagctttaaaagatccaacaattaaaaaatagtttaaaggaaacgtaaaatccaaaataacctaactttttgatcttagacattattcaaaaaagcattattaaacataccaaagtgcatgatcatcctgaaccttcctgagttaaggagattagtgactgataactattaaagctaggattatgcattatattacattttgaggatatgtattaaagatatagtcattgctcctaaaaagataagctagattctaatcaacattaataggcttaaaattagtagtgacaggtataatttaaagcataggaattctgtgtgggtaaacaggaattcaaaccagatcagttcaactattccttcggcgcttgctattttccttctgcagttgggtgaatatagaaaagaccatatcatggtcaacatctcctggacagtgtttttcaaactttaaagtgtaaataaatcacctggagaccttgtcagaacacagattctgattcagcaggctaagattcagtattcctaataaatgcccaggtaacactgatgcttctgctccctgaacaacggtttaagtagcaaggcctcagggcatttgaaccctattgtgttgaaaaaagaaaatcccatgaatcaaattaggtcactgtggcaaattgtattttccaaagatggccatattacaattgttcttatcccacatgattttccaagtgtgaccttggcactccctcatcaagagatagagtttaatttccttgcccttgaatctaggccagctttcatgactcacttgcaactgaaagaatgtggtagaagtgtcactgcaggacttctgagcccagatgacaagacttgcagcttctgctgtggtctcatggaatactctcctcagatgcttcctctcagagcccagcagccacactgggagaaacccaaaccatatggagaggctgtgtaggtgctctcatgacagtccaagccttagaatcaactcagcccaggcaccagacatgtgaatgaagaagcctccagagagcccccacactcagccattcaattcactcccagtcagttgagcattcccaggcgaggaacccagactttctgaagcaaagataaatcatccacacttgccctcttggaatgcctaacatacaaaatccatgaacatagtaaattaactgttgttttatgctctaagtttgaggtgatctgttctacaacgatggaaaactgcaagaatggaattagagttaatgtagagaaaggatatctactaaataaaggaaaaaaaccatacgttatttttaatagtttaaacaaagctgtgtggttaagaaagggaaagtctggtgatagagacaaagtatccaaaatcattaaaaaaaaaaaaactcaaggaaaaagtctggctggaatagaagatgagttctaagatgaggcaagagattataatataaattaaatggggaggattataaagaaactttaaaggaatcagtaacagatagtaaccaagtagatgaaaatttgagaatggaacatgaactattaagattttaagattttttttgttccatcaatgatactttttttgttagacttattagaacaaccatggagcaaaacagaaatcaaacaacggaaagcaaagaaaaagttctaaggaaagaagcagaagcaatgcaaaaagacacccacagagcataaacagaagcggaaagaaagaaaagaattatggcacaatggcgaaaatggctcataaaacctgttgatacttctgctgaacaaatatttttgaaaccctgctatggggtcattcagtgttccaggaactgcggataatacgtgaggagcatgacagagtcactgccccattaaagctaaaatactagtgaggacaataaaccagtaaacaggtaaataaaaggacaggctaagcattcttaatcttaaaatccaaaatttgaactgctctaaaatcaaaactttttgagcactgacatgatgccacaagtaaaaagttctacacctgccctcatgtgacagggtgcagtcagaatgcactgaaaactttgtttcatgcacaaaattattttataatattgtacaaaattaccttcaggctatgtgtataaggtgtatatgaaacataagtaaactttgtgtttagtcttgggtctcacccccaaggtactcattgtgcacatgcaaatattccaaaattcaaagcacttctgttccgaagtgtttcaggtaaggaatactcaacctgtacttttacatagtgataagtatcatgaagaaaataaagcagagtgaagggatataactatttggtaaaggggaaatgggaagaggcgatacataagatttatatatacttaaaataaccaagaaagagcccacgaaaaaatagtaatagtagcagtagtgaaatagcagtagttgtagcgtagtaattttagtagtagttatagtactaaaagcttaagaaaaggtagtaatgagagaaaaagctaagagttattagggataaaaaaaggttaccagcaaatgaagagaaagcccaagacagcttcctaactataatccaccagatgttccagtcagaaagcttggagtcattcttgatcctctgtagcagaggctgctggcactcaccaatgcctgcgtgttcttctcttcctaggtacataggagaactgtaattccagtttcctccacaattaggtgtgtccagattccagccaaggtgtgtggctggaagtgataaatgctacttctcagcttggcccataaattcctccaacagcatcctccatgccacataatgggagaagagagaaggcaggtgtttgattctactttccctcccgaccacactatggtgttcacagtaccggtatctgctcccctccgactgctcttccacatacctagctctaataccatttccctgttttgccccttgaggtctagggacaataacagcacccagcttttcatgagttctgggtgactcgccattccatgttagttccttatcaccgcccacacttctgtaaacggtcccttcatgaaactcctctcagttaaacattttaaagaatgtcactgctccctgtcagaaccttgacagctatgtctggctttctcattaaaatttaaataaagattatgatacttaagtattaaagagaactaatgaaaatgacagaactttggaaccgaaaatgatcttgggaatcaccttgagactgtcctcttcattgtatgctgatggtatcaaggaccaataataaaacagatgagtaagttttttcctttttacatttttttacataatcagtacatatacatcacagcaaaagaaaatgtgtattacatgccaagcttttaacattattcagaatacttatttatgatatttatattttcaagaaaaaaagtaatgagatccaattcttaaaattaacactcagaaactagttctacattggaacagcatccacctaagctggaaggcagagagcatatatttctcagttctcattctttcaatgaaatcctactctgtttatagggctgccaaatggctgaaccagcccaaaacagtttacagtattgaaatatgctgactttttttcccgataatcttcttatgatggaaaaaacaagcttcaaccaaaactaaccctgatcatgaatgtcagctcctgatcaagagccacaccctgcctgcaagtaacattaagatgctaaataaagcatctctccagctagaagctcagtagtcatggcaaatgtccattatcaagagccaaggataaagactgtctagtttcctttgttttcatttaaatttgctctatagcactcatctcgtatcttgagcttcttctcatattcttgttctgagatgcattatcaaatatgtaacattctaaagaaaggagaaggcatatctatcaaaagaagctataccttgcttcaaactaagactcgaccctggtatattaaatatgacattaaagcgttcgttactttaaatagctacatttgttgatctaatgtgtgtcaggcagaatccaatgtgtttcacagattttctttaattctcctaaattttttccccacacctttgctgtatgaacatgaaatttcgcacaaacatggtactgttctataagaaatggtatggttctataacaaatacattaaaattatgtgctactaccaaaatatgtctcttaatgtcataatcttggtaatagtaagcttacatataagtgattttccaagcacttatatttgttatttctaacaaaattatcaaaagaagagcagagtgtgctttctgttacatatgctagctgatcaatgattttgttatttttaaactgtggatgtttatcacagggatgtgagttggaattagaaaaaaaaactttcaacaacaaagtatatattttatagaatagctgccctctcttacaatcaagtacatcaatgaactagactaccgaggttggtgaaatctcattacaacagtagctgaccaatagctggtcagatatactaacaatcaaatataaatggcaagtcccagccttcaagcttgagtacattctgttctttagatggccacatgagaacagagtaaacagatcagtgctgatctgcaccctgagattcacaggctgcaaacaaaatggagctcccccccaccaagagaatttaggcacctaagttttttaggtccaaatatatggtaccataactgcaatagcaatgccaatttacaaatacgtagcccatttaaaattcatttgctcattcagtcattaaaactaaattgcattatttaaaaactagactcaagaaattaaaatggcatgcccaaggtcacattgtgagtggcacaactaagacatgaactcgtgtcttttaactcttaactgatgttctttttactcttatagagtagaataaggtcccggacctttaagaaacaccaattctggagctccactgtagacttactaaatctaaacctctgaggttgggtcttgtagtaggcagaattctaaggtggcccccccaaattcctataccccagccaacagtgtgcacatcctgcataatccctccctttgagtgtgggcaggacctgtgaatatgatgaaatgtcatgcccatgattaggttacatatgtggcaaaggaagggggttttgcagatgcaattaaggtcttaatttagttgagttgagttgattacttgaaagggagagtatcctgtgtgggactgacttcagcaggtgagagctcttcaaattagggttgggtttcttctgaagctagagaatcttccgctggccttgaagaagcaaatggccaggcagtgagccgtctatgcagatgattacatgttaaagatctgagtgtggcctctaggagaaaagattggtttctagctgacatctaacaagaaaatgtggatctcaattagccacaaggaaattcaattttgccaccaacctgaacgaacttgaaagtgattcttcccaaattaagcctctaaacagcataaactttgacctcatggccaatagcactgtaattcatgcttgagcaaagacatagtttctaaccattttaaccggtcagatcaccaacaaaaagcacaaaactgtgaaatgtgtggcactaaacagacctcaaaaaagacatttgattgcagtatgaaagctgatataaaaaggcagatcactgccttgtttgattttagctgggaatatgtgcctttttaggcaactcaaattttttgctgctctgtttgaccacaaaagctcccaaaatattgatttttagggctacaaataaatcttagcaagtaagcaaatgtgaaaaaaaaatccatgaataatgaaggaccaactgtatattgaaatgttaaccgatgttgcatttatttactatatttcctgaatttttacactgaacatgtatttttttaaaaaaccctgcattttgaaaaaataataaatttctcaattcaaccacagcaaattctgcaccttctgcctaccttatgaatagttttattagctctgtattaaaactgtatgcttacttctgaatcctttaattgactgtcgactgatgtaagacagtacatggcacataagcagtggtaaaacagagatatagacaaatggaacagaacagagccctcaaaattaataccacacatctacaaccatctgatctttgacaaacctgataaaaataggaaatggggaaaggatttcctatttaataaatggtgctgagaaaactggctagccatatgtagaaagctgaaactggatcctttccttacacctatacaaaaattaattcgaaatagattagagacttaaatgttagacctaaaaccataaaaacccttgaagaaaacctaggcaataccattcaggacataggcatgggcaaggaattcatgactaaaacaccaaaagcaatggcaacaaaagacaaaattgacaaatgggatctaattaaactaaagagcttctgcgcaacaaaagaaactaccatcagagtgaacaggcaacctacagaatgggagaaaatttttgcaatctacccatctgacaaagggctaataccaagaatctacaaagaacttaaacaaatttacaagaaaaaaatcaaacaaccgcatcaaaaagtgggcaaaggatatgaacagacacttctcaaaagaagatatttatgcagccaaaagacacatgaaaaaaatgttcatcatcactggccatcagagaaatgcaaatcaaaaccataatgagataccatctcacgccagttagaatggcaatcatcaaaaagtcaggaaacaacaggtgctggagaggatgtggagaaataggaacacttttacactgttggtgggactgtaaacttgttcaatcattgtggaagacagtgtggcgattcctcaaggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccatcaatgatagactggattaagaaaatgtggcacacatacactatggaatactatgcagccataaaaaaggatgagttcatgtcctttatagggacatggataaagctaggaaccatcattctcagcaaactatcgcaaggacagaaaaccaaacaccgcatgttctcactcataggtgggaattgaacaatgagaacacttggacacagggtggggaacatcacacaccgaggactgttgtggggtggggggagtggggagggataacattaggaaaaatatctaacataaatgacgagttaatgggtgcagcacaccaacatggcacttgtatacatatgtaacaaacctgcacgttgtgcacatgtaccctagaacttaaaatataataataataataaaaagaggtggtagagaaatgttgaatgaatgggtgaactttatcaaatgttgagtttgctcaaactattcactccacaggacattcttcaacatgacaatagttaaaagtagaactacaaattgtgatgtgagtattctgtaaaacttcacacaaaaaattaccagttatcaccaaatcttctcagggaaggcaggtctcttgcaacggaaatgaacatttttaaaaaatacatatttaggaagtacaaatgcagtgttgttccacagacataaaataaatcttttcaatagggatcagcatgaaaagcatctgcactgctagaaccacgtacatcgaaaatttatcaaccaacatcctaaaatattttcaaagtaactgaatgcctataaaagaaggctctgtaccaatttattgcaacacaaagattatcagatagctagtattttgcccatggatctgtatcctccttagttgatactaggaattgtatagcatgatcatagtcctatttctatcacagttcatcactctcaagtaagtgtttactgaaaaaccgatgcagaagatgctttgcgagggttgtgttgtcaacaattttccccagttccaaagctttcagccaagcctctgtgttggtgcactatgaaccaatcttctagagggtgatgataacagaaacaataatagaatgggctcagctcttcaaagccatgtggctttgattattttcactaccaacaattcagacccataaagtaaacaagaattctttctgatctcaaaactgctaggtgaagtcatgtagtgtgtctattttcattaatattaacaataggtaatatgctaataatagtaatggaaaaaatacacgcagttttgggaaaacaaaaacaccctcgataagatttttttcccattaaatgggaaagatgagtttagcttgatgaaactgtttctgtcgttttgagttcccataaatgttttttgttgttgtttcttttgtgttctcatggttttagctattgtgatttaaagtgattttaagccagagtaaactgacttaacccatctttactctgtgtgtgcagaaattagggcacagggaaagcaacccgactatatccagaggtaatagtaggaagataaggaaggatttctggtcacataaacaaagtctgctgaaagatccattgagttatattgtttataaatgtctttcctgctttcaggtagaaacattctaaagcagggtttctcaacctttttggtcctatttgagataattaagggccctaaagagcttttgttcatgtaggctacatttccagttacgttatgttagaaattaaaacaaaattttatgaaatatttaattccttttaaaacaaaaataattagtccattacatggtaaaataactgaatgtgtttatgtaaaataactatgtttttctaaaccaaaaaaattagtgataagaatgtcattgttttacatttttataaatctctttctgtctgacttaatagaagacagttgggttctcctagctgcttttgaattcaatctgttgtgtatattatcatacctctcatagcctctggaaaactcctctgtgcacttgagtgagtatgagagtgaaacaaacacaagtagtattattatgaaaatagttttgattttacagacctcttgaaagagtattgaggacacaggatgaacaaccttctggtttgcctaggactactctagttttagtctcaagttctaggaaaccctgagtttcagggcaaaccaggacaactggtcgccctctctgcactacattttgagaacggcagtgctaagacatcaaaaaagatcaacttgcttaagaccataacatccactaactattactgtgccttcacaatcacaaggtgacctaactcacatatatccactattactggctacataggtatctattttactttttacagtgtttaatagtaacgtaataatttgaaatcaacgaaatcttctcagtagcatatacccaagcatactcaaagtagaggtttgatgttattttaggtaaagtcaaaattaagttatatttaatttttggtagtttgggaactgaggattgaactaatgtaacttaataagtggccattaaaatacatttattttttatttttaaaaacagtacatgccatttcattaagtttttagtcacaaaatacagtttgaaatcttacttttacagtaattaccttgagcaacaacaaaaaagtatttagcttcctgagaattagcttattttctcaaaaagctttacagaataaagtttattaattctgttttatgacattcaagtgccaagccacatgttttccctccaacacctttatttccttttaaataaaattgcatgagtaaggccttagtcaaataatagtcatcagtttccttatttttttcctttttttaagatgaagcatttcttaaatgtaacatatagaacaactaacagtgactggtataatgttttaataattcctaagtttcatttttgttaaaacatgaatgaaaaaaatcatattatttagattaaaatgttatttaaaaaaatcaccaccctaaccagtggttttccctcatgtgagatatttaacattattgaattggcaacagacattcatttcaagctcaagacatttttcttgccatctttctcacaaaatgaaatgtgtacctacagttgctatggtactggtataagccttaccgtggcatagtaatattgtttaaataaatcattttattaaaaagtgtttgctgaaactttaaaatatatttccaaaggcaataattttctaaaaaaaagttgcttccttctccaattatttttgtatttttttcactcaattgtttacaaattcactgagatggttacttatgactttttaaagaactatatctaataatgccaatgcaaaatttcaaaatatatgcagaaaatcagttaagagcttttctacttcaaataggaataaaccaaaatactttaaaataccactaatatttgaaacttcacaattttgataaaggttacttgttactgcctaaaaaaatggtgacaattatataatactaattacacaaaaaagtgtcaaagtggacaaatgaaagatgagtttcatagtatttttcaaacaaaattcagtagacatgaaggtctaaattccattttatatccacacatcaaagtatactaagatattagtatctaaaagatatgtttattgtggataaattgctcaatagcaaaaacatcacatccacacatgaatatccctgccactagtttctctaaattttggcttactgtccacaaagccagtaaagttgttgcataggggaaaaaaatcatttccttgtttaaaaacttccatgaatatgtttttccttaaaaaaatgcagtctgaactttttagcaatgcatatgatgttcactcagcccaaaaccacttcatctcttgccagttcattcttcaacaagtaggcctagagtggcttcagcacctggcccaaagcagatatgcaatcacacttttcgtaacaggcacagcaacctccttgagagcttatattctcacatgactttgaacacacttttccttcttccagtgaagatacagcacagtgcagctgagaactttatacaaaaagaacaattcaagaaaactgaaatttctccctgcatgaattttgtccatccataatcaaaataatttcaataagtcccgtgggagtgaaatacacctattcaatttggattttcactttttttattacaagaattataatgagaaaaattactattacttttgtgtatgtcattttttatctaattaaaattaacataagatacaatgatgcacagatcttagttactcaatacaatgagtattcacaattgcaaatacctgtgtagccagcagtgagatcaaaatataggacatatctgtgagtctcaaaaagttttcatgcctttctccagtcagtttctttctcccttccccaggcaaccacttcctgatttctaacatcatagattgttttttctgttcttggactgcatatcaatcaaatcatcatatatgcagactttttaaatctggcttttttattcagcataatgcttttgagattcacccatattgttgcatgaatcagtagtttcttctttttattgctgagtaatatttcattatatgaacacactatatattttatgtatttttcaacatttgtacatcttcttttgtgagatgtcagttcaattcttgtgcacattttaaaaaattggattgtcttttcactgatgatttataggctttctttacatatctgggatacaagttgtttgtcatgtatgtgttgtgaatattttttataatatttcaatttgttatttgttatttgtctgttcattattgcaatgctgtcttgagatgagcagttttaattttgaagtctagtttatctatggttttcatggttactgctctttgtgtcctactgaagaaatcttggtctactccaaagactcattccatgtgccaacattcccctgcagattaggagtgccctgttcctgttctcatggctttctcttccaaggctgcacatttgtcatggggaaaaggctaaacagagctggtgttggtttattcatcagtcacatcaatgttgttgctaccagcttaaatattcacagcctttccccacacagaaccatctgctggtgctctccaacaatattaacattaaaagggaagccttgacaagaagtccagtaagtggctactgatatcggttccacaacttaatgacgttgaggctggcacgagggcaattctcaaggcctttccttcatgatcactagatgactgctgcaactccagccatcatgttttctctgggttctatgggtcaggatttcagagaggcacaatgcagatggcttctctttgctccacaatgtctgaagactagctggacagatctaaagagctggaagtgacttgaatggctgaggtctaggaacatttagtggattctcatgcacatgtttggcacctgggctaggatatctcaaggacttgcttctccatgtggctagagtgtctcacaggtgtgatgacagagttctgaaagacagcacagaaaaggagcacacaagagagatgccttagtccattttgtattgcaataaaggaatacctgggactaaataatttataaagaaaagaggtttatttgtcctgcagttctgcaggccatacaagaagcacagctttgtcatctgcttctggcaataacctcaggaaacttttaatcatgatggaagataaagtggatgaggcatcacatggcaagacggaggaagcaagagaggaaaaaagcaagaaaaagcaaggcaggaggaaggtgccaggctcttttaaacgaccagatctcactcattactgctacaatggcaccaagccattcaagaagggtccacctccatggcccaaacaccttccaccagaccgcaactccatcactggcaatcacatttcaacatgagatgtgaaggggacaaatatccaaactatatcaagagattatccagataaggaacacctgagagagattgcccagagggattgctccgaatgggagcacccagagtgccaaagggcgcattacatgaaaaagcttaccaatgcattttaattagcagcaagacagaggcagctttctgtttttccatcctgaaattaatctctgggaagttacttgtctttcatgtagaaaggggtgacagatatccttgagttcaaaactttgactcacccccgaaaattctttaaccttggattagtcactcaatgactccaaacctcagctttcccttttgtataataatagtaatactacaacgataaaaggtttataatatattctattattacactacaacaatgatgcaatggagtaatgatactaccttgctcagttaatgtgtcaaataacttatccttcttggcgactgaaacatgggaagtaattttcataatttagttccctgcccatatctgcccagtgaaatcctactcagtcaccacaatctcatcaaaagacatgtatatgtaaaactaccccatcaccaggacaaagtcagtttcatctgtgtccctcaaacttccattacatggtacaacatgtaataattatatcatgttataattatgcgttcattcatttaaaaaatacatattgagagcctaccacctgttaagcactgtgctaggagttgtatatactgtttagtaaaaacagtttgaatccctaccaccataaagcttaccctctagtgttaaaaatgtctttatctgcacctagacaattacctgattgagagtcacctctgtatcttattcagcacattccctaacaatggctagattctcaaaaatgtttgacaaattaatttcctacaaaagataaagtagtttaatacttgttcacagttagttcatctaggtaatccagcacaatctgtattaaaataaattaatgtaattttaaaaggtaatatttcctttagggaaatctgaaatcccaaaaacgttcgaatggaaaaaaaaaaaatggtacaagaaacctcatttgcattcccatttgaaccactcctttttcatgtttttactattattaggttaattattcctcaaaatcctggcagtagaaaagagtaatactggtcattttggtgatcatctgtggtcattgaagtgtgttctatgggtcactagttccaacccattcaagactaatgggttgggttgcagaatggttatccaaggtcctcacagtctttctccctgcagacaaagtcatatatttatggggccaaaataaacagacaagtaatcaccatagtgaatagccattgtttttatcatcatatgctgcagggaacttaaaaatcagctcaaatatggactataatggcaccaggaaagaggcagcaggctgcacagctattatgtgtgtgtctgtgcacaaatgcagccagtgcttctaagcacttcccttctgaggaacaaaatacaaacataaaaatgcacagacagttccttctcctattcctagaaaaacaaatcataaaagaattcactgctaccctcaccaaaatctaaatggggaggtaaaagagtcacaaaaatcccagcaaatgacgcatgataaaaatttattcctctcatgtctttccaagatcataaaaaacaggttggtagctgtcatcatggtcttatcctggacatttaaggataaacattaaacacctcaggatactcttttccaatttaagtctaaacccaggtttacaattactgcctgtgttaaaaataatgtattcacatgtgaatttctctaactttttaaatccagggatttatgtgtatgtacatttttgtttgaatgtgtgctgagttttctttctctctttcattccttttctgtgtgaagctataaacacattttaggcaattaagtggtcagtaaacaaagtcttacacatagaaatgtcatacttaaatgctagataaaatcagaggaaaatagcataggctacgtatttgacattgcaagttataaggaaaactgaaagatgacaagagatgaattcagattacaatatgagataattcataattgccagaaagtggaaacaagccattgtctgtcaactgaagaatgggtaaataaaatatggtatagccatacaatggcacacaattctgcaatgaaaggaaacgaagaactgatgcatgctacgacatggatgaaccttgaaaacatgctaaatggaagaaaccagtagcaaaacccacatattgtacgcatctatttatacaaattgtctagtgtaggcaaatccacagagacagaaaatagatcagtggtttctgaaaggagagggaaagaaatgagaggaaatggagactgactgctaatgggcacgtggtttatttttgagataatgaaaatgctttaaaattgattttgttgacaactgcacaccccaaatgcactagaaaccactgcattttaaataggtgaattgtatggtatgtgaatcacaactcaataaagctattaaaatattttgtagctgaaatgacacagggatctactttgtatataaaaagaacacatgaaataaatacttgctcatgtttataagcataaatctgagaggatacagagaaaggcaaaactgggagagaaaactcttctcctgagtctaaagccaggaactgaacatactttacctcagccaccaatatgttcaaataatctatggcaaagtttctccacatgcttcaaaacatcacttaagtacactgtccttaataatgagtactataggaaaaacagttctgtaagagtaaaatagaaggaacttttaatgcccttattttgaaagtttgaaaggggaaacatagtgaacaaaaacaaaatgataaaatcttacttttattagcaacatgaagctgtagcaaagtattagctaaacaaatgtatatgtacatagggtggaggagcttcacttaaagaatcataggcccaaatcagcccaattcagtgttaaacccaccacagaaaaacaccaagtgctgtcaccttaattccagcataaaattttagaagacaatttgattttcatgtcaatcatggcaaatgcttttgcttgtgtttatgaatcattaaagaatgatatcagttaaatataataattcgaagagaagattctaaaaacaatactaaaggcatcattgattaacagaagtcacaggtgaactgaaataaactacaagggattgagtacatagtagccaggatgctttgagctgcaagtaacagaagagcaaactaaaagaaatggaaactggaaaggattaatcatctcccatacaagaagatatgtgaaaggagggctccctcattgactcagttgctcaacttgacctcaagggccccaggactttcaattgtcctaccttgcatccctgtactccagcaatctctcccctaatgttttcaagctaactgtagcagttctataggtgtcaacttctgacagttccacatccccaaaaatggaaaaaggcatttcctcaatgtatctttttatttgggaaaaagtcttgcaaacatcttctggtcaagttcccctcagatctcactgccaggattgggtcacataatcatgcttaaaccaatccttaacaaggagaatgagacctcaataggactggatcattctaatcatgatttgcccctgaactcggcaggagagatcatttcctcaaatcagaacaatgaggtgagaacaatgaacaaattcaggcttcttccaggaaggaaggtgagcaactctcaccaagaaaacagcgatcacactggtgtatgatccagacactatttcacatggaaaaccaataaaaaacggaggatgtttaacctacacaggggaaggctatgatgaagtcttcaaatatgtgaaagtcttcaaataccatgtgaaagagaagatccctgattaatttaatatgaggccttacaaactatagctctctaacaatatgctcagtgcaaactcatgagagagcagtcattagacaattcacatacaagcagaatcatcatttccagagaatatactctttggatagaaggttgaactagtgaatctaagatttttttctatcccttctctagtttggctgaatcatgcatgtaggaaacttgcccataacctcctccctcatcctccttaacaagtctgccaactcaaatttaaaacctaaaattgatatttttacatggaaagaaaagaaacaacaaaatgatcttaataggttaaacagtcttttcttgaatcagacaatacagtaaatacaataaagataattcagagctatctaaagcaattataaacattagtgtcattttcctcatattcaatcccagttccactcctatcaataggcaactgttcttacggttgctctaagtagaagaacagattgcagattatacaagggctctagcctcagccagcatttactaaataaataccaatatctgaaaatcccttatgtctttctttgctgttattctaactgccagcatgaacaagcaaaaggagcaattaaagaagctgccatcaatatcatgggaggaacccattatttccaatccttacctcctctcttccaaatcttaccttctaatttccattctgacctcttttcatgcagctaatattgataattatttaaacaaatactatgatctcagcctgaatttatttcactctctgaacagaatgtcagtaaactgcaagtaaagttattaattttatgttcaattacaacaaaatttgagtcaggattttctccataatgccacattggaaaatacatttaacaaaatgtagatgtaaaaattacttaagattttcttgtattcaaaaacaagtgaggctttgagatgtgagaaaatgacctaagattaatagagaagatctttcattgccccacactccatcttcaacatctgcatcttcttcatctacacattttgcagtagattactaaacataaagaagcacagttggctctaaaaggcaaaaccggtgacccaaatgcagaaaccatcagataaaattcatatttttcctttgtttctgaggggaaaatagaaagccaccccatgtggctcatatctaaaaatgtaaccacttatttttgctaacctggagactgcaccaacattctccctgccaggcacatcataatgctacttacacaaaacttttcactaatgacttcagacactttttttatactgagtagatatttttaaagtataaacccaaaggggacctctctgtttttatctcacttgatcactcacctgtcctgtatgcactttattactctctccttccaaacgaagctaactcagtttaaggttcagggccccttatttacaaaggccaaactaaggctcagagaggggccccaacaatgtttccataagacattttatttttaagtttgccaaaatcacgtatattttcatcaattggtggatactgctcgacctcccctctatcacatttgcctttatgctgggaagcgagcaagcatctttaagatctatataagtaggcagtgagtttggaattatattcacttcggattcagtacgatgtaatttctgtgattcagagtaattttcttacataattcagttattgctaattatttccagtgtagaaatgccttccaggctcttaacaccaaagcatcggtaacaaactggtttataagttattctttaagattacttaagattagtcactctgcatgaaaacttggcatgtcctgaaatcacaaagctcatatatgagagaaacttgatgtaagtttccacattttggcaacaatcctaaaaatttatatggcattatcaataataggctgtaataccaaaagaaactgttctaaacttttcaataataaaaatataatttcaaccagctatgctaaatactgaattatttttctgatatccctgcagaagatgacattataaaattcttgtaatatgaagaagcaatccaaaagtaagcctcctccccttttctactccctaaaaaagaaaaaaaagtattatagaagtgcattggtgtttaattaataagatttttctgaattttgttcatttatggcattttaactctttaaaattttataatttttaccattattttctcattccagtcaaattagtacctaagtttgtattaataatcctgtattatttttctttaaaaggacctccacattgactaagcttccaaccccacaatatctacctttgtctcactcttgaaatgctattttccactggcttctagaaaatcatactctccttattttcccccagcttactgactctttctctgcacttgtcataaaagcaggagtgtgtgaagactgtgctctgggcctccttcacttttcagacaatttactttacttaagtgttcccaccgagtcccatggttgtaaagagcatcttctgactgtttttaacacctaaatctgtacctccagccctaaccccatcttcccacttgacatctccctgggacatctaacagacatctcaaactctccacggccaaaactcttgagtttgctatggatgcccactgctcccctagtggtccccatctcaggaaatgacccatcagtactattcctcacatctcaaatccaggcattatcattgtcttctctcttcctttcaccatacatatggcattccccaaccagtcctgtcaatctacctccacaacatccattacctccttccagctttcttattactattgtagtccaagccaccatcacacctcacctgaacaacagtaagagcctcctagacagactcctgcccatcctctattccattctttacacagcaagatgaacattttcaaaaaggcaaatcataccatattatccttctgcttaaaatccttcctggcccctattatacctgcagttaaatgttttactctggcttacacagccatacaagactggcttcttcccatctgttttgtcttttaatgcccactccattgctcactcactttcttactcgtcctctctgccagaaatgttttgccccttagtttctccacatctggcactttcttttttttcagtttcaatctaaatagcatgtcttcctcaccacccattctaagaatgccttagtcacttcttgtcatgtaacactaaacttatttatctgcataacattaagacttctcctaatcccacagttttcctgtgtgtatattggttttccacctatctctccctggaagcctcatctaacatctttgccatgctgtcctaccacctagaacagtgccaaacataacttcttaggccctcagtacattctttgaaatatgacactaataatcttggtgcccataattccctccaggcctgtctcaaaggttatggtacactgtttagtttgaaaaagaggtggacaaaactgatagaacacctttcctcatacaacccctgcttgaaaccacattttttttcatttcacagatgcactgaacggtacaattgccttcgtggtcataagtatgctccaggagccacatggccaggctctggcaccatggaagagcatgcaaggcacccctctgctagaaaacagacattccagtgtttctcaggtaagacttgcttattgtggctgtgtaagaggcatccaagtgacaaaaacctatgtttaatccattatatgaccattcccaaattatcattctttgctctttcacaatctggtattttaccatgcctgtgtagaggtagtttttactttgtcttacagaatcttttctgaggctttcactgatgccaacaccactaataaacataagaattgtcatgattacaccatctaagaaactccatggcaaactaaaatctgtggcaaatgtcctactactgcaaaagtgtagactccatgaagcttctctcaatcaaaattgcaagtccatttccagccgggtgccttgtgccaccccgagcatctctcacacctgtcttgctagaaaggccttcaagagagtaccaagaggagaaaccaaatatacaaaaacagcataccaatgattccacacatcactacccccaaaacaggaataaatgggagcaatagaaagaggaggaggaggaggagagcagggaaggaaggaaggaaggaaggaaggcaggcaggcaggcaggcaaaaagaagagaagagaagagaagagaagagaagagaagagaagagaagagaaatttgcaacagataagaatatccttaacactaacctacagtttctattattttcactgttgaaacagactgcagacaagtaaaaggatagcataccctttcatgaaatcatctacaggcctttgggaatgtcaaagcctaatgctggccagagaagttggccaggtatctaaaacaggagaagatcaagtctggcccaatcctggctgaatcttagattcctgaaggtcaaataacattcagcacaaactgactgcctggataaagtgcacctgagctactcagaacaaatgtcaggggaaaaaaagttgataatgagaaaagaatgacacaaatttctcaataatgtctgaggtcatttcttactagaagattccaaaatggaagcaaaccatgagtataatagactgatcaccaatcaaaagaaaatacataaaatctacattttaaaagataggcatggaagcactagtggaaaagctagccctggcccagcgccaacatatttagaaagaaggccagctccatttcatgacgtaaattgaacatttttcagatccaaaatttgtaactacagacacagaaatagactgacactaaggggaaaaaagtttgttacacttactgattccaaactttcaaagtaatgaaaccaaaaccaaaacccaatatatctctgacaagatttttcataaattatatacgttaaaggaaatatgattgacccattatattcatatataaatgaagcattattggagattttaaattgttaaacaatagctttaaagtttggaggccaggcacagtggctcacgcctgtaattccaacactttgaaaggccaaaatttgaggattgcttgagcccacgagtttaagagcaaccaaagcaacataatgagacccccttctctataaaaaattagccaaacatggtggtggacacctgtaatccaagctactcaggagacttaggtgggaggatgcttgagcacaggaggtcaaggctacaatgagctgtgatcctgccactgcactccatgcactccagcctgagtgagacccagtttcaaacaataacaacaacaacaacaataataaaagtttgcatgttcctttccctttacaggaagtcacatttataaaaacagaatctgaatacaaaaataaaagcttatgctttactagaaagtattgaccagctctacacttcacaaaatgtgttatctatagcaatagacatgttataatacgtataagtttataatttatttttattattaacataatataatataaaatataataagtatagttgggatatgtatactagtcaaagaacatatttagggtattgctttcataaaacagatctttttctttcttataaacaaaactggcccaattacctcaaaaaagtacaagccagaactcaggtgacttatgtttcaaattgcttctagatataattgtatgcttgaaatgccattgtctggttgggagcagttgagttagaacatgaatctatcagcaaggtcgacccttcttttgaaactgcttcaacaaccagtctccatctttcaacttaagtttcttagtaaatcaaattcagtactggactgggtcactacagctctcataatacacaggcagtcttgagctgatttcgtgcatcagggattctgcagtatggctggtctgaaccacacagtcctacaaattgggcaggttccctgggctttggtacctgcccaccacttccttcaaagcatctctcctacaacctaaaaccactatcttggttctaactatttacttgtgtcaaatagccaaataccattctactaggtttttagttgatgatctctgaagggatgtatcggagtctatctcaaagaacactaaacaagaagaatgttttctaaaaaatgcagcagtaggggtaggggtatgaaaactgcccctggatccacgctacatacttcatctctgctcagagatttgctattacatttgcatctcaaaagagctggagaatcctactatactagaaacctgattgcttaaacaaatgtactcccaaacatatgtggccacaggccattgctttattatattatatattttttccatttattaacattctaaaaaacatagagaaattctgatttatcagtcctctgagtagcatctgcatttcttagaggttcctgactaatctttgataatatttcagacactatggctggtagtagtagaaacagctgtagtcagagaaccaatcctgaggcatctcaaatcattcattcccaacagtgacatagtcggcttgctgttaaaaataacagctaatatttattaagagtttactgtgtaacattcattattccaagtattttacatatattaagacatgcaaactacccaacaatccagcaagtcagtactatgtgttatccctgttagacagatgaggaaactgagcacaaaaaggttacatcacttgccataggtaacatggttagtatgtggtggaacagggattcaagtccaagcaatcacatctagtaaagatttaaaattagataaatttatttgattagataataatcctttggagaacaagcaagtaacacaaatacaaagtgctatggtcccagtatatagaggccatcctcaggatgggtacttgttaatttttttctgtatttgtgataaaagtagcttataacaaggataaaaaagtaggcctaaacagagacaactcatggaaattaagtcataataagtttaagtaaggtgccaactgaacatcaggagttaaaagcaggagaggctcccctctgcaacatatttatattatactatattatattatatgtaaaatatatatatatatatgtatacatagggagaaagtgcatatgcacaaactttttatccaacagtgaagaaaggaagtaactggatagattttgactgtagatttgcttgaaagcaaattcacacacttctgaacctgtataataaagatgagtaaaaataatattttatgctcattcacaaagattagaaagcaacttcaataaaaatactgatgaaataagttaaattctatatttcaaactcaaaaggactgttcattttattttttattgttttgattttttattataatacattattgcatacagttactgaaatattaagctttattctaataatgacctttgacttaagtatttttggttttacagataagttagttgtaaaataatctcctgttgaaaggactagaataaattaataaaatccaaagatataaaaagttataattagaaaatataataatttgtgtaagtaaaatagaagggcatgtttgggtttgaaccaccccacaccaagtgtaaactgctgaaaagtggtttgtagtagtttggctttgagtctgaatagaaagcccgacaagttcagttttctcatttacaaaattagaattggttcatggcaataattagatggtacatgcttggcacatgcttgaaatgtagcacttgacactagctaatattattattgttgttcttgcccattattaggccttctccttggcaatatctcatcttaattcaaaaattacctttgtaaaatacaataggttgaagaagaccaggagaaggatattaacaacactaggaggatcaaagagagaaacagtacacagtgcccagcctggaagtgtatgagcagtggaggagaaacagggtttgaagcctatgaagccagaatctgggctgtggacaagtcttccaatccttactttaaaactgtaggtgagggaactggttctcatcaatacttagtcaaaatggaaatttacccttgtcagaaatatatttgataattcaacatcataatgaacaaataacaaaatttaaacacactgtattgatttttatgagaaatgtatgagactgaattcatcagaattcctgtttgtaaggaacaaaccaacagcagcactacaaacaaatgatgatgactatatgcacatgttttatgcatctcaattatcaataataaaaatcaaaatctgaacaatgatagaagaaaaactgagttaactttttattctctctacaaaaatgatatttcaaaatcattgataagcaaagaagcgattaaagtataagagccaacaaatatagaaaaaacttagaaatatgttggataaagaaaatgtggcacatataacaccatgaaatacaatgcagccataaaaaagataggttcatgtcctttgcagggacatggatgaagctggaaaccatcattctcagcaaactaacacaggaacagaaaaccaaacaccacatgttctcactggtatgtgggagttgaacaatgagaacatatggacacagggaggggaacatcacgcaccagggcctattgggggtggggaactatgggagcgatagcattaggagaaatacctaatgtagatgatgggttgatgggtgcagcaaaccatcatggtacgtgtatagctatgcaacaaacctgcacattctgcacatgtatcccagaacttaaagtattaaaaaaaaaaaaaaagaaagaaagaaatatgttggacagtttctttaaaaagattacctttcttccggattttttgatgttagtgatatctgtcggctttatcaaatttgtaatttttacaatttttttctcagactaaagaaatattcaccattgtaactacttatatatatatatattttgtgtctatatattttacatatagtatatacagtgtatatactatatattttatatatagtatatacactgtatatactatatatattttatatatagtatatacactgtatatatactatatatattttatatatagtatatatacagtatatatactatatatattttacatatagtatatatactatatatattttacatatagtatatatactatatatatattttacatatagtatatatactatatatatattttacatatagtatatatactatatatattttatatatatagtatatatactatatatattttatatatagtatatatactatatatattttatatatattttatatatagtatatactatatatattttatatatagtatgtactatatatattttatatatagtatgtactatatatattttatatatagtatatatactgtatatactatatatattttatatatagtatatatactgtatatactatatatattttatatatagtatatatactgtatatactatatatagtatatagtatacaatatatagtatatatagtatatatattatagattttatatatagtatatatataacatatatatagttctattcacttctctaaaatgtaatctgcaaaattatacaagtttctggctccacaaaacctaaatccacccatgatgatagtataaccttcaccagcagcatctgtgaatgagctgtttaaatatctgctatatcatacaaaggataaatatattttaaattatttctaaaagtacttacatctgccaaaaatgccgcataactcacataggcacccactaattcctaccagagttcatttccgcatgatccctacctttcccctaagctaacatttggggagaaactgggaagcaagcttgcatactatgctgcacagaatggtaggctcctctttaattgggggtgcattctttacatttgtgtgtttgcatcttcatttgttctgcttttaaacagagcactccctatatagtgccccaagccaacacagggagggactacaaaggattaaaagacaaaagaaagtctttgagaaacttgttaaagtgaacatattcaaagtggcatttattggaagatcgtagtcttaagtttgtagaaatcatcatggaaggaagtcacccaaaatataagtagagatctttgaggtgtagggatgtgagcatttttttcttcttctatgattaaaatatcttttagtatttctaaataccacatgaaataaagatgtgctacatttataatagaaattaaaattagtaaacaaagtgagctttgtttggtaacctgaaatgttctacattataagcaaattttatcaggttccgtttgcttattgcccataggcataacctacaagaaactggcaggacataacaaaaattaaagataaaccattttacatttatgggttgaaaaccattaaacacataaatgacagtaatagcactttaattgacttgtagtataagggaataaaatcttaagaggtttggaatattcagtggtctagtattagtcaggcagaaaggaatgagaactacctcaaattagatattacatgattctttgaactagttacatttttagatgttttactgtaaatagaagtggtcgttttactttaaataaaatgcggttgttcctagatatgtcattaaaactgggagacaacaaaagatggttctgttaccaataaacaaacatttattgaggacttgcagtttgttaaaaactttgcctgctctaaccctagcctgtaggtccacgattattccattttatcctgaattgtaaaaatgaaacagctaaccagtggcaggtctaaggtagaaagattccacagcatgggttgtttactacatgatactgtcttcttagaattatgaaagactgattcaaaacaaactactaagttttatccttaaaatgtatagaatattttatacccttctttcatactctcttgttttgttgttgttgttgttgtttatgaagtaaactcattatctctgttagacaattataagaaaggcaggttgctgtgactcatctttggaggggatgaggcaaagtgaaaacagtttgggagattaaaggacagacagcccctggcactgattttctgcttccgtttcttcagcagtaactagtctattccagagtgacatggtagcagggttttaactgagcgcatctagagctggtaatatttggagatggaggtgatggcccaggtgataatgaagagaaataaaacttaggaattcctgttttactgttaggaaggaagacagaactctaggaccatattttagattattacagtatagtacatgcatcactgaactaacaggtttcaaatagtaagttcatagcagccaatcatcccagagccttaaagtctccaaattttagtctctctctgtctttaaaatatggccatttatgcaactaaagaataagcaatcacgatgttaattaaaaaaaaagtccatgtcatcattgcttaaaaatagcaagcaaaaaaatgcttagagttagacataggaaattgacagaagaataggaacagaaattatggtaaaaataggcatctaagaggtctggtatttaagttaagtggttaaataaatgcagatgacaaggttttaagaatagggatgttttaaaactttcttagggtccagttttctttttagatacttgaatgaatggtgaaatggataattcaatgaataactgaatgaatgatgaaaatgatgaattcaaaaaaaaacacagtgacataatttttcacacaccactcccaacctatgattccctgaagccctctccatggtcctcaggctaaaaacttctaaggtaaataataatcatgattataaataggcatttgttgaatatctccacatatcagaaagagtttctactcgtaagtgccacaccattttcagtaagaacaaggctgaatgtaaccaggacctagaaagaacacttaaatattcttcactggtgaccacaaaaatgacccgattttatcaagctcagtttaaacaacattccccatagcacagcaattgacaaaaactggcaaagcacaggaaatattaatgaaaatgctaacaaaaaaacaattttgtatacaaaaagttctttttacttctgaaaaacattttacatactgtaaaccattaattatacacaacaaatattagataaagatatcagaaatgtttggggccataatcaagtttattttgattaagttctgtgttaagtgaaagatgaggactctgtttacaaaagaagcccaaagttagggaacagacaaatcagggagtgaagcttagagcaaatcagttaactgcttgctctgtgtagagatattggaagatggctttcccagcatagatcaatacctggttatcaagaacactttggataagaatttaaaatttatttgctaaatatttcaattccgagatggccatacaaatacacaattagaaagagagagtcttctaaaaagaaatccttagcaataaacgcaaattatcaaaaccaatgtacttagcatagaatcatgattaagagcgtgaggtttagacagactcaagtctgaacagtttttctacctctgggctagttttatttaatttcccaaagcttcagttccaccatctatgaaaaaggaataataacaagattgagaaaatgtacaggaaatccagtactttgtacatataaaaatctcaaaatgtagctattattaccaatagttagcattctaatatcaacaaaaagactattatctaagggttacataaccagggaaaggtttgagtaaaggtcaagtatcccttatctgaaatgcttggaaccagaagtttcccagattttggattttttcggattttggaatacttgcatatatgtaatgagatatcttgggaatgggacccaaatctgaacatagaattcatttacatttcatatatatcttatacacatagcctgaaagtaaccttatacaatttttaaataattttgtacatgaaacaaagttttgactgtgactcatcacataagttcaggtgcgaaattttccacccatactgtcatatcagagatcaaaatgtttcagattttggaacatatcagattttggatttttaaattaggaattcccaacctgcactacatatttagaaagagaaccaggaaacgaaaagttaaatattaagagtatctcctccccgcccccactttttttaccggtcattagctggttttcaaccaaagatttgttcattctaaataagcacaaaattattgttctgttcattgaagctgcttaaggtagattttctagtttctcttacttttttggagagtaatgaagctaagaaagaaacaataattatgtaccacatagtatatgaacgtgtgtgtattttaaccatttgaaagcaacttcaaaagccactagcatttcaaaaattgaaatagggagggaagaataaaaataaaagggcttcgggaatgtgaaagttgtagacaccccacctgaaatatgcacatttaaaaaactagcttgtaacaataattaagcagtatccaagtacaaaggccttttaaaaattccttgaaaaaattaataaaatgcataatttatttttaaaaatatattaataaaagtcataaatatgctaacaattactatcaaaaaaaccatgcctaaaattaaaagaaaaactaaaataggtgtcacttagatccaaatttgggaatacttgtagctacaatgtgtcagaaagaagaaatggccacaagaaatgctagataagaccaaaaatatccttacttattttgtaagagcaaaggaatattcaaaaactgaagataccactataaaattgtgtcacccattttcaaattaaaagatatacaaaaatgttcacaacatttgactaataaatttctttttgggaattcatcataagactgaatcaaaagaatcatgaagccacaggcattcctatagatggttacctcattacttataatatcaataaaccagaaagaagctaaatgtccaataataaagtaaaggttaaatacatttgggatagtcaattaagtttaacaaacataaactgagtatgttctacatgccaggcatatagctagctataggcatacaaaaactactaacataacagctttgctcccaatacgggagtctcattctaccatatcaactcgatgaactatgaaaaacccattaagaagaatgtaaaacaaaatagatacatctttagggtaaatactagtatataaaaatatgaaataaaaaatatgaaatattatgatctgagttatataaaaagtcaacatagagtagaaagaaatagagtggaatcatgagaagaatatttggtagttaattacagggtgttcactaatccattattactgatcttaatttgacaggctatttctcatgccatctgtaatgtgtcaaacaccctccttaaacatttttttctttagtggactgtagatattctctttagtcaattccatctgttagtggcagcatatgctatatagctccagaaatgctaatatactcaggcaatggatataagcaactaatagagattttgaaattgacaaacctaacctttctaaagcagagggcatggcagtaaacagagttttaaatgtattcttgtggaccgatggtaaaatttctgaactgatactcttaacacctttattaaaacaaatctaatctctctgctcactccttccattcaacaatacaatgaaatgttttcatattctctgatctttggctaacttaattatttcatttacttggtataagtgatgtttgctacatgcaattcagttttcactcacagttttactagtagtactaatacacatttaacaaaattgatggactttcctgtggtgctttaactagcagcatattgaatgatattatctgagaaacaatcatttcctttctctacttcatcctttatcgctcctttcattactagttcagtcattcaacataaatttatcaagcatttactataacctggttactcttctgagcactatggattaagcagtgaataagaaaacatccctggcctcacataactcacacacattgcagttgaagagttatgactttaaaaacagaaatatagttcaggtcataataattgctataaaaaataaagcaagtgcacacttaaagagtgactgggtgagggcttggtgtattgcctcttttgaggaggtgacatttgagcagaagcctcaatagagtaaaggattaataaagccagcaacctcacgagattatcaacatctataacaacataaggaatattataaatctcttggaaaatgtaaaccagaaagatgatttatacttgcttcgtttttgtgctgttagttctaaaaagtctcatcatagcccttggctgttgaaacaatgcgcagtcatgaagactcacagactaaaagtagttcaatcccaagcacatcaaagaaacatgagtgcattttacacaagtgtacggtcacacaccacaaaatgacatttcagtcaacaatggactgcatatatgatgatggtcccgtaggattccaatggagctgaaaatttcctatcaccctgtgacgtcttaatgatcctgatcccatgtaggccgaggctagtgacgtcttaatgatcctgatcccatgtagtctgagtctaatgtgtatgttcgtgttttagtttttaatgaaatagtttaaacatgttttaaatttaaaaaatagaaaatatagaatagaatataaaaagaaaatatttttgtagagttatacaatgcgtttgggttattataagagtttaaaagtaaaaaaaaaatcgtaaacatttataaagtaaaaaagtgacagtaagctcaagttattattgaagaaagaaaatttttaaaataaatttagtgtagcctaagtgtacggtgtttatgaagtctagaggagtgtacagtaatgttttaggccttcacagtaacacatcgctcactcactcagagtcatacagagcaacttccagtcctgaaagctccattcatgacaggtgatctatataggtgtaccatttttatctttgatacagtatttttatgctatcttttctatgtttagatacacaaaaacttaccactgtgttataactgcctacagtatgcagtacagtaacatactgtacaggtttgtagcctaggatcaatagactataaggcatagcctaggtgtgtattaggctatgccatctgggtttgtgtaagtacactgcatgatgttcacacaatgtgaaatcacctaacaacacatttctcagaatatatcctccacattaagcaaggcatgactgtaatgggtacgtagctcagaaatgaccaacctctcaaaaagccaaaccacttcatatttttgtcaggttatttatgccttggcatttgtgcaaagcagaagcatacattgtaatcacttgaaagaaaagattatatctagaccaaagaaagtaagacaaaagccacaatgaacagcaaggttaattattctaatgaagcatctttccacagctcctccaatttctaaccatattataagaatactcattctccatccctctcccaaaccactgccactgcccaaaaataatggtgggatttagttgacatttttttactatttttcagtgttttgaaatcttttttggatactaaaacaggcaaaaaaaaaaaaaaaaaagcatttggtaacatactttcaaataaagatttcctcttccacaacttcacatctacttctttctttattttttaacttgtccagttacaggtggctagcagcaaagagttccaccctgccattaaccaaagagaagcctcactgaaaaggatcaagagctctgtgtttcatcaatttaacatcctagcattagcaccagccaagcagacacagccagcctgccaagacaaacaaatgggtcttggctaaaggggcgcccatctctggagacagccctccagtctaaacttcttaaggagtccatataaacgtgcttttattgaaaggtgctactccatctaaaaagcacagattcagttcaaacactaccacctttcacggttatgttggcttaaggtgtgtgcagctcaatgaccgtgcaaaacctgcgtcacagctacctgctgctcactttttaaatccccaaaccaaaacttctggagccacattgaacactggctgttttatcagaaagaaaataagagtgaagaaggatgctgggccacagaatcttttcctgcctccaccccaaccccatccaaatagagagctgcactaggtgaataaatggttataggtctcctctgtttctctagcctagtggatagaatttaaacttagtgtgggaatgtcactccttcattccttttctggagtttgtcagtaagcgaacattgcttaaaggttgagcttcttggagatgtggggtgggcagggctaaattgtgaaatctattaaaaactgaaaagattttacagaaaactataaatttttaactaaatttaaaagaaaatccactagcaaacatttattgaacatttactctgtgttgaattctgggaaaagtgtggggctatgaaagagaacatggcacttaccatcctagagaaactataaatctaattcagtcaaatactaatggcaacaactaagaataaaaactacatcctgaaagtttgcaagatttggattcctaagaatgtgcaagaagtgtctctacaaagtaatggaccaaaattctatgagatagtttggaaaagtagtctcacaacttagtgttcaaactgcataaccttcatcttagaagtttcaggcgtttgtgtgtcaccaaatgagtattcaagcattcacaatcacaaggagccaccctcacaggagcggcagtagtcttgtattcattcatcctctgagcattgggcttctaaaatgtgccaagcactccatccaggtgttggaaatgtaatggtaacaagacagaaatctaagcccttgccctcatgaagttgataatccagttcaggagagagaatattaataagtaaataaataaacaccattgcttagttagtgacaactatgatgctaaaaattagcctgggtcctgggaagatctgagatggaggggcaggtatcagaggaaccattttaagaaagggtagtccagattggctcaagaaggaatacttgagcaaaaatctgaaggatcaaaaggagccaactatgtaggaggagtgactggcaaaggaagtagcaagaggaagaaatgagcttagcaagttccaagaacaaaaacgccaatgtggcttgaacatagtcaaccagggtggaatagtaaggctagaggccagtctttaccaaggcttggatcatgtaaggccttgcagatgatggtacaaagtttggcttttattctgacagtgataggaggcagctagggtgggagggttaaaagtgggggcgatatgatctgatttacttgttttaatgtccactctgactgtactcattcattcaaacatttgttcagcattaactatgtcctacacactggggatccaggattgaactaaaaagggcaaaatctctaccttcatgaagtttgggtgcaggacaggggttttaggggcaataaatacaaagcacacacttaagcttaatgtttcaagttgatatggtttccctgtgtccccacccaaatctcaccttgaattgcaataatccccatgtgtcaagggtggggccatgtggagataactgaattatgggggcaggtttcccccatactgttctcatggtagtgaataagtctcatgagatctaatggttttataaatgggagtttttctgcacaagttctcttgtctgccaccatgtaagatgtgactttgctcctcattcagcttctgccatgattgtaaggcctgcccagacatgtgaaactgtgagtcaattaaacttctttcctttataaattacccagtcttgggcatatctttattagcagcatgagaactgactaatacacaagtgataatgtcctatcaataaaaagagaataaaaaggtagaatgtgataatgcaagatgccatttcagaaaggttggttgggtccttctgacactgtgatgaacatctggggagaaagcatctcaggaaggtgagcagtcagtgcaaattccatagagaaagcactgttcagctcgtggctggcactatggttcacaggaggatgtagaagaagaggctagagggatagcctgtgtgagagccatgtgcatccttgtagtccatggtaatgagtttggattgtattcttgaatggcaagaaagaccactggatagttctgagcagaaaatgacaatctaactgctgtttggagaaaagacactacggcaacaagactagatgtgaaaaacaccgttacagcacaagagatgtgagtagcttggaccagagtgaatggtcagaatctatacatattctgaaggcggagcaaacagaatttgctaatcgacagaatgtgggggtgggaaagaatgagagccttcaagcttgattctaatggttttgtcttggatgtaatgctatttctaatttccctgcctccctgtggctgcatcttctctatatccctggtaggctccatgtaatctaatgttatttgcccaagttctacccttgaccatcttctcttctcttgttctcttctctttttatcatttccatttatactcatcgcttcaactgtactatatatgagatgatacccagagtaatagaatggaaaaggctgtaatttagggtcagatagaattaagctcaattccaagttctatcagttccagctatgcggtcttagttaagataatgacctctctaaatctgcctcctcaatggtccattagagatgataatacctcaaggggatactgagataattaaatatgtcacatttaaaacctcactatatctctggcacattggaagtaatcaaacattatttcaaagttgtattttattttgttttaatctccatctctagctaaaaatcactgcaaaaaagctttcccctctcctccattttccatagtcagccaaacctgaagcccaaaagtcacctttgagtcacctttgtctcctctagctttttctggctttatttctaactgccaagtctgcagattcaaaattatacctattgatttcattccttctgttaatcctatacttaggtagccccaaaatctgctgatcactgtctcgaggcttactctacagccttgtctcagctacacctcttcccacagtatctattgcagtatcttccaacttctctaagtcttatttcagtgatcctcctaaaatgcaagagcactcctaagtgaaaacctgcaaatggctccttataatctaaataagattccagcttgttaatatacattcaagagacatgattttgatcccatcttgtatctccaacttctcctacattatttcgtctttattccatactcttacaatttaaaagtctactgtcctattccaccctgatttgtcccatgttatttcttctgcctaaaatatgctccttcctcccagcaccccaaactctctactgtttattctttaagtccaagtcttacctcctctgaaggatcttccctgaatacatcacagactaagttaccacccttttaagtgaggacagagtagcaagtttgcatcactttactaggccctcatcataccacactgtaatcttttgctaacttgtatagcactccccatagatggccatccttgaagacagaactactcatgactcatctttgtatccttagtgcctaccatcctacagcaatgctgtaatccaattatatagagcagtcaactaatgttcaaagaggttaagctatattatatcatatatgcctgtatgtatcagagcaaagaaggttataaactctggaccattttgttccagcagccacactttctcaaaattagaatcatataaaaatgtattatttcactaatccttcagaggttttcagtctgaaaaaaaaatttctttaagtagagctcaagaacattcttcattgtatatctaaaaatagtgaaatgaaaaactattttagattccttcatttacaaactctaacttaacaaaaacaaaaagcattacatgtaatatatagtgtaagaatctaattggcaaaacttcacaattgccatggatatgatgccaatggaatttcaaacttcttcacagtcatcatgatccaaagtttacaggagtcttaagaaaaataaatcaggacaatatcccaaatttcttttcaaatacaaatactctaatggcaaatatcatgcaaacattatgcaattatttcacagttcacagttttgttcttcttaaaaaatgtatttcacaattttactaaaaattacccacatggtaattacataaataaggaacttgatgtatcagttatattaaaagactccccatacctagtcatatttaaatgacaagtctggaataataaataatgattaacacaagcattaaccaaatacaaaaagctatcttaacattttcctttaaaacttaagtaatgtcttaggtaaatccatccgttatttcgaacaacattgcatcaaacacatcacaacaaagttaaattaataatgtcaaaactggcatgtattatgaaaaaaaaaacgagaagaaaacttagaatagaatgtaagttttgacttggttcacagcttatcttgccagtgcatatcacatggtccctctcttcaaccaccagtcacacatctaagtttaactaaatgttatttatttttcatattttgtggaaaaagcagtctctggtttccaataaaaagatggcacagcatctttcttaccaagaataattactagatggttgttcataacttttcatatgcaagttcctatagtacatacatatgattataaatcatactacaatcatattaatttaaactctactcatcaatcattatcaacttaacaaattagcactcttgtgccctctagtggatgaatgaatacaaaattctgtttattttcctcagaaaggtaaaaactgaacctgactatacacgtgtatattcagaaatatgtttagaagacagatatagtaacagttaaccagttaacaatgtagcccaagaggctggtgaatacagatatgaagacactatattacaataaaatggtagtattccatgggttggagttctacctatagaattcaaatggtttgaattcatactccaacccatagaagtgatgttgtttcaggctcattgtttaatatcagaggctccatttcttcctctctaaaatgaggtggataatagtgacttcataagttgttgtgagaattaaaggggttaacatgtgagtacaatgaacagtacctggcattcattagacgactaataaaatcagtgtcctttccccttattgctatctaatccctcacctctccgtgatcagcatgcacaggtctttcaggcctgctccttccaagcacaggtgactcttgaacaacacagatgtgaactgtgtgcatccatttatacatggatcttctgcctttgccaaccctgtgacagcaagaccaacccctcctcctccgcctcctctcccttagcctattcactgtgaggacaacagggaatgaaaagcttgatgatgatccactcccacttaatgaataataaatacattttcccttccttatgactttcttaataacactttttttctctggcttacgttattgtaagaatacagtatataatatatacaacatacgaaataagtgttaattgactgtttatgttatcagtgaggcttccaggcaacagtaagctattagtggttaagctttaagggagtcaaaagttacatacagacatttcactgcatgggggttggttgcccaacctccgcattgatcaaggatcaattgtattgtcccagtgtgccatatttttttaaatacaagacttcagagaagacttcaagtttgtatacaagatgagaaaaactagaatgctcaatactgttttagtctaggttgatactggctgtcctgtgggtttcattctgaatcgggattctagccctttcagcaactcctcttacttggtcatgggcaaaatggcatagctacactgacatgattcctctatatctcaggcagatattctaatcaccacctacctctctggaataccatgaggattactcaagtcattttctgaaattattttaagtttatatatatatatatacacacacacacacacacacacacacacacatttcatatacataatatatacatctcatgtataatatatatacactcataatatatacatattatgagtatgtatatacacacatataatacacacacattcttaaaattatatccatcttcctgtatatgcatgacttatagtaatagttctcgaaatttaacctgtgaatccctgaagacacctaagacccattctcttaaaggggctctgcaaggtcaaaactattctcaccctaatatgaagatgttttcacctttttcactgtgttgatattcgcactggtggcaaaaaggcaatggtgagttaaactgctgggcttccacatgaatcaaggcagtggcactcaactgtactaggagtcatcatattcttcactgtcctacacacttatggtaatgacaataatttttaaaagccagttgcaataaaaaagtcctgttaaagcgtaacaattattaattttattaagtcttaaggcttaagtacaaaatttttaatatcctatgtgatataaataggaagtgcacaaccatataccacttctatcgcataccaaactacaaaggatatctcaagaaagatcacttgcacaaatgtttgaggtgtgagtcgaatgagccgttttttcatggaacaccatttttacttaaaataatgactaagagataaagcacagttattcaaacttggatatttggcaaacatcttcttgaaaaataacgtgagcctgccttttcaaggaaaacaactaacaggatatgttgctaatgataaaattcaagatttcaagcaaaaattagaaacttggagtacttgttatctgccactgttagcttaacagactctcaacatttaaagactttttctgatttaatctgtagttatagtaacaaatgtcaataatgcaataacttctaactccatgacacaatattttccaaatgaccaatgcataaaattacaaaaagtgcaacatagattttaatataacagagtacaaaaatacttgatatgcttttggattccacattgcatctagtatttagagtgctagtatttgttgagttctagtatagaatcaaagaatgttctcattatataaaaagcattttaaaatatttgtttcatttccaactgcatatgtttataagaccagattttcttcatatacttcaaccaaaacaacattaaaaatgcaaaagcagatatgaaaacgtaaccatcttctatcaagccaggcaagaaaaaggttggtgaaaattaaaaacaatgccatcttcctcttgaatttttttgtttttgaaaatatagctacttttagacaaacttgtttatgttaatatatgccaagtttattataactactgtaaaaattaataaatcaatatttaattttgttcatctctgattttcattatggtaaatgtagatagatataatctatataaacaaaatctctttgaggtcttaaataatttttaagactataagggccctaaagtcaaaaattgtcagaactactacctgaaagaaaccaagatcctccactgaagaaagctatcagtagagatcacttctccctcagttggaagcaggaatgtcaggaactatgggacataaagcagatacttagaattcctgagataaatacaaggaagatctagaaataagaactgagtttaacatctggaaatcctggtccaggaaaaatgagacagggcttgacaatataaatgacaaataggagaaataacgtttttataaatattctgaaattcatacattctcaattccactacatcgcttatatttgctaaggccaaaattccatgccccttagaagaaaagaaacttataaaaaccaaactacatactgatcatttttcttctgaaaataagatattaacctctgttactacagagtatacgccaaatacagaaatatccctggtaaaatatcttttaacaacatgcaaagcaattcactgtaggtttatacagtatattaaagacacataaacagtgcttctgaacataaaaataactcaacattctcaagcttccatgaaaatcagtttgttttcttacttttttttagcaaaatgggctaattaacctactagtccatgttatgaattgcttttaagaacctgacaatgtcatcttgtccgttccccaatatatatttaataaggagacattaaaattagattctgttcaagagaaatattccttctttcaccttgcagttctgaagaacccccaatatataacagaaaaatcagagttgtgctaataagtactcttaggggaataattactgaaaatgccacatataagatagtcaaaatgaagggtaaaataaattctttattcatggatagcttatgttgacaattgtagaatggcttaagcactgcacgaactttggctagcatttgtttcatgttaagacacaagtcaatctgaggtgcctcaaacgtaactgtaatatttgatgaccatgagtatgagtgaaagagaaattcatctaaaagttggcataaaatacagcaaaacaaaatctttagttttgcaaccaaagtaacttggaaccccattacaaaatttctaaaaagaattaaaaataaaaaattaatattaacaaaacaaacgataatttaataatgtatagctttgctattcaacatgtgtacctgaagtagcagatcccacagatcttgttaaaaatattgattatcataatcagtatatcagaagtcgacatacttctactacacctagggactctactcactaagtacaactgtctactctggaccttatatatataacaaacataagacgactctaaaggtggagagaagaaggcagactagctaaagacctcaagatccatgatgacatgctgggttttctttttgcttcttttatcccagatttgcagtggaaaaaaaagttagcaactcagaaatgtagacaaaaacaggcaaggaaacaaaaacaaacaaaataacaacagcaacaataacaaagccctaaaaaaaacatgctctctctagccaatggtctaggaaatggccagcctatgagaataaaaacatttagacactaacagttttacacaagccaaacaccacagaaaaaaaaaaaaaaaacacggtcctactacattcacaccagcacaggccaagtggggagcttaggcctccatcttgtcaagattgtgatgagtcatcccaacaccctaggtggtgtgagagaaagccaagtggggagctgggactttcattcccaccagttggtaaccagcacttccctagtacactgtgtactatcagtgggaccatatgaaaaaccaagactcccaactcctacccatcagtaatgagtcactctttcccctccccactggggtggtttcaaaggaggcagagtggagagttagaactttcaccattgcctggtaataaggttatcttttattggaggccatcctcaacatgatgtcagtgaagaccatgtggagagccaaaattcccactcccacccagcagtaatgagacactcctgtcttcaggagtaaatagaagccaaatgaggaacacaaacttttatctacacctggcagtaacaagggagctccttccccacatatctgctaaaatggtgtcagaaaaggccagttaaaacagaaggtttaaataaaatccagagtctcagaacatatgaaaaagtccagatataagtcaaaaatcactcgtcatatcaagaacctggaagatctcaaactaaatgaaaaaagacaattaatagatgccaacactaagatgacagatgttaaaatcatctgcacagattttaaagcaacaatgataaacaatgtttcaatcatcaattacaaacatacttgaaataaatgaaaacggagaaaaaacaaagaaatagaaaatataaggaaaattcaaataaagtattacaacagaaaaatatggtaacccagacacaaagctcatttggaaaggctcaacagcagaataaatggacagagaaaagaatcagtaaactggaaagcagaatagatgttatctaatctgaacaaaagaaagaaaatagactacataaaataaacagagcctcagaaacctggaaacaatatacttaaaaaaaaaatctgacactaatattcaggtaaagtttccatacttcattcaaactggtaaaatgacaacatcagtagttatgtacatataatacaatatgtagagtaaccaccagaaactacacaaggatatacctcacaaacgctattaataaatcaaaatagaattctaggccgggcgctgtggctcacgcctgtaatcccagcactttgggaggccgaggcgggtggatcacgaggtcaggagatcgagaccatcccggctaaaacggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctaaaaaaaaaaaagaaaaaagaattctaaaaatgtttgcataatctttaaaggcaggaaaaataaaacaaagaattaaaaaatagaggaggagaaaaaaacagaaaacaaaaataaagtaccaaacttaagccctaacatattaataattacattaaatataaataatgtaaatataacattaaaagacagagattgacagatgaaatttaaaagcataacaaaattacatgctgtctacaagaaactctcttcaacgaaatagggaagttgaaagtaaaagaatgcaatatatacataatgcacatatcattcaaagaaaatcataagtggctatactaatgttagataatgtagacttcagagcaaaaacatatatatattaacagaaagagatattatataattataaaatagtcaatacaggaagaagacacagcaatcttaaatacatatgcaccagacaacagagacgcaaaacatatgatacaaaaactgataaaattgaaagaagaaacaaacaaatccacaattacagttggagtctttaacatgacctttggaagaactaaacagctagacaaaaaattagcaagaatatagacgaactcaacaccatcaatctacaagatccagtcaatatttataaaatattctactgaagaataggaaactatatacagtttcaagagcccacagaacatataccaagagagaatatatcctcatctatgaaaaaaaaacaaaattaaaataactgaaatcagactaagtatgttctctgactataacagaatcaatctaaaaataacaggaatgtccccacttagaaagtaaacaatacattttaaataatccatgagtcaaagaggaagtctcataggaagtcaaaatacattcaaatgaataaaaatacaacatatcaaaatttgtgggacacagttaaagcagtacaaaaagagtaatttacagcatgcaatacatacattagaaaaaagaaaaatctcgaatcaataagctaagcccctacctgaagaaactatgaaaactagagcaaagtaaacccaaactaagtagaaagaagtaaataagtaaataataaagagctaaaatcaataaatcaaaaaagaaaaaatcaatagagaaaaccaataaaacaaagagctaggtctttgaaaagatcaataaaactgaaaaaatatctagcaagactgacaaagaagaaaggaggcatgagttgtcaatatcagaaatgaaatagattcattcaagatcctaaagataacaaaagaataatgatagaatgcaatgaaaaattccatcaatataaatttaacaacttagacaaaataaactacttccccaaaaaacataaactaccacaactcatctaacatgaaatagataatttaaacatccttgtaaccaataaggtaattaaatgtacaacttaaaaaatcccaaaaaaggaatgtccaggcccagatgggttcaatggagaattctaccaaatggttgaagaagaattaacatcaactctatacaatttcttccagaaaacagaagaagaaaaacttaccaattaatttacgaagctaaaattacactaatccccaaactagacaaagacaaagggagggaaggaagaagggagggtgatgaaagaaagagaaggaaaattacacatcaacattcctcataaatattcatgcaaaaaatcattaacaaaatattgcaaacaaaattcaaaaacatagcaataatataatgatataaaaagaatcatacaacatggcctaatggggtttatttcagggaagcaaggctagttcaactttcaagaatcaatcaatgtaagctaaaacattaacaggatttatttaaaatcacatatcaaatgatgcagaaaatacgtatcaaatgatgcagaaaaaatcatttgacagaattcaatattcatttgtaataaaaaatgctcagaaaaataggagtagaagggaacttcctcaacttgacaaaaagcatcttcaaaaaacctatagataacattatatttaagtggtaaaagactcaagactttcaccctgaaattgggagcaaagcagagatgtctactctcagcacttttactcaatatagattgaactcagctctgtaccaagcggacctaatagacatttacagaacactccaccccaaatcaacagaatatgcattcttctcagcaccacaccacacctactccaaaactgaccacacagttggaagtaaagctctcatcagcaaatgtaaaagaacagaaattataacaaactgtctctcagaccacagtgcaatcaaactagaactcaggattaagaaactcactcaaaagcgctcaactacatggaaactgaacaacctgctcctgaatgactactgggtacgtaacgaaatgaaggcagaaataaagatgttctttgaaaccaacgagaaaaaagacacaacataccagaatctctgggacacactcaaagcagtgtgtagagggaaatttatagcactaaatgcccacaagagaaagcaggaaagatccaaaattgacaccctaacatcacaattaaaagatctagaaaagcaagagcaaacacattcaaaatctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagtgagaagaatcaaatagacgcaataaaaaatgataaaggggatatcaccaccgatcccaccgaaatacaaactaccatcagagaatactacaaacacctctatgcaaataaactagaaaacctagaagaaatggataaattcttcgacacatacaccctcccaagactaaaccaggaagaagttgaatctctgaatagacaaataacaagatctgaaattgtggcaataatcaatagcttaccaaccaaaaagagtccaggaccagatggtttcacagccaaattctaccagaggtacaaggaggaactggtaccattctttctgaaactattccaatcaacagaaaaagagggaatcttctctaactcattttatgaggccagcttcattctgataccaaagctgggcagagacacaactaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacagagtgttggaagttctggccagggcaattaggcaggagaaggaaataaagggtattcaattaggaaaagaggaagtcaaattgtccctgtttgcagttgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatcctacttacaagggacgtgaaggacctcctcaaggagaactacaaaccactgctcaacgaaataaaagaggatacaaacaaatggaagaacattccatgctcatggctaggaagaatcaatatcctgagaatggccatactgcccagggtaatttatagattcaatgccatacccatcaagctaccaatgactttcttcacagaattggaaaaaactactttaaagttcatagggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagaacaatggaacagaaaagagccctcagaaataatgccacatatctacaactatctgatctttgacaaacctgacaaaaacaagcaatggggaaaggattccctatttaataaatggtgctgggaaaactggctagccatatgtagaaagctgaaactggatcctttccttacaccttatataaaagttaactcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattaacaaatgggatctcattaaactaaagagcttctgcacagcaaaagaaactaccatcagagtgaacaggcagcctgcaaaatgggagaaaattttcgcaacctactcatctgacaaagggctaatatccagaatctacaatgaactcaaacaaatttacaagaaacaaacaaacaaccccatcaaagagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaacgagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcactattcacaatagcaaagacttggaaccaacccaaacgtccaacaatgatagactagattaagaaaacgtggcacatatacaccatggaatactatgcagccataaaaaaggatgagttcatgtcctttgtagggacatggatgaaattggaaatcatccttctcagtaaactatcgcaaggacaaaaaaccaaacaccacatgttctcaatcatagatgggaattgaacaatgagaacacatggacacaggaaggggaacataacactctggggactgttgtggggtcgggggacgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaataaaaaataaaaaaagagaaacaagaggaaataaaaggcatgtatactggaaaaaaaaaaaactacccctatttccagatgatatgatagtctacatagaaaatctcaaggaactcattaaaaagctcatagaaacaataagtgaatttagcaaggtagcatggtacaaaataaacctgcaaaaataaattgtattttaatatcaataatgaatatatgggaagaatttaaaatgcagtactatttacaaccatgaaaacatacttaaatataggtgaaactctaacaaaaacatgtataaaacctgtatgctgaaacttacacaatattggtgaaagaaatcaaagacctaaataaagggaaagacatactgtcatgataaattgaaacactcaagatagtaaagatttcagtttttcccaaacttgtgaacaagcttgatgaaattcctatcaaaactcaagcaatatttttcatagatatagacaagattattttcaaattgatacagaaaggtggaagaactagaagagttaagacaattttgaaaaataataaagcaggaataatcagtatacctaatttcaagacttttacagctacaggaatccagattgtgtcatattggtgaagggataaatacatagcccaatggaacaaagtaaagaatccagaaacatatccacaccaatatgcccaacttacttctgacaaagttgcaaaggcaattcaataaaagaaagagagcttttcagcaaatggtgctagagcaattgactctccatagacaaaagaatagccttggacctaaattttatatctgaagcaaaaatcaaatcaaaattgaccacagatttaaatgtaagtcataaaatcataagacttttagaaaaaaacataggagaaaaatcttcaggatctagagctaggcaaagagttcttatgacatgaaccataaaaactgattaattggactccatcaaaattaaaaattttctctgcaaaaggccacattaagaagatgaaaagacaagtcaaaaagtggtagaaaatatttgcaaatgacatatctgacaaaggaaaattttctagaatagattagctcaaaatgtaaatttaaaaaattcaattagaaaatgaaaaagccatgaacagacatttcacatatttagagaatacataaatggaaaataagcacatgaaaagataattaaccattatgaaaatccaaattaaaagaacagtgagctatgactacacactatcataaaggcaaaaacatagtgacatcaccaaatgctggtaagaatgtgaagaaactggaacattcatacgttgctggtgggaatgtaaaatgttacaaccactctgcattaacagttcgtcaactttttaaaaaactaatcactcaattatcatacaatccagaaatttcactctagggcatttttaccagaaaaactaagggttatgttcatttaaaaaaaaacctgtacacaaagtttatagcacctttggtcacaacagccaaaaattggaaacaacctgatgtctttcaatggacgaattattaaataaagtatgatacatccattccttggaatagtacacatcaataaaaaaaatgaacaaactattgatgcatacaacaacctgagtgaatctccagaaaattatgcagagcaaaaaaaaaagtcaagtcctaaaaggttacatactatatagtaccatttacatactgttctggaaatgacaaaaatggaaatgaagaacagattcacagttttcagagcttaaggaagaagtggggtgggagaaaagtggtcatggctataaaagggcaatatgagaaagccttttagtcatgtaacacatctgtatattaactgtatcaatgtcaatattctattggtaatatcatactgtagttgaggatgttattgagggaaacagaaaagagtacactgaatctatcatttcttataactgcaacagaatctataactatctcaaaaaggtttaatttaaaaaaaatgtagatcatgatttagtaagtaaagcctgagattctgtatttctaacaagtcttcagataatacagattccactgctgtggggaccacaatgtaagtaataagtcattggaaaattggtcactgtaactcatcatactaacaggctaaaaataaaaaaacccatgaccatctcaatagatgctagaaaggcatttaacaagatttaacatctataaaagagaataactatcagcaaactaaaattagaaggccagttccccaacctgaaagtgtgctaatgaaaaacttacagctaacgtcctatcaaccattattgactgaatgcaattttcctaagattaggattaagacagagatttctactctcatcttttttttcaacatttcatttctagagatcctaaccaatgtaatgaggcaagaaaaaaaaggcgtacatattggaagggaagaaataaaactctctttcccagaaaatatgacagtttatgtagaaaattatgagagctaccaaaaacctactaaaactacaaagccacaggatgcaagggaatatacaaattgtacttccaaaattggtgaatttcattttgtctaagttataccccaataaatctgattttaaaagctctatagctaaactaaatagtctagccttggttaaagcagtatcaataatcagtcttataataaatgtcttagctaatggcaagtatccctcactccttttatttctctttttccaaaagagtgacaccccatcaacaatgagtttcaggaagttcattcttcatttgtccccaagataaccagacaatacatttggtttgccccagtctcaagtgtaggacaaatcttctgttaacagtggctctcagagaggttttcactactcctagtatccaacctagctgcaaaacaatataattgtttggataaaagtaaagaagtaaaatccaaagaatacccaaaccttcattaagatagcatttgtgccaggcacggtggctcacgcctgtaatcccagcactttgggaggctgaggcaggcgatcatgaggtcaggagattgagaccatcctgactaacatggtgaaaccccgtctctactaaaaatacaaaaaattagccaggcgtggtggcaggcgcctgtagtcccagctactcaggaggctgaggcaggagaatggcgtgaacccaggaggcggaacttgcggtgagccaagatggcaccattgcactccagcccgggtgacagagcaggactccgtctcaaaaaagaaagaaagaaaaaaaaaagatagcatttgtttgttctatttatttgctccatttattctcaaacagccctggctccctccctcaatcccatctaatttaccccaatcttactgtccttccttaaatgcaatagaatccagaaatgtgtaaaaaggaaaagcaaaaagataataacaaagtttaaaacctaacactaaattacagtgcacagtacatattaaggcactattctagtttcttatgtgtaaaattcttccagtaatgtcctgaaagttaaatgccttccttttttcttttaaaaaacatatttttccattatcatttataaaccaacaactacatttaccctttcaaaacttgggatcctgaccatctatgtcttactcaaatattcccttagtacagcatacttaaagcagggtaaaaaaagaccaaaaggcagataagtgtgtctgaacctcattaaggcacaaatggagttgtatttgattcactgtacttgagctacattcctacaccagaccaaagatgaagccaggaaaattcagttcccttgatttatatactcaccttagcaaaagtgggagtggatctcacaggctactcacagcaaatctgcagtgctctcatttgtcatataggacaaactagaaactcccatggatggtgaggataggcagcatggcggaagtgtgcagagtggtggtgagggtggctgctattgcagcatatagcctaccttaaaggtagatacctgaaagatactcaggtaacaaggaaaaagtccaattctggttgtagatcactcttgggaatagattttttaaagtataagacccccaaaatgccagagtataaacgaccctccctttcaatcatgtatccttgtttttcctatttcccacattataaatatcaaagacctgagcatttacatcagattggtgtgctcaaaacttcttgaaaatggtgtgtaaaatgtcagtaagatgaaatgggttgtaaaatgtcagtaagatgaaatgggttaaaaagagaaatgcagcatattatacttctgattatttctgcagccacaaggttttcattaagcttcaagcatgtgggtttgtgattatgttcatgacaacaaacactaaaacatggaacaagatccgtagttcaaagaaatgaaatattccagaatttatccacatattccaatatactgtttttgtgtattttgtttccaactcaagaggtttcttgaaacctctacaaaaatgttaatcttagtgattcattcacaaagggtttaagctaaaatttttgtagtttagactggagttcaattgtcaagtaatgattttagaagtgatataaatttttaaaattttgatcagatcatagagaatagataaacatgtctattctaatgcaaaattttagctacgtttcctgcattatcttccaggcttaattatgtatgttctggtttaacaggttattttttttttaaagatcattggaaaaatatgttcacaataaaatcattcaagaaatatatttctaccagtactcttgtttcctaacttcctattttttaagttcccttaattttcaaaacacaaacttttcttttctctcctgagttatatttgctgctcctaaccatacttacattgttcaatgccttctaaatataacaactgctatggtctgaatgttagcatccccctcaaaattcatacgttgaaacctaacccttacggtaatgaaattaagagggggggcctttgggaggtaataaggtcatgagggctttgccctcataaatgagattagtgcccttataaaagaggcttgacagagcctgtttgccccttccaccatgtgaggatgtagcaaacaagtgctatctttgaagcagagactgggccctcactggacactgaaactgctggtaccttgatcttggatttcctagcatccagaattgtgagcaataaatttctgttgtttagaaattacccattcttacatgtttccatatagcagcccaaatagactaagatgatacctagtacgtgccttcatgcaagaactgtatatagtagtagacttacatgttatcttagttaaaccagactgaaaaacttctgtagtaaatatcatttctgttttataaatgaggaaactaagatctacataaatcaattaaacttgcccaacttaacaaagtttctagatggcacagccaagctttatccagttctaatgtactccaacacccaaaatgtattttcatcattgtagtaagtactgaggccaccttggttgaacaaccacatttggatattcatatactttactcatatttctgctcagtcttgtacagagaggcctatctggctcctacttaaaaaataaaattatttgaatcataggttctatgtctatttcacaaagaaaactgagaacctagccctccatcaggcctctgaagcaagagccctccgtcattaataaatccagggctttggatggattctatttttagagtgcttgaaaagatccaaatgctagaaaaatcaaattttcaaataggcaggtttctgataataaaagattgaatcaaatatgaaagaaaaaaataattctttcccaaaacagactgcatgaccagatggaagaaagagtttaagaacaaaaagtgccaagtacttaattcaagtgaagaatacaggcattcgagggtcaatgcactacttagaacagccagagtgccagcatggacagaatactgcaccttcattctctgatgcttttcactcatctgctctatcacttccttattccccctctaatgtcattagtttaaaaaggtagaagggcaaaatatagcaaataataaatgctcagttaactgtagattgttcattggatttcatgaaaactatgcacatccttatctgaatttaataacttattttaaggatgatcacctctccagtcatcacttttactttacagaagagaagaaaaaatattctgagaggttaaaatattcccaaagtcacaagaagtgaggcatagtgaccactgtatgccaaaggttgttgtagaagatttacattctctataaaaggtatgtcaactcttagatcattaaatctttttcacagaaaacatgactcattgtgattattcacattaataaaattatattggctcaatgttcaggaaaacaaataagtagaagacaaaggtaggagaaaaagctaacatggatattaagaaggaaaaaaggatgcatgtgctaaaataggtcttcaaaaaatttgcagcaagtattctgactccatcacaagaatctatgatcttcttaagaggtggcttggagccaagaaaaattcactagatgagagtgaaggagtcaaagaaccaatcagcaaaacaaaatttcaatagctaatgctaagtaaaacagatgcccatctctgtctgccctgtccctcaccatacatgggcaatcagttataccactctgtaaccattacctttggttccagatttaccatgagcatgcagtcttatatcggttagtgacaaaaacgctttccatctcttattaacaatactttctgctacatattcagtcttgtattcattccctttacatatatgtaaaaattagcatgtgagtaaaaatcaggttctatatgctgacaagcacaatactgaatgaacctggtatatacaattaataaagagatggcaacaaaaagggagtagctatgatcaaatacaatcattctctctacactgctagaagagtttaataatccatataaacattataatcaaaaagaattctgatgcatttataaggcttgacttaagagaaaaaatagctcttcctaagagaaaaaatagcccttttcttattcattttcttggccatgtttgaaatggagaaagaaaaaaataaataaatgcccaaatattgtgcactttggttatgagtccataaatttctatgcatattattcaagccagaaaagttacacaatcaagtctttttttatttttaacttagtgattaggagtgattaaccatgatcctgttgagttgcaaacgtggcaatgtaaaggcctttatcccctatgctttgtggtcttgatttaatagtgttgtgtattcaatatatttaatatacaggagctgccttttcctggttggtaattaatgtcccttggaccctgaaattgctcagaacagggacttctctgtggagactatattccagattacactgctatttttactttataggttcttgaattttaaggatttatttctagattgtacaggttcacattttgcatcaaggttactagtcagatagcttactcttctgataacaaattccatctctgtgaaatactggcatttgtcatgctatcagtttttgaaatgttttggtagtgcctgagatgatccattgctcatcacttccaccacttctaacctaatccaacctacagccatatctcaaatgtgatcatctcctgctctctagttgattcacattttaggcagggtaatctttttcaagatagattactttattcaagatttactatttataattgacaaatattacatatatatttaaggcataaaatttaatgatttgatagacatatatatttatgaaataatcaccacaaattaattaacctatcacctcatgtagtcatcaatattttttctttattttcgtggtgagaacacctaggatctaccctcttagcaaatttcaagcatataataaaatacaacaactatagtcaccagaacttagatctccagaatgtactcatctaataactataaagtttgtatgctttgaccactatctccccattttctcctcatcatgacctctagcaatcttccttctactctccatttctataagttgacttttttatattccacatataagtgagatcatgcaatatttgtctttctgtgtctggcctatttcacttagcataaagtcctccagattcatccatgttgtcacaaatggcaggatttccttcatttctaaagctgaataaaggtttagaaaggtttccctatccattcatacattgacagacatttaggttgtttccctatcttgttgattgtgaataatactgcaatgaatatgaaagtgcagacatctctctgagatagtgatttttcttgtacagtagcccccctttatctgcagtgttgctttctatggtttcgatcacccatggtcaattgcagtccaaaaatattaaatgaaaaattccagaagtaacaattcataagttttaaattgcttgttgttttctgtagcatgatgaaatctaatgtcatctagctctgtcttgcccaggacatgaatcattcctttgtccagcaagtccttgctgtctatactacccacttgttaatcatcaacatcgtctgctcctgacagccaaccatatcatagcccaataatccaggatcacctgaagcagatgttcttccttctgaggtatagtcagaaacggaataataacctaacactacatctcaatggctacggcattcacctcacttcatttcatcacataggcattttatcatctcacatcctcacatgcatattttattattagttatttgtattaatttcttattgtgcctattttataaacttaatcataggcatgtatgtgcaggaaaaaatatagtatatatagggttcattactttctaaggtttcagacatccactgagggtctcggaacatatttctcacagataaggaagttgctgtatatatacccaaaagtagatcgctggaatatatgtagttttatttttaattttttgaggagcctccatactgtttttcataagtgctgcaccatttacattcccatcagtagtgtacagacattcccttttctccatatctcaccaacacttatctttcacttttctcctagtagccatttcaacaggtgtgatgcgatatctcactgtgagtttgatctgcatttccctgatgattagtgatgtggagcactttttcatatacctattggccatttgttgtcttctattgagaaatgtctattcggatctttgcccatttttcaaatagattgttttgatgctattgagttgttgagttcttcatgtattttgcatgttaaccctttataggatatattgtctgcaaatattttctcccattctgttggttatctcttcactttgtcatttatttctatgcaaatgcttttcactttgatgtaaattcatttgtctatttttgcttttgttgcctgtgcctttgtgatcatatcaaaaaaattattgcccagactaatgtcatgaagcttttttcttttgttttcttctactactttggcaatttcaggtcttaagagttaagcttttaatacatttgaacggaattttgcatgcattgtaagataaggatcatatttcattattctgcatgtgcatatctggtttttccagcaccatttattggacattgtcttttccacattatgtattcttggcacattgttaaagaccagttgactgagtatgcgtgagtttatccttatgctcttttttctgttccattggttttcatgccagtaccatacgttttaattagtgtagctttgtaataaaattttaacttaagcagcctgatacctctagctttattcttcctgctaagtttctttggctactcagggtcttttgtggtttcacaggaattataggattgtttttctatatctgtaactacttccatgaagcttttgatagaaatgcactgagtctgtatataactttggttagtaacattttaacaatattaattcttccaatgaatgaacatgagattttttccatttgtctttaatttcccttatcaatgctttatagtttttagtgtacaagtctttcacttatttggttaagtttatttctaagtattttattctttttgttgacattacgaatgagattgttttcttaattttctttttggacaatttgttgtttgtaaatagaagcacaattgattttgttctgttgattttttattatgcaaccttactgaattcatttgttagttctaacagaattttgttgttgttcattctttagagtttcctgggtatatgatcatgttatctgcaaacaaagacaatttttcttctttttgtttttttctttcctaaatgctctagctaaaacttctgatactatgttgagaagtgaccagagtaggcatctttgtattgttcagtatctcagaagaaaagttttcagtttttcctcatttattatcataagaggtatgggtttttcatatatagacttcactatgttgaagtaagatccttctatcactattttgttaagagtttttatcatgaatgggtattgaactttgtcaattgcttgtcctgcatctatgaaaatgatgttatttttgtctttcactctgttaattgtgtatgtagacccatccttgcataatagaaaacttccactttgtcatggtgttggatccttttatcatgctgttgattagggttactggtatttccttgaggatttttgcatccatgttcatcagggaaattagcttatagttttcttttctttactatttttgcctggttttagtagcagggagatgctggcctcataaaatgagttggaaagtgttcccttttcttcgattttctggaacagtctgagacagattcatattaatttctcttttaataaaattcacctatgaagccatcaggttctgaacttttcattgttggcagatttttcattactaattcaatcatctctttatttgttattgtccttttcaggttgtttcttcccgacacaattttggtagtttgaaagtttctcaaaattgaaaattgatccatttcttttatgtaatctagtttttcgggatataattgtttataatagtgcctatgatttttatttcagaaaaaaattgttttaatgtctcctcttatatttctgatattaaatatttgaatcttctttctctttttcttagactaagggttttttaaaacttttatttatctttcgaaaaacaactttcagctttgctgatttttttctgtttttttattctctatttgatttatttcttttctaatttttattgtgtccttatttatgctaacactaggcttagcttattcttgtttttctagttctttgaggtgcaaagttttttttttcaatataggcatttatacctacaaagattcctcttattaaagcttttgctgaatcccatgggctttgatatgttgttttaattttcctttgtttcgagatacactttacattcccttttaattttcagtgtagagcttagtttccatatatttgtgaatttttcactttcttgctgttactaatttcaacttttattgcactgtgctcagaaaaagtgatttttattttggaatgatttttattttcttaaatttgttgagatttgttttgtgacctaatatgtgatctaacctagagaatgttctgtgtgtactgaaaagttctgttgcgtgaaaagttctgtatacatcagataggaccctttagctctccagtgttgtttgagtcatctgtttatggttgatattcatatttgaatgttccacctattcttgtaaatatggtactaaagtccccaagtgttactgtattgctgtcaatttctgccttcagatctatcaatatttactttatttagataaaacattatctaaatatttagatgctgtgatatttggtgtgtttatacttataactgttataacttactgttgaattaactcttttatcaatgtataatgaccttcttttcctctagataaggttttagacttaatgactattttgccaaatataaatatagccaccagttttcttttatttgcatgaaatatctttttacatcccttcacttttagcctatgtgtctttaattctaaagtgaacctcttatagacaacatatcaccaaatttgttttttgtccattcagccattctatcctatgacttttgtttggtggtgagtttaatccatttatatttaaagaaattatttttaggtgaggacatactgttaccactttgttagttgttttctgtttatcttacagtggttttgtctgtctcatcctcttttgttatcttcctttgttattctatttttgtagtgatttgctttgatttattttctttatcttttgtgtgcctattacacgctttttctttgtggttagctcatggcttgcataaaatatctgatagttttaaccttctattttaagttgataacaacttaactctaatctcatacaaaaacactatacttttactcctcatacatacattttgtgttcttgtagaaagagtgtgcttcatatcatactgtgtaaccactaacacatttttatctattaatgtatgtgttaatattaaaagtaatttatgcaccactttgatgatgttacattaatttgtacatgtccatttggctgtatctgttatatttatgctttcaaatgctttttgttgttgtttagcatattttcatttcaatacaaaaagtcccttaagcatttcttgtaaagtaagtctagtggtgacaaactctctcagtttttgtttatctaggaaagtcactatttctccctcatttttaaaaataattttacaaagtatagtattattgtggagtttttttctttcagaacttttaatatatcatacaaatcactcctggacagctaaaaaaaaataaatacactgtcagtcttatagaggtcaccttgtatgtgatgagttgcttttctcttgctgctttcaaaattctatctttgtctttgacatttgacaatttgattacaatgtgcctcagtatagtcttcttcgggtttatcatgtttggagactttacagctttcatgaactagaatgtcaatttcccgctcaagatttgggaagttttcagatattaattctttaaataagctttcatctcctttatctgtctcttctccttcttgaactctcaaaatgcatattttagttttcttgatgatgcatcatgagtctcataagctttcttcattcctttttattctttgtccttctttgactgggaacctccaaaccatgggtcctcacatttttagatatttttctgattgattgagtctgttgctgacactctctattgctttcttcattccattcattgtattcttcagctccagaatttctgtttggttctatttttatgatttctatgtctttgttgaacttcttgttttgttcttgtattgttttctgattttgttaagttttctatctgtgttctcttttagctaccttaatttccttaaaagaattattttgaactcttacccagttcatagacttccatttctttacagtcagatactggaaaattatcatgttgctttggtgatatcatgtttagctgatgttttgtgtttcctgtagccttgcattgacatctgcacatttgagggagcagtagcctcttccagactttatgaactggcttcagaaagatatttacctaaggtagggtgtgacagtgccaactgggtagggtgtgacagctttggctcagtttgggggtgcttagtagtaattctggcttcaggcagatgcaacaatgaaatctccacagagttacatcagctaggtcagcatcagcagagactatgaggatcttcagcagccaaggttacaaatatacctggcagcaaaaaggactcttggtgtccttaatggaaaaggttgctggggtcctctagttctccttttccctcatgggggaagtcatgaccaagggaatcccttttagcaccaggtctgacatgtgggcgcacacaaccagtggcagcaatgtccgggtctgggacacaggtgcccttaccataatgatggtgtaagtgtctaaggcctgagtgtgctaagcagccgcgaagacagggtccaaggctttggggtgtgtagaacaaccacagcacttggaaccatggaatgggcacactcactgcagtagtgacaccgttatctaaggtgtgaaaatgtgtggaatagtcccagggtctgtggggtctatagagtcattgtagggaactggtagctctggctggaaaagagagaaatggcaggcacagcagcaaatcagcaggatggggaagaaggtgcagctgtggtatctctgctctcagatggggtggggttcaatcaattatttattacttaaactgaaaagccaggtttacattattaataagcttacattttatatactattagctatgtatctggaaggaatgcaggagacactgactacctttttacaaagaaaaaaagagacattatttgtcaaactcctttaaaacattgttttgtagaaatacacaggtaaggctacaaagtttaactcaataataacagttgcaaaaaaatacctagaaaaatcatcaaatcatgacctacctctttcagttattttttaataacctgcagcaaaaaaagcaactttctcacagtaacctatatatattaaatgtgctgccaacccagatctttagaacattacaaacaattttggaaaaggacactttttggaatatatatttaagcctggttaaaagatagaaccataatacaaacctactatacagcaaggactttgcacagaagcaaattaacacactatttgctaactcaatacagcactatttctggtctacatctttccatgtaagcaatcttgtcaactacaaatgtactatgtacctactatgtgccagtcactataaagtgttagatatcaaaaatgactataatgggagagcttttttattttttccatttaatcttttgaaatgagttgtaaatctgtaaagaaaattattagacttttctcagttgtagctcctgcaaacatggcataagaatggtgcttacttaatcttacagaggaaatcttcaatctacagagttggcaaaataagcagataaaatctggaatgattaacacgtcatcacagcagtagttcttgtgtggttttctagtcataccttcaaatgtaataaattaagtgttcctactttgggctttctcttgctgaaagcagtattgttcactcaagtcaagtgttcattttagagatgttttaccagtgtaaaataactccatcttgtggattatcctgaccatggcattcagatctcacctttcttctttaattttttaaaggtaagactagcatcagcctgatcctttccaacctctgtaatctgtcttgtttcctactggatattaatcttcacaagcatcccgctatatggcataggtatataaaagtgtctgccactcctagtatcatcaatcctatgaccactatggagcttagattttccagcccaccaggaccaatacagcttagtgtcagaagccatcgattatactgtccctattcattttaattccattgaaatatctaggagggaagatagtaaacatagtaaggaaggctctttgaacggctgggatataagagagtggtaatccaatggcctcctcactttacatggacttttgtccttttgtacacctgtctcctgtttgctttctgaagatgataattataattctgtatatttcaactcaaatacacttaaaactgacttataaaaataaacattcagccgcacatcaagaaaaatcctccattttgataccatatttttgaagttcaaaatttaaaggaacttcttctctctcacccactttgcacaataacaattctaacatccaatatttcttccaggtgtcattccaggtcccccctttggaagctgccagaggctttaatctaaagcacactctgcttgtgtaaagggaagttatcagatgtttaatatatccactaattaatagaatatttttttcctatataatccacaaatttatgatggaaggaaggataaagctgttggaagtattttatcttaagaacaaatgcaaatgtactttattctatcacttaaggttacagaaatctctattctggaaatgcatatacagacactaccacaaaatccagaatatattttatatcgtgatcaaaaatgcaggataagcaaggcctcagtatgcagtagaattagcacattattttctattttaatatgtcactacttctgttctacagaatgtaactataaacatactcttttggagaacttgtaaaacattttcctatctattgcttacatttttatggaaatggtataactgaagagacatcaaggagagtcttttagtacatattatgttaaatattaaaaatattttatcaaaacatagcccataaaattattaacccagaagaatatcataaaatattagctcagttttttaaggaaagtatatttttatactctaaatatatcataagatttacagatattcaaagatctgaaactaaagccctaatatttaaaatataacaaagctgcctccaaaaaaatctcaacttttcttgttatagattaatgattatcatcagaaaaaaagtctatttacattaacataaaaactgaccagcctaattttaacttcatccaaaagtttgtctcaataatttgaacaaataaaaaattaaaaacttatttctgaattcacatcgctaaagataagtcagttatctgtgcctcaaggactttttctcagctcagttaaaagataaaaagatttgtttttcatgcttgaggctttcaaaggctatggcaatttgtaaaatgtcaatatccactgaaatttggcccttagctctctaaattctctctttgtacatgcagatgcttctgcagataattgtgactactttcaggcataactaaaaagaccagtatataactaagtgttttccgtataacatattaagtaaaatgtgtcctttgtcttagagagcgaacactatatattgaggctggcaatatttatcattttgctcaaaagtaagcactctacgatttctgcaccgcattctggtctaacaactccttataactttttaagccatctatagtgcttttaggaattgaaatcagatttcccagcatccctgccattgtatcaatgacatcacgagctctactcacagtaatgtaaaaaaaaagacatcagaactcaaaccatcttatattgagagtaatagaagtcataaaaagagttttactagaaaagcctgtaaaaaaaagaatttgttttcagaagaaaaagtacatgaatgagaatacaactttcaaggtaataaagaatgaaactacagtttgggcatacctactaaatcacattcatcagaggatattaatgtattccaaacaaaagcaagaaaaacagaacattctacctcaccctgaaatattcaatattccctctctctctctcactctctctctctttctcacacgcacacacacacgcacacacacgtttattaatatgtgagatgtgtgtagaactaaaatattcttggagcatctaggattcacttccaaagtttcttttctctttaacttccccataaagctgtctcatagtttcagtaataacagaattcttggccacattggtaaaagagtggttcagaagtaaataatctgaatgttcattgttccaatacttcaagtccatgcctttgaactgattacacataattcttccatctctgacactatttataagctaatataaaatcacctataacagggttgtcaagattatggtccacagaccacttgcatcataatcatacggaatatttgataaaactagaatcttcagcccctacaagacctaccaaattcaaatctctaaaagtcagcccagaaatgtgtattttagcaagcaccccatgtgagactcataccaaaggaagtttgagaatcacagatctggaatctgaaaggtctgtaaacaaattcagaagacatcttccattgttttgtctacagtctgtgaaatgcaataagaaatttcttcccattattaaagtataataagaatctatgtttaaaaatctattcacaaaagtaagcgcaagctttagatacttgttaacagcactgtacatgtttttaattatagtaaatcaagtcctggatcagaagctaaacagtacatcagaaggaaaagcttatttcagcaggataatctcctcctacaggtggacaagattatttatacaagtcaatataaattccactaaaaaatgatgcgagaacatacctcttagtctaaaaagtggtaaactacatttattaacaaccaaaaatcaacttcctatattacaccgacctatgtacttgccatatgttgcactctacaacaatgtatcttcgggggctcaggcatttctttaaatttttccatttttgataatttcaacttttattttagattcgggagtacatttgcaggtttgttactttggtatattgcatgatgctgaggtttgaggtacaattgatcccgtcacccagatactgagcacaatgcccaatagtttttcaacttttgccatccttcctagctccccactgtagtggtccctcggtgtccatcattcccatctttatgtccatgagtacctattgttgaggtcacccttataagtaagaacatgaggtatttcgttttctgttcctgtgttaatttgtttagaacaatggcctccagctgcatctatattcctgcaaaggatatgatttcattcctttttattgctgcaaagtattcaatggtgtatatgtaccacattttctttatccaatccacgactgatgaacacttagattgattccatgtctttgttattgtgaacagtgctgtaatgaacatacaagtgcatgtgtcttcttggtagaatgatttattttcttttggatatatacccagtaatgagactgctgggttgaatggtagtttaaagttctttgagatatttccaaactgatttccatagtggctggacaaatttgcattcccactaacagtgtataagcattccgttttctctgcagccttgacagcatctgttattttttgactttttaataataaccattctgactggtgtgagatggtatttccttgtggttttgatttgcatctctctgatgattagtgatattgagcattttttcacgtttgttggcatgtacatctcttttggagaagtgtctgttcatgttctttgcccatttttaagtggagttacttgctttttgcttgttcagttaagttccctatagattctggatatgaaatctttgtcagatgcatagtttgcaaatacttttcccattctgtaggttgtctgtttaatctgttgatagtttattttgctgtacagaaaagctctttagtttaattatgttctccttgtcagtttttgtttttgttgcaattgcttttgaagacacagtcacaaattattttccaaagctggtatcgattatggtatttcccaggttttcttcaagaattcttgtattttgaggtcttacatttaaatctttaatccatcttgagttaatttttatataaagtgaaaggtaggagtagttccgttcttctgcaaatggctagccagctattccagcaccatttattaaatagggggtcctttccctattgcttacttttgttaagttttttaaagatcagatggctgtaggcatgtggctttatttctgagttctctattttgttccattggtctatttgtctgtttttgtgcatgtaccatgctgttttagttactgtagccttattgtatagtttgaggtcaggtaatgtgaggcctctggctttgttctttttgcttagcattgctttgactatttgagcctttttttgtttctatatgaattttaaaatagttttttcaaattctgtgaaaaatgacattggtagcttgagaggactcgcaatgtgtctgtaaattgctttggacagtatggccattttaacaatattaattcttccaatccatgagcatgaaatttttttcagtttatttgtgtcatctataatttctttcagcagtatttgattgttgtccttgtagagctctttcacctctttggttacatgtattcctaggtattttatgtatatttatttaagctattttaaatgggattgtgttcttgatttggctcgcagcttaaacattattgatatatagaaatgctactaatttttatacattgattttgtatcctgaaacttcattgaaatcatttgtcagtaccagcagctttttgacagagtctttagggtttttttagctctagaatcatatcatgagcaaagagagataatttgactccttctcctatttggatatcttatttctttctcttgcctgatttatctgataaggactcccagtactatgttgaataggagtggtgagagttagcttcctgttcctgttctcaaggggaatgcttccagttcttgactgcttagtatcgttgtctcctatgggttggtcatagacagttattaaaattttgaagtatatttctttaatgcttaatttcctgagggtttttttatcatactgggatgttatcaattttatcaacagctctttccacatctattgagatgatcgtatgattttctttctaattctgtttatatggtgaatcaccttttttgatttgtgtttgttgaacaaacctcgcatcccagcaatgaagcctacttgatcatggtgcattcactttttgatgtgctgctggatttagtttgctagtatttccttttcaagatttttgcatctatgtttaacagagatattggcctatagttttgtttctttgttatgtctttgccaggttttggtatcagggtaatgctggctttatagaatgagttagggaggagttcctcctcctcaattttttggagtagttacagtatgattagtgccaggtcttttttgtacatcttgtagaatttggctgtgaatccatctggtctggggcttctttttggtggtaagttttttattgctgattgaatattggaacttgataccattctgttcaaggtttcaatttcttcctgattcaatcttggaaggttgcgtgtttccaggaatttattcatttcctctagattttctagtttgtgtgtacataggtgttcataatagtctctgagaatcatttgtattcctgtggaatcagttgtagtcacctttgccattttttattgtgcttatttggactttcttgttttcacagttaatctaaagagcaatctatcaatcttgtttattctttcaaacgcctacttctggttgctttgattctttgtgtggatatttgggtctcaatttcattcagttcttttctgacttaagtgattcctgctagctttgggatttgtttgttcttatttttctagttcccctaagttcaatgttagatcattaatttgagatcttgctaacttctttttattattattacactctaagttctggggtacatgtgcagaacatgcagttttgttacataggtatacacttgccattgaggtttgctgcacccatcaacccatcacctacattaggtactcctcctaacgttatccctcccctagcccgccacccactgacaggctctggtgtgtgatgttcccctcggtaagtgtttggcactataaactttcctcttaacactacttatgctgtatcctagatatttttggtatgttgtgtctctattttcatttatttgaaaggttttttttgtttcttttgtttttgttttcttgatggagtctcactctgttgcccaggctagagtacagtgttgcaatctcagctcactgcaacctttccctcccaggttcaagcgattctctgcctcagcctcccaagtagctgggattacaggtgcccaccaccacgcttggctaattttttgtattttactagagatggggtttcaccatcttggccaggctggtcttgaactcctgaccttgtgatccacccacctcagcctcccaaagtgctgggattatagccgtgagacaccactcccagccttgacagtatttgtttatttctgccttaattttattgtttacacaaaattcattcaaaagcaagttgtttaatttccatgtaactttgtggttttgagagattttcttggtaatgatttctatttttattccactgtggtctgagattatagttggtatgacttcagtgtttttattttattgagactgctttatggccaagcatgtggtctatcttggagtattttccatgtgcaattgagaatatacattctatggttgatgggtaaagtattcagtagatgtctatcagctccaattggtcaagtgttgaatttaagtccagaatttctttgttagctttctgcctcaatgagctttctaaggctgtcagtcagttgttgaaatccctcagtattattgtgtgactgtctacatttcctaacaggtctagaagtactttatgaatacaggtcctccaatgttggatgtgtatatatttaagactgttaagtcttcttgttgaatttaaccctttatcattatgtaatatccttctttgtccttttttactgttgttggtttaatgtctgtttcatctaatataagaatacttatccctgctctttgttgtgttctttgtgcataatagatttttctccaaccctttattttgatattatggatgtcattatgtgtgagataggtctcttgaagacagcagatggatgggtcttgcttttttatccaagttgccactctgccatttaagtgggatgtttagaacatttacattttaatattgatatgtgaggttttgatgctatcatgaagttgttgactggttgctttgtagtttctactgtttggttgctttattgggtctgtgggctatgtacataagtgtctttttgtggtagcaggtattgttttatcattttcaagatttattgtaaagttggtctagtggtaaattcccttggtacttgcttgtctgaaaaaatattttatttctctttcatttataaagcttagtttggtgaaatatgaaattcttgattggacttccttgtctttaagaaggccgaaaataggccctgatctcttctggctcgtaaggtttctgctgagaccactgttagcccaatagagttccttttgtacatgatctgaccttttactctggttacatttaattttttttctttagcactggatttggacagtctggtgaccatatgccttagggatgttagttttgtatagtatttcataggtgttctctggatttcttatacttggatatctacctctctaggaaggttagaaaaattttcttaaatttttcattcaaatatcttttacaggttgttttctttctctacctcctctcagaaacaccaataatttgtatgtttgtatgctttacaagatcccatatttctcaaatgttttgttcatttattttaattctttttctttattgttaactcactggattagttcaaaaacccagttttcaatctctgaaagtccttcttcttggtaaagctacttataaagttttcaatcatattttgaaatttcttaggtgaggttttcaattccagaagctctaattgatttctttttaagatgtttatctctcccttcatttcccatattgctttagaagatttctttgtgttgattttcaaccttgacttggatcttgttgagcttccttgcaatccacgttttacattctttatctgtcatttgtgagtttccattttgattatggaccattgctggagagttagtgagaccctttggtggtgtcactacattcggatttttcatggtgtcagaattcttgtgctagttccttatcatttggagatgctggcaattctaatttttatagttattttcatgtgggtaggattttttctttttctctataatactgttgttttgtttcttctttccctgtctctttaccctcttccctagagtgtgtgactgaagaaaatgatgggtaaggtcttttgtctttgaccctatagcactatgcacttctgttggtagatttttttactggggtatgcaatttgacctataagtcagtagatggcgcttatgggtaagagccggctatggccaataaggcagggtatatgcttgatccttgtttactggtaaaagctgtctgttgccccagggaatgggctgactcctggaaagcacagcagtccaagctccctcctcagccctggaaggagacggtagaggggaagggcaagatggacaaatacacctacaggtcccctgatggcaggcacatgcacaagtgctaagagacagtccagtgggcagccaccaagtacccagaggtataggtaggcatgaaactgggaaacctccttagccctgagttccctgcctggagatggcagggggcagcctagacttctaatcctggaaagtggacactccagatggctgtaggtctgcctgggcatggagcagagaggaccatcctgcaccaggatctctctgcataggaagtgtgaagcagctcaggctgctgttccaggtgagcaggtgctccaaatgcttggaaatctgcctgggtgtggagtggagatggtgtccctgcaccaacatctctgaacaaaaagagtggggcaattatgcctgcagaaccaggcaaatgagggcttccaatgcatggagatctgcctgagcatgaggcagagagggcacccccatacccagatctctgcacagaaagatgcggtgactcaggctgttagtctatgctagcagttgctcctaattcttggagatctgcttatgtatagagcaaagagggctccactgcactacgatctatgcacaggaaaagtggggtggcttaggctgctgatcaaggtgaagggatgctcaaaaagcctggagatctgcctggctctggaacagagaagaccctgctgcacaaaaatctcaggggaacaggctggggcacccagcaatggcacatgcagaccagatccaggttgtcaagctggccctggctgcaggtctcatcattcagaagaactgtgattgggggagggcacaattccagtgccaactgttgaggcactttccaaagttctggctgtggtgacccctaccctgctccaaagcaagcagttcaattgctggcccaagactaaaatgcctacatgtccatcatgccagctcaccacagaatggctgattttatatgaactcaggttaaaaattgtgtgctgttctcagtcccacatctagggaaatgcttgcagctctttctggtatctttccctcacagcatctctaagcctctccctaagttacctccaggacctgggagaaacagagcgttcttccttgacctgggttgctcacatacccagtggaaaagtgtgtcacagagggaggttctctgcttctctcacatactggggcttcactcacttttatcagccagtctctgtcatgtggctgtttgcccacattttcccccaccaggatctgggatgtccttcatgattccagtggattcccatttttcttcctgaattaaagttcacagagttggtctttatgcactatcttgctatttccaagtgcctgaagcacactaaaagcctctaatccaccttcttctaaattttttctttgaggggagaaaagaagactgtagtgtaccactccatatatcaacaagaatagtgaatgaaggaaaaagtggcagagattatctaaatgcagtatataaaatatgtatgtgtgaatgtgtatatctgcatatataagtgtgtataaatatagtttgagaccactcaggcctattttttatttttactttttaaaaaagaactacaaagcaccatcactgtctgtggcaggtccattatatatgcctgcccagcttcccttcctcttcttgtgacaaccacaccttatgcctctttcggagggcaacccctgctgagtctcagcagctctgatgagctgttagttactgtgccttggtaactcaatccaagattgtacaatcagaatctgactcctgagaatttaaatctagataagggccatacgaaatagctggaacctaaccattccaatttcccaggaactatgttttgattgtgagtcctctcactatcccagttcttgctcttgaagcttggttgcttaagtttgccttcaatttctgttaattacctaatatgtttctagtatatttcattatttcatgatgttatccagatagcatttctcttgccagcaaccaaaaaactccaactgataagagagacacattttgagaacacaccttgtttcggtacactatttgtagggcactgtttctcaatgagcatttaaagcactataaaaatcccaccactgcatccatgaaaccctttcagattgtcataaaatcaagagccactcttgtgtttatcctgttagcctaacaaaaccctccacaggctatctgtctattttctaactaaaggtttgaaatctcctgttatgaatatccagtacacagtcaaatgtccttttttgacttgcatatttaacgccttattgcctgtttactgctttacatttatgctgatttattaagtcacatatgcctctattaacatcaagtatgtcatttttaccttagaatatatgcaagtaaaatgcataataacatggactgtgcaaaattatcattcaccataacaataatatgcatagttacatgcacaattcaaaaccacatctctgaagggcaataaacaaacacatgcacattgtaaaatattcataagtcattaaagtaaaacatagaagtccccctaaacacacatttccactgaccctgcaaatctcctctctataaattacagctaacagttggggtgttacatttgtctcagtacctcagcaatgactcactcatagcaatagttctttagaggcctataagcagactgaatggaagagttaaaatgggttagtggttaaaatctcccaccaataacctaaaaaattgagagttatttttatcttacttttctaagatatttttcaaggtaattggagaaaacaatgagtatggtcatattttacattaggaagatgagtcaaaaaaggatttaaatgagtttctgatttaaatacgtttcatttccttaataagtttttccaagaaaaagaagagttagagaaaagaatttgaattttcgaaggaatgtttttacaaatatcatctggctgattcaatcataaacaagagtaatttcataataccaatattgaatcagtcatagctattcattattacattctataagaatttcttaggaggaatactattttggcataatttgagttaacaaaaaatacgtactgtataatttttttaccaagttaaatatgagccaagacttgatctacactatagaccaaatggatctaataaatatttacagaacatttcatccaagagctgtagaatacacattcttttactatgcccatggatagaccatatgttaggtcaaaaagcaagttttaaacattcaaaaaaattgaaataatatcaagcatcttctctaaccacaatggaataaaactagaaattaataacaagtggaattctagaaattatacaaatacatagaaactaaacaatatgctcctgaatgaccagtgggtcaataaagaaattgagaaggaaattgaaaaatttcttgaaacaaatgataatggaaacatgacgtattaaaacctttgagatacacaaaagcagaactaagagggaaatttatagctataagtgtctacatcaaaaaagagaaaaaattttaaataaacaatctaatgatgcatcttaaagaactagaaatgcaagagcaaagcaaacccaaaattagtagaagaaaaaaaaaataaaggtcggaccagaaataaatgaaattgaaatttaaaagaaaaaatacaaaagatcaacgaaacaaaaaattgggtttttgaaaagtcaaacaaaatgaatgaatctttagccaaactaagaagagaggagatccaaataaataaaatcagaaatgaaaaacagacattacaacaaatagtgcagaaattcaaaggatcattaatggctgccatgagcaactatgtgccaataaattggaaaaactagaaaaatgggcaaattcctagatacatacaacctaccaagattgaaccacgaagaaatccaaaatctgaacaaaccaataacaagtaacaagattgaagccataatgaaaactctcccagtaaagaaaagcccaggacctgatggctttactgatgaattctaccaaccatttaaagaactaataccaatccttttcaaactattctgaaaaatggaggaggagcaaatatttccaaactcatactacgaggctgctattaacctgttaccaaaaccagacaaagacacattaaaaaaaaaaaactacaggtgagtatgtctgatggatactgacacaaaaatcctcaaaaaactactagcaaaccaaattcaacaatacattagaaaggtcattcatcatgaccaagtgggagttatccctgggattcaaggatggttcaacatatgcaaatcaatcagcgtgatacatcatatcaacaggatgaagaataaaaaccatatgatcatttcaattgatgctggaaaagcatttgataaaattcaatgtcccttcatgataaaaaaaaaaaaactctcaaaaagatcaggtaaagaaggaacatgcctcaacataataaaagcaaaatatgacagacccacagctagtatcatattaaatgaggaaaaactgaaactctttcctctaagatctggaaaatgaaaaggctgcccactgtcaccactgttactcaacatagtactaaaagtcctagcttgagcaatcagacaagagaatgatataaagggcatccaaattggaaagaaaaaagtcaaattacccttgtttgcagatgatatgatgttatatttggaaaaacctaaacactccaccaaaaaactattagaaatgataaacaaattcagtaaagttgcaggatacaaaaataacgtataaaaattagtagcatttctatatgccaacagtgaacaatctgaaaaggaaataaaaaagtaatgccatttacaatagccacacataaaattaaataggaattaaccaaagaaataaaagatctctataatgaaaactataaaacactgatgaaataaattgaagaggacaccaaaacataaaaaaatgccatgttcatggatttgaagaatcaatattgttaaaatgtccatactacccaaagcaatctataggttcaatgtaacccctagcaaaataccaatagatgttattcacagaaatagaaaaatcaatcctaaaatttatgtggaaccacaaaagacctggaatagccaaagctatccttaagccaaaaaaaaaaaaaaaaaaaaaaaaactggaggaatcacattatctgacttcaaattacactacagagctgtgataaacaaaacagcatgatactggtataaaatcagatatacagaccaatggaacagaatagagaacccagaaacaaatccatacacacacagtgaactcattttctacaaaagtgccaagaacatacaatggggaaaagacagtctcttcaataaatggtgctgggaaaactgaatatccatatgcagaagaataaaagtagatccctatgtctctccatatgcaaaaatcaaatcaaaatagattaaagacttaaatctcagagctcaaattatgaaactattacaaggaaagattggagaaaatctccaggatattgatctggacaaaaaattcttgatcaatatcccacaagcacaagcaaccaaagcaaaaatggacaaatgggatcacatcaacttaaaaagcttctgcacagcaaagtgaaaagatgactcacagaatgggagaaaacatctgcaaactgcccatctgacaagagattaataactagaatatatgaggagctcaaacaactctacaggggaaaaaaatctaataacctgatccaaaattagggaaaagatttgaatagacatttctcaaaagaagacagacaaatggcaaacggacatacgaaaacgtgctcaacatcactgatcatcagagaaatgcaaattaaaactacaatgcgatattatctcacctcagttaaaatgacttatacccaaatggcagtaacaaatgctagtgaggatgtggagaaaagggtactgttgcacactgttaatgagaatgtaaattagtataaccacaatggagaacagtttggaggtttctcaaaaaactaaaaatagagctaccatatgacccagcaatcctacagctgggtatatacccaaaagaaaggctatcagtatatcagagagatatctgcactattaggtttgctgcagtactgtttacaataactaatatttaaaagcaacctaagtgcccatcaacagatgaatgaataaagaaaatgtggtacatacacacaatggagtactattcagttataaaaaagaacgagagcttgtcatttgcaacaacatggatgcaactggagatcattatgttaagtgaaataagccaggaacagaaagacaaacatcatatgttctcacttatttgtagactctaaaaatcaaaacaattgaactcatagatgtagagagtagaaggatggttaccagaggctgggaagggtagtgggagggttgtggggagttggatcagtaaatgggtataaaaaataagtagaaagaataaataagacctggttgggtgcactggctcacacttgtaatccctgcactttgggaggccgcggtggacagatcttgaggtgggtggatcacttgaggtcaggagttcaagaccagcctggccaatatggtgaaaccctgtctctactaaaaatacaaaaactagccagggatggtggcatgtgcctgtagtcccagctactcgggaggctgaggcagaagaatcgcttgaacccaggaggcagaggttgcagtcagccaagagggcaccactgcactccagcctgggcaacagagcaagactccgtctcaaaaataaatgaataaataaataaataagacttactatttgatagcatagcacaacaaggtgactatagtcaataactaaattgtatattttaacataactgaaagagtacaactggattatttgtaactcaaaggataaatgcttgaagggatggagaacccattttctataatgtgcttatttcaccttgcatgcctgtatcaaaacatctcatgccccccgtaaatatatacacctactatgtacccacaaaaattaaaagtataaataaaaaaataagcttgaccctaaaatttacattcattttttctaagagcatgctattcttgaagttttgtttccttggctcagccacttctttttgtctcttctggcttctcctcctgctctccaaaaagtgggtattcttttcacgtgtggaggcagagggtacataggaaatttctgcatccccaatcagcctaaaaatgctcttaaaaatacatcttcaagacatcatacttcagctctcctctccaaacactccttaattctatctattgtctcagcttcagttacctcctttaaaagttccatgtcttccaaattcctgtccctagccatgtactgtctctggagagtacccacgactcccatctcctgtcttctaaacatctctgcctgcacatcctgttgacagttcacatgcaatgtgtcttagataaaatttatgttttctactttacctattctatttcccatatttcttggtcatgccagctcaaaactttccaactcatctttgatcccttacacacactcctttcttccctcttcattcacagcagttggcatatcttaggaattccactcaataatgttataccatctttcccttttcaatgaccacagctactgttctacttcctctttatactgtctattatctagctattgcagtagcctccaaactactgcccaccactgtctttccacttccgtttcactccccaccatctaacggattaaccttcttgagtaaaattctgatcagaagactcttgtttattgacactccaaagctcttttcatgttctatgatgaagccaaattaatgtttgaacttccttctttccccatacttgtcacatccatatgtttactttcagattttccttcatttggacactagcattccctctttcctgtctctgtatgcttaaatcttaaatattcttttcttttttcctgcagtttttttacataaatatattgcataatggtaaggtttgggcttccagtgtacccatcacccacatagagaacattgtacccaacaggtaatttttaaaccctcactcctctcccatccttcctctttttagagtccccagtgtctgttattagggtaaacatgtgtatccattgtttagctcctatttataagcgagaatatgcagtatttggttttctatttctgagttatttcactgaggataaatattatttaagaccttcctcttaaaagtcttccttgacttctaagatgagagtaatcattctattctgtcctctgaattttcatctctctccttcttcctcaccccctctccttctctctctctctctcagtaacgcctctcaatttaattggtgtaacagttatttctataatcactatgttgtcaccaggccttacccatctatgggcactgatgggtccccttaatagtaataaattcaatgtcaccaactcttgaacctgctgatacaggattactaggcccatacaagttacaagtacttctaggaggcttcaagacatgtttcccatgtattggtgaataaggcttctctcactacagtttttatttagatgctcacctttgtttgcatggggctcagacatgaatctattgagggtgggagtattataaaaccatgaaaaacaaacattatcatcagaattgctctgtctcaatgtccaagaccaaatcaagctaagaatagctggctcttcttttctgaggaaaactctctcgcagaagttttgttagatttttatccagctaggcttctctgagctcactcagcccatctaccagctttgccacgtacctgcctattcttctgcctagactcatcctgtagttagtattcactaccgactggatggtaaactttttgagagtaagccccatgtttaagtaatatatatcctcaccaaaacatttaacatagcttcttacacacagacaaacctcaagggtaaaactaaaataaaatttaaaaagtaatccaaattaatgattacttaacagcatttaaaaattaactccaatatttacaatcttttttccttttttttaattattattatactttaagttttagggtacatgtgcacaatgtgcaggttagttacatatgtatacatgtgccatgctggtgtgctgcacccattaactcgtcatgtagcattaggtatatctcctaatactatccctccccgctacccccaccccacaacagtccccagagtgtaatattccccttcctgtgtccatgtgttctcattgttcaatgcccatctatgaatgagaacatgcggtgtttggttttttgtccttgcgatagtttgctgagaatgatgatttccaatttcatccatgtccctacaaaggacatgaactgatccttttttatggctgcatagcattccatggtgtatatgtgccacattttcttaatccactctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccttgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttgtttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttggcttttgttgccattgcttttggtgttttagacatgaagtccttgtgcatgcctatgtcctgaatggtactgcctaggttttcttctagggtttttatggttttaggtctaacatgtaaatctttaatccatcttgaattaatttttgtataaggtgtaaggaagggatccagttccagctttctacatatggctacccagttttcccagcaccatttattaaatggggaatcctttccccattgcttgtttttctcaggtttgtctaagatcagatagttgtagatatgcagcattatttctgagggctctgttctgttccattgttctatatctctgttttggtaccagtaccatgctgttttggttactgtggccttgtagtatagtttcaagtcaggtagcgtgatgcctccagcttcgttcttttagcttaggattgacttggcaatgcgggctcttttttgttccatatgaactttcaagtagttttttccaattctgtgaagaaagtcattggtaacttgatggggatggcaccaaatctataaattaccttgggcagtatggccattctcaggatattgattcttcctaaccatgagcatggaatgttcttccatttgtctgtatccttttttatttcattgagcagtggtttgtcgttctccttgaagaggtccttcatgtcccttgtaagttggattcctaagtattttattctctttgaaggaattttgaatgggagttcactcatgatttggctctctgctagtccgttattggtgtataagaatgcttgtgatttttgtacattgattttgtatcctgacactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactctgttgaataggagtggtgagagagggcatccctgtcttgtgccagttttcaaagggaatgcttccagtttttgcccattcagtatgatattagctgtgagtttgcatagatagctcttaatattttgagatacatcccatcaatacctaatttattgagagtttttagcatgaagggctgttgaattttgtcaaaggccttttctgcatctattgagataatcatgtggtttttgtctttggttctgtttatatggtggattacatttattgatttgcatatattgaaccagccttgcatcccagggatgaagcccacttgatcatggtggataagctttttgatgtgctgctggattcggtttgccagtattttattgaggagatttgcatcaatgttcatcaaggatattggtctaaaattctcttttttggttgtgtctctgccaggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttagtaagctattgattattgccacaatttcagagcctgttattggtctattcagagattcaacttcttcctggtttagtcttgggagggtgtatgtgtcaaggaatttatccatttcttctagattttctactttatttgcatagaggtgtttgtagtattctctgatgttagtttgtatttctgtgggatcggtggtgatatcccctttatcattttttattgcgtctatttgattcttctctctttttttctttattagtcttgctagtggtctatcaattttgttgatcctttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgcgtctttgttctcgttggtttcaaagaatatctttatttctgccttcatttcattatatacccagtagtcattcaggaacaggttgttcagtttccatgtagttgagcggttttgagtgagtttcttaatcctgagttctagtttgattgcactgtggtctgagagacagtttgttataatttctgttcttttacatttgctgaggagacctttacttccaagtatgtggtcaattttggaataggtgtggtatggtgctgaaaaaaatgtatattctgttgatatggggtggagagttctgtagatgtctattaggtacacttggtgcagagctgagttcaattcctgggtatccttcttaactttctgtctcgtagatctgtctaatgttgacagcggggtgttaaagtctcccatttttattgtgtgggagtctaagtctctttgtaggtcactcaggacttgctttatgaatctgggtgctcctgtattgggtgcatatatatttaggatagttagctcttcttgttgaattgatccctttaccattatgtaatagccttctttgtctcttttgatctttgttggtttaaagtctgttttatcacggactaggattgcaacccctgcttttttttgttttccatttgcttggcagatcttcctctatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgcttattttgctcattagttgacgcagtttcttcctagtctcaatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactctcttctggcttgtagagtttctgccgagagatccgctgttagtctgatgggcttccctttgtgggtaacctgacatttctctctgcctgcccttaacattttttccttcatttcaactttggtgaatctgacaattatgtgtcttggagttgctcttctcgaggagtatctttgtggtgttctctgtatttcctgaatctgaatgttggcctgccttgctggattggggaagttctcctggataatatcctgcagagtgttttccaacttggttccattctccccatcactttcaggtacacaaatcagacatagatttggtcttttcacatagtcccatatttcttggaggctttgttcatttctttttattcttttttctctaaacttcccttctcgcttcatttgattcatttcatcttccgtcactgataccctttcttccagttgattgcatcggctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatttcttcctgtagctcggagtagtttgttcgtctgaagccttcttctctcaactcatcaaagtcattctccatccagctttgttccattgctggtgaagaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccacttcagaccctgtttgcctgggtatcagcagcggtggctgcagaacagcagattttcgtgaaccacaaatgctgctgtctaatcgttcctctggaagttttgtctcagaggagtacccggccgtgtgaggtgtcagtctgcccctactggggggtgcctcccagttaggctgctcgggggtcaggggtcagggacccacttgaggaggcagtctgcttgttctcagatctccagctgcatgctgggagaaccactgctctcttcaaagctgtcagacagggacatttaagtctgcagaggttactgctgtctttttgtttgtctgtgccctgcccccagaggtggagcctacacagacaggcaggcctccttgagctgtggtgggctccacccagttggagcttcccggctgctttgtttacctaagcgagcctgggcaatggcgggcgcccctcccccagcctcgctgccgccttgcagtttgatctcagactgccgtgctagcaatcagtgagactccgtgggcgtaggaccctccaagccatgtgcgggatataatctcctggtgcgctgtttcctaagcctgtcagaaaagcacagtattcgggtgggattgacccgattttccaggtgctatctgtcacccctttccttgaccaggaaaggaaactccctgaccccttgtgcttcccgagtgaggcaatgcctccccttgcttcggctcgcgcatgatgtgctgcaccctctgtcctgtgcccactgtttggcactgcctagtgagatgaacctggtacctcagatggaaatgcagaaatcacccgtcttctgcatcgctcacgctgggagctgtagactagcgctgttcctattcggccatctgggctcctccccactttttttcttttttttttttgagacagagtctcgttcagtcacccagactggagtgtagtggcatgatcttggctcactgcaacctccacctccccggttcaagtgattctcctacttcagcctccagaatagctgatactacaggttcctgccaccacccccagctaatttttgtagttttagtagagacagggtttcaccatgttggccaggctggtctcgaactcctgacctcaagtgacccacctgcctcagctgcccaaagtgctaagattacaggcatgagccaccgtgctaggtcaatatttacaatctttatgtcaggtaatcgaggccttagcattttaagaccagttatatgcagttagctacctcttttctctacttttccaataatcacaatcccttaaaaatattaatatcagggatcttttgaaatcagtttcaaaaggtattaaaagcagtgagaattttgtttcaagctcactgagttgtttctaggattaaaaaacatataaagtatttagcatattgtgtagaatgtaatcagagctcaatgcaagtcagtttatattattttcattgtgaaagctagacttatttgaaatggttccaaaaataaatcctacaagaaacatcctcgaaagtgactatttattatattatacataaaagtaccccaaatagtgtacattacctccagcttatgttaaattctgtctttgtcaataataacctctaatttaattgaagttaatcatatctcttaattagctattcccattattataataaagagcagttaccaggaaaatctagccatagtaacccacatataaatgaatgctttcagtaagcaaataaaataatttcaacaagtttccaggccatttaactaagtactgctctacttagatcactggaataagatcagaatatctagatttctaattgaggtggctctaaaacatcccattgaaaacagagccgtatatgtcccttaaccaaacaagcaaggagaactcaagaatttcaagtaaaaacatgacagacttctataggaatgaaccttaattgagttggcaggttaaattgttggcactgatacagtgaaagaagatgaagcccaagggagggacatttcacaatcaaatcggaaatggtacatccttctcctacacacaaatccataattgaaaaaaaagactgaaaacctttcctcccaccattgaccttctgagtaggtgtggtaggacaaatttcatcctcaatattcacaacaagatcttgatctttttagcacctggtcaagtttgcaaagtcactaaataaaacctaatccaattagtttctccccagtcaacttacttttcacttccatgaaatgtgctctttccacacaatagatgaaatagcacccactacatcatcctggttacaatcctcatgagatgacagatccttgcttgttgaggacacattcacagaaagaacagttaagcgagaggaaactcagaggccaggaatagaggttacctacaaagtctacaagtcgtatcaactactgtggtgaaaaaagagtgaacctctgcaattagaccattttttatgactaactttagattaaacacagcgtgactatgcttaccatcaagtggaatatttcagtctcccacacacagtttctgttctattcaatcactacaccttgtataacagctttatacagaaataatcataaccaacaaaaaaagaacaatcttcatttttgacagtgttaaaaatgcttaaaacatttttcaaaggttataaccttataaaagttaatgcattaacttcagacagtgtttgaaaaaaggaaagaaatatctaagactgagccagtaccaaagtgagctagtttcttaacacgagcaagtgtttaacagtattgttttcagtcataaaaacataaaacatgaatcttaatcccacaagaaagaaaataatagacttatttttagactagtctcttctatcaaaataaatggaagaaataatgtctgaaattaataacctaaattttaactttataagagtcttagatattacccaataatttctcatatcaccaagttaataaattactattccaaaggtaaatataaaaaaaagaaaaagtaagaaaagcacagtgtacaatctacatttgacatgtgcattaaaacaaaaactttcaatgtccagtaaatttcgaaccaataatttccttaaacttttacaatttttacaattacatacccagagtaatatctctttgtttatttctgaaaagcataatttctaaagttccttcctgttaacacaattaacatcaaaagaacaaaatcaaaactctgaggatactgctatcctatatatttgatgggcattctattttccagtgttatgaaaacaacttaaaccaaacagtataactgtatgcaaatgtcactcaaattaaaatgaaatataaagaaatacacagaaaacttattgtctgcccagcataacatgtgaaacaatactatacattacattacattacattttaattaagattaaaaacaaagatctatatttaaaacttttccatagttttttaaataattgtatgactcatctctattgcctctgttaattcaaaaaattagtgaacttaccaatatgcaacccactcaaaatgactcattttgacatttaattatttccatgcatgaggtgaacaatatctttaacatatgacctgattataattagatcatacgaaaagatgaaaataacatgaaaatgtgacttataaatgcaagattatatgtctatttatcaaatacaatttattggtcaatgttcaatgtatgtaaattgatctacaattgttgtaacttgaatttgaccctattggggaaaaaataactaatttgcctctaaagatctaatttttattcttttctattgttaggaaactaaaactatgtaacctaatgtatttcccttttaggttttaactgccaaaaactttagagcaatccttatttcccaagtgtttaattttgtttagctcatatacttgaaaagattacttttagcttcctttgttctgatccctccttaaattacttagctggcattgtgctgacatgtggtctcctgaagtcctttcaggaataactaaaaaggagagccttcaacaaaaagacaaagagaagaattatgggaagggaggaagacaggtaggagaaaggtaggaaggtatgcaagtacctgtacacacttgatactcggaattgtcatacattgctgtttctttctgcaaacaacactagatattttctaaatacacacatgttgggaatggtctataattttcaaagttgaggcaataacagtgctatataagtatatataacaaactgagtacagctaaaaataataataatatcattgaatctttttaatgtcctaggcactatactaagtgtttaatcacttattgctcacagtaacccatgaatcatgctttattattattattaattattattaagttactattattatcaccattttactaatgaggaaacagagacttagaatgattttatagccggtatgtggtaaagctgagattcagactaactccggagtctgttcccttaaccagtagcctctcttcactgatattaaataaaatcttcattgttagtttagtatgtattttctaaagtatataactggcatacgcttcatgaggtatatggcagccagctcaaataaaatactgaaatggataataattttatattgccaaaccaaatatttgagtcaactgaagggaagaagaaatagaactggacagaataggaagcgtccctaagacctctttgaagtactctggattcataatcaggtgctacgtaggaaaaacactagagacagcagttgtgatacctgggatccagttctttctctactgctaattagaaatgtgtgacactgattccatgattcaacttctctgggaaccagtttcttcatctataaagctataagtatgattctataacagccaaggatgctgtagttctgcaactgcaacccagatctctccattcacctgttaggtgcactcacagctccagaatggtccaagtatcacactgggaagagaaactgctccaaattattaagggtcaaaacaggtagagcctaaagaccccacttctatttagtcaggacagagaaatccttcttctatgagaaagtgctccaccacactgatataacttagaaaaaatccttgtcctcagacttttccctgaaactccaccaattattagagggacatttgaagctaaaaaataagataaaataaaatcaccactgacacaattaggacaactcagaaaacaagctagtatatagcattagacatgtaagtcatgctgtagcatggaatagtttaatcatattgatagaactgacacttaaaataaacttttaggaatacatgtgctcaccttcttttcgcctcaccctccaaagaaaaaaaatgagcaaaggcaagatgaaacgtaagtaaaactgtaaagaacacaaaatgtatggtctttgtcttttgtttctctcctcctaatgatctgttttcctaggctttgctcaaagcctttcacacccttcctgagctatgcttcttgttcacagtctccctcacctgtcctttctcccatccactcagtagccctcagaagcaagtgtattgaattacttaagtgatttgatctaagctagactcttataactaaagagtgtgatatttgcattttctagcagtggaaattccaggcaaaaattactctgaactggcgggggagagagggttatgatcctcttaaatcatccccatgtacctgtgaatagcacaaatcaaattcccccttaagaaaaacaagggggtagagaggggccaatgaggtatcacaaaagaatttaaaagtctgggattagccagcactagcccttcaagggctttacccaaagcaggaaattgctgtgctgctccatggcttccctacaccggtgcccaggcagctggccaattcactaaccccttccctggcctcttccctggccttgcacagacagcatagtcagtactaccctggccccaccgtaaccctggctggcttgagaaaagttggcagagagagtccagggttgtgctatttaaagctataagcagctactgtggatggagatgagctgctttagcagcagaggataaggccagctgtgtaagattttcactagccctaatgaaattcactcacctgctaaagttagggtacccaaatttgatagaaaacagctcagttccacttattaattactaattatcatctagctatcccatctggcaatttttttcattgttaaattgcctgattgcaaatccttaaattttcctcaaaatatactaataaatatatagaatataaatatacatataaaacagtctactaattagtaattaataaaatatactaatgaaatttatgtgtgtgtgtgtgtgtgtgtgtgtgtgtgtgtgtagagtccatgtaggtttttgctgtgtacacatcaaaatacccagaaggacttttatataaccatatacacatgcatatctttgtatacactacacacatatatagagacagaaaaaatatatacatacatatatatatatatatatatatatatatatatatatatatatatagacagagagagagagagagagagaggaatccatacatgtatctatgtttcaatccaagctgcccacactatctcaaatattaggtgaacaaggataaaataatggtcaaaagcacaggttgtgaatgcaggtatctgtgtcttcagtgaaacacaggataagataattctctggatttctaatctgtaagtggcaattgttgacaaggttaagatgattcctataaaggacagacctttgcttggaacacaatagttagtattcatcaattttaactagtgttagcattatgataaaacatccatggtaactcaaaacaacaactgtagcagtatggttttcttctaaaaatcaaacattatctcagacagccctgacaatctgaccctgtcgtctccttgtgctcttacttctcaaaatgggcttgacaggtactttatcaagggaactcctcttcatccttaaaagctcagctcaactagcatttccttacagaaaccttccttgacccttagcctaggtcagataacactgttacttatttcaaaaagcagcataccttttctttatagcatttatgccagcttattatttacttagttcagtgacttttaaaaaagtaacacctgtatttcccactctaacctcatggggcaaatactatgcctgcttttgctcattgttgcatccacagcaatgaaagtatcaggtacacagtaagtgatcaaaaatacttattgaatgaatcaatgactcagccaagttctatctagatgtccatctatttatatactcccaagaagcagcgagagtaagaatttggtcacagaaaaataaaagaatcctggaagtttcccagaggaataaaagttagaaaaaacaatacttgtcgaaaagaagtccaacaatccagaaaccaaagagacatggctttctgtacttggcttgagaaccctcctgacattccattacgaagaaactttaaaagaagcacagggttacaaggccgagctctgggtaccaagaggaaggaaggacagggattctacccagaggaagaattcatccaactaagaatcctgaaacctagagggggatagggagcagagtgtagtgtcatcaaatttatgttctgtgtcttcattcagtcagtaactcatcagagcacctaccacatgagatgtagtgcctggacttgtggatacagaagtaagcatgacagacacagtcaccactctcatggaatttccactttatttcagaggagaaacaggacattaaacaagtaatgtacatgtggccagtgctcacagaactacaagttgctgtagtaataacactgactgaaaagtcagtacatacacatattttgtatttgtccaaggaaataattccaagaatatttttatgatctctctttttttaattctctctttaaaaaaaaaaagtttccatgctaatttgtattggtttctgttgcttagcaggagtaaactaatttaagagacacactatatatctactattaggttgaactcaagtgaggatttggtcaagatgatttcaaagtagttaaaagagagtattttaaatgttctgaccacaaaggaatgataaatattggaagcaatcaatatgttgattactctgattttatcattctatggtgtatacacataagaaaatatcacttttaccccataaatatatgcaattgttgtttgtcaattaaaagtgaaaactaaaaaaaaaaaaaaaaaacagatgctgcttctccttcactagcttgtacgtgaaagtagatgagatggaaaatgagaggaaaaaagaacttatgcaaacaaaagcataaaaacactactcaggaggatggaatttatttatataaaatcttaggtacctcaaaaactttcaagttcgtaacactctctttattttatgaaagttacacaaaagggaaaactgaaaacatcaaagaaaagccctcaattcacctctcaagagtggtatttaattctccattccaaaatccataccaatcagtctgtcaatattaatttgttgagtacacactctacgccaagaattgttaaaaacccaaggaaagagttctcctcagtagacccatgccctccccaacaataaatgtacataaaaaatttaagataaacttgagatgccaataatggctaaagagaatatcaaaagcaccaatatacggtagagtaatcagggtttctgctttagctagaatggtcaggaaaatcctttctgaggaaatataatttaaattaacactcaaatgatgaatatgaacccctatttattataaaagtccagaaaagaatattcttacagaagaaaagctgatccaaaaggccagaggcaggaaaattttaaattgtttgaaagacaaaaaggccagaatggccgaatacagtaaacgaagtaaggagttgaggggaaatgacatcagggaagtatactgaaaccagttcttgtaggacagtggctctcaaaatgtagcatcatatgggaactgttagaaatgcaaactttcaggcccctctacagacttactgagtcagaaagtctgtggtggtgcccagaaatctgttttagcaaggcttccaggggattctgatgcctactaagatcagtggcctcttgaagagaacagtaattctcaacctagttatatattagaatcatttgtagaggcattcaatctacttatactgagccttacccaagaccaaatgaatctctgtatctggagatgggatctcgatatatacacatatatcaagatgctgtacaggtttgcagcctggcagcaataatatatataatattatatataatacattataatatatatataaaatattaaatattatttatatattaaataatatatattaatattaaatataatatatattaattaatatatatttatttaatatattgtatataatattaatatatgttaattaatatatgatataatttaatataatatatattatatataataatacataatatataacatataatatattatattaatatataatatataatataaattatatataatatattatatattatatataaataatatatattataaatattatataatatattatatttatatataatatataatatattatatttatatataaatataatatattatatttatatataatatataatatattatatttatatataaatataatatattatatttatatataatatgttatatataacatattatatttatatataatatgttatatataacatattatatattatgtattataatataatatatattatatattaaattatattatatattaaactaatatatatttatattatatattaaattaacatatgttattttaatatatatatattatatatattaaatatatataatatatttatattatatataatatataatatataataacatataatatataatataattatatattaaattcatatatgttaatataatatataatatatattaaattaatatataaatataatatataatatatattaaattaacatatatgaatttaatatataatatatattaaattaatatatgttaatttaatatatattatatattaaatatattaatttaatatataaatatatatttatatacaaatatatatttatatataaatatattaatttaatatatattaatttaaaatatattgatttaaatattaatttaatatatattaaatatatattaatattaaaatatatattatataatatatattattatataatatattatatataatattatatatattatataatatataatatgtataatatatattgtatcatatattatatattatatataatattatacattatatattatatatattatatattatatattatatagattatatatattatattatacattatatattatatatattatatattatatattatatagattatatataatatataatatataatattttatatgatatatattatatatgctctttagatatacatatatgctttttaggtaattatgatacacaatgtttattgcaaacactgaaatggagtcttaaaagtcatagtaaaatgtttggaatttaatgggaagccactgaaatcttgtaaacagaacattttatcaaacttagaaatgccaatgcagcttctatgtgaagaagggggcaataattggccgaaaacaccagtcaggaggtcattgtcatatccagggaaaagatgacagtggttttgtccaaagctgtaacattggagatataataagtagattcaaacatatttcatagaaaaacctaaaaatgtattatggatttgataggagatatttgagggaaaaataagaagagtctaggataataagaatctaggtttttggcctgagaaatggtgcccaacttttctttttggaggaaagcattcaggtgtgtctatcaagggttgatctttggccaggttaaatttagacagccaagtggagatgctgaattggccgcagaatatacatatgattctggagctcagaagagaagtcagagccaaacccagacacatacaaatcatcactgggtatttgaagccacagaatcagatgaggtctctaggttgagagtagacatgcaggagagggttgggtaaagcacagagctggtgtaggaacagggtacgtggctggctcatgggagcccaagaagagtgatggtcctcaggctgttgaagcgcaggacaactgaagatcttaggctttctctgttgccttgtggcacagttctacccagttcatggaggcaaaatggctttagaaactcacaagcatttcttaatgactactggccaccaaataacagcaccaatatccacttcaaaggtccgcattataccaggcaatctttccctgaaccaaatgaggaaaccaaggatcagacacattaggtggcttgtctaagttcacacagtttctgtatgctgccagaacatagcctggggagatggcactcatgtgtgcctacaaagaacacatagcttccaagaaaggggactaaaagagggagttaaagttgtgcaaagttaatccaatctgggactgacaggtactgagtcaaactggcagggattatgactgagcattgggaaagggccagacagtattacagacaaaaaaaaaaaaaagttgaaatttcctaccagaaaaaggaagtcagctagaaaaaaccagtatccagtaccattgcacacatacaagaaacagacagtagagttttagggtctgtcagtaactgagagcatgacagaaatgcaaactttcagtcccatctgcagacctactaaatcagaaactctgaggtggaacccagaagtctgttttaataaaccctccaggagatcctgatgcccactaaggtcagaagccccttagggaaaacaatgattttcagccctattgcatattcctcaaatgcaacacaggaggactttccagggaaatggaaatcatcaatagagctggcacaacactcctatcttgaagaaacttggtgcttccctaacagtccatctaagggacagttccttctgctcttaataatttaatatgcacacacacacacacacacacacacacacgtataactttatatatatctatctttacactagttaattataatacagtcatgtgttgcttaatgactaggatatgttctgagaaatgcattaggtgatttcatcactacgtgaacatgatatggtatacttacacaaccgtacatagtgtatcctactacatacctactacatacctaggctgtatggcacaacatattgctcccaggctgcaaacctacacagcatgctactacactgaatattataggaaactgtcataacataggaagtatttgtgtatctaaacatatgtgaacatagaaaagaaatggtaaaaatacggtataaaagatttaaaatggtacacatatatagggcactatatggagcttgcaggactggaagttgttctgggcaagtcagtgagtggtaagtaaaagtaaaggtctaagacattattgtaggctcctgtgtaagcaccacacttaggctacactaaatttattttaaaaatatttttctttctccaataataaattaaccttagctgactgtaacttgttactttataaacttataattttaaaaaatgattattttataattatacttagcttaaaacacaaacacattgtacatctgtataaaaatatattttctttatatacctattctataaggcttgtctaattttaaattaaaaaaattgtttttggtttttaaacttttttgttaaaaatgaagacacgaacatacacattaccttaggcctacacagagtcagattcatcaataaaactgtcttccaatttcacatcttatcccactggaaggtcttcagaggcaataacatgcacggagctgtcatctcctgttataacaatgccttcttctggaacacctcctgaaggaactgcctgaggctgttttacagcagctttttttttctaataacagaagtacactctaaagtaatgattaaaaagtgtagaacagtaaataaactagtaacaaagtcatttattatcatcaagtacataattgcaggtgctatacttttgatgtgactggcagcgcagtacatttatatgtatacacatatgcacatatgtatatatacatatatatgtatatgcacatatgtatatatacatatatatgtatatgcacatatatgcacacatgtatatatacttttttctttacactggttatttccacatctcattaggagacaagctgaaacatcttccaaagctgtaatagcagttaggtcctctgaagccttcaagtacacagagcttattcagaattagaggattaaaaaatacattttaaaaagtagaaaaagtgctattataaagtaactatatctcagcatttgaaatagtaaacatttatacatgcaatttcttttgcaggccataattaatgagtaatagttaatttggtgctttgatctcttcctcggccagaaggacactgtccataaaaacaaattagaagacaaatttagatattgtcatagaacatcacagtccccggctgggtgcaggggctcacgcctgtaatcccagcagtttgggaggccaaggtgggtggatcgcgaggtcgagagatcgagaccatcctggctaacacggtgaaaacccgtctctactaaaaatacaaaaaattagccgggcgtggtggcgggtgcctgcagtccaagctactcaggaggctgaggcaggagaatggcgtgaacccgggtggcggagtttgcagtgagctgagattgcgccactgcactccagcatgggcgacagagcgagactccgtctcaaaaaaaaaaaagaaaaaaggaacatcacagtcccagaaggaacctcaaaaacttaatagttaatgatttcctaattctagctccctagatcttaagggaccagtggaagcaataatgaagatctgagaatgaatgtcattgtttcataagactggacaaaatggtacaggtctatgaataagttgttttattggaaaagggaatcaaccagtgtagaggaagagtaatttgtactcatagtgaactttgaccagaaattttgtatgtttttattttattaaaaagtagaaaaagtgatcactatacagtttggtttacaaaccattttaaataacgttccacaaatggaacaaaaagaatcactgacctaattcaaactcctggtttttaagtatggaaaaaagtagcaacatagtgccatgaatacagcccatatttcaaacattctcatagatgaacatgttcctaattttttttccaagcataacatataaaaagagatccctttctgaaaattttagatcaatggttagggtctaggaccaaaatggctcaaagagtctagaaaaatatggctcacagtgaaccaatatggctcaatattagtgtctagaaccaatatgccacaaagtcttctctcatttttatatgctaagtctaggtgtgacaccacaattgaagccaaggctggaagtgaggtgcagctgaccaaatagagatctcatggtgacttattttatctggacccacatcactatgcttggtctgctttcttgtccaggcagccagttaataccattctcagagccaggtatgcaaaataaaggactgtaagaagccaggaagtaaagtgtaaaatattggtacaccctaagcaaagtcaaatatcctgcaagcccaaaggaagtattaccccaagagtccaatcactatgttaaaggcatcctgtttcactgataatgctaaatgaaatgtttcccattgtgtttgggttgctaacatttgtaaattctctcattaactactgttcttcattttctctcaggcttcgtacgatcagctcagaagttgactttaagactggatcccattaggttaatgagacaccccagcatctaacagtacagtcctctcaatctataaatatcttctacttttagagacatcaccagacagaagtagaccttccagaagtctcctacattttaaattgaggttggaaagttttatcagctagtcagaaccccaaagacctactttgataatgctattcaagtctaaaaactacattttctggtaattggagctagacacccctatgccacttctttcttcattcctttcaattgcctccacagaggggcagaaaacacccactccttgctggatgcttgtttttatcaaagactctagaccagaaaccacaaaaaaagatataaggtagcatattaaacaccatcacttaaaaaaaaagacagcaaaagaatgaggttgggaagattctgaacaacagtataaactatctgatgccataaaaccctttaccttctatcccaaatacatctcatcctgagattcctaacttaaaatatttgaccaaaacaaaaagcctgagacaaatgttaaaattgtgacttacgccaggttaattctattccagctagggtttgaactacatcacaccactgaaggaactgtttcctacagcagaggtcattttctatatggttatttgtgacatagtgcactacatggtggtcaattgtgtaaaacctcattatcgtaatgacaacagcaataagaagtctatcatggttattatatttttgtctcaactccgaagattcaaataagtggaacaataactttctatatggtagagttatatataaataagatggaaagtaatgggttttttatctttagaactcttcaggagagcagagattagagtaaccctcagggaagatgatgttaaaggagccatacatgacgtagaaaaggttatcttaaaattacaaggattttcaccaaggttctaattttgtggaagactatattttccacaaactggctcacaggccgaattgggttactgcagcgtattttattttgcaaacttaaccatcattattattaatcacaaaatgctaaaacaaatcattgtaaatggaaaaagaagaggatttcagtaacattgatttcctaagggccaggctgtgtggaagatgcattaatgctcttggtaatgccctaatctgataagcattacttccccattttactgaaggaaagagaccttagcaaggttaaataacttgctcaaggtcatgaggctggtaagtgatagaactggaactagagtccaagtttgtctaattctaaaacaacactgtgatcaatcccaacatgagtcctttcctttgaccattttacaaaaggcttgacttctgtcatcaacggtacttacttttttaaaaaactgaactctcccaaagtatcataactcagaataatttggccactattcgttttcattcatgcttattgattattcccactaaaaaaacccaaatttaatatattccaaacattttataaaattaaaatgtaacaggtaatattgtaaaaaggtgatagaataggaagcaccaagaatttccccactaaggcaacaatcatactggcagaatctgtctgatgataggattttggaactctgtagtctactgaaggcttaccacttccaggggaagactcaaataataaattacagttaattttagtcaacttcagctcttagcacagtagcagttaccagtaccccaaccctcagccctgtggcaggcagctgtgcacatattcctagagcagcttgcataaaacctgcaggagcaaatgtgggcaaaaagggccttgttctccaaatatctgggatccatgccctgatcactgatgcttctgatcatggagatttagacaaagagtgatagccttttttgttactccctccattgttgcaaatccctcctcatctgactgaaatgatttttagggaatttatagagatagctttttttttcatttttctctttttctccttttgtgaaccagagattgaatactaggatagtcaaaagcaactacatatacaagaaaaatttgaaagtcattgtgcatgcccagggaaaggcacaggctcagaaaagacctgagaagaccttaagtttacagttcagcctaatcttcagaaaagaggcagcctacaacaactacaaacaaataaacaacaacaacaacaacaaagcaaacagcaagcactgaggaatgggaggaaatctgatttccagagatacaacactattaggttcagaagctcaatttaaaaccaaatatcacaaggagcacaaaggaacagaaaagtatggtccattcaaaggaaaagaaaaaaacaatagatacggttcctaaacaagacctagtggcagtattagcagatctaccagacaaatactttaaaacaagtgtcttaaagatgtttaaagaattaagacacacatggagaaagtcaagaaagagatataggtaaagaaatgaaaatatcaagaaagacataaattctaaaaagaaaccaaaaagaaagtctggagttgaaaaggaaactaactgtactggaaaattcactagaggaattcaaaggcagatttgagcaggcagaaaaattagtaaacttgaagggaggaccacggaaataccaagtctgagaaagaaaaaagattgaagaaaagtgaacagaggctaaaggacctgtggaacaccattaagcagaccaacatagatattgtgggagatccagaaacagcagagaaaaaggaagaagcagagaaaacatctaaagaaataatagatggaaaattgccaaatttgatgaaagacataagtataaacatctaagaagctcaataaacttcaagtagcatgaattcaaagagactcataccaaaatacattgtaattaaattgctgaaagacaaagacaaagagaatttttaaagaaggaagagagaagtgattcatcacattacaagggatcctcaagacaatcagcagatttctcatcagaaacttttagattccagaggcagtggactgatatattcagaataacaagagaaaaaaaaaaggtacaccaaggtatggcaaaaaatcccttcaaaattgagggagaagttaagacatttctagataaatacaggctgaaggagttcattaccactacaccttctgcaataaatgccaaagacttttttttggcagaagttgaaaaacccatcttaaattcatatggtatctcaagggaacccaaatcaccaaaacaaacctgagaaaaaaagaagcataaagctggaggactcacacttcctgataacaaaacttactacaaagctacagtaatcaaaataaagttatattagcctaaagataaacatatgcagcagtggaatagaatagaaagtccagaaataaattgttgcatatatggtcaaatgatttcagaaaggggtgccaagaccattcaattgagaaaagacagtcttttcaacaaatggagcttggaaaacttgatatccacatgcccaaagcataaagctggatccttacctaacaccatatacaaaaattaatacaaaatggatcaaagacctaaatataagacataaaactaaaaactcttgttaaaaaatatatatatagggcaaaagcttcacaacattgaattttgcaatagatttcacatcaaaggcacaggaaacaaaagaaaaaataaattggacttcatgaaaataaaaagatttttgtgtatcaaaagacgctattaacagagtaaaaaggcaacacacagaatggaagagaacacttgcaaaccatatatctgataagagattaatatccagaatatataaactcctaaaactcaacaaaaaacaaccaccagattcaaaaatgagcaaatgacttcagtagacatttctccaaagaaaatatacaagtggccaacaggcacacgaagagatgttcaacttcactaaccattagggaaatgcatctcaaaactataataaaacaccacccacctcccaacctttaggatggctactatcagaaaaaaaaaaaaaaaaaaaaaacagaaaataacaagtgttcacaagaatgtggaaaaaaatcaaactctgtgcactgttgatgggaatgtaaaatggtatagctacttatatggtctggctgtgtccccaccaaaatctcatcttgaactgtaattcctacaattcccatatgtcatgggaggaacctggtgggaggtgactgaattatgggggtgggtctttcctgtgctgttctcctgatagtgaattagtctcacaagatctgatggttttaaacaatgggagtttgcctgcataagctctctctttgctgccatccacttaagatgtgacttgctcctccttgccttccgccatgattgtgaggcttccccagccacatggaactgtgagtccaattaaacctctttcttttgtaaattacccagtctcagatacatctgtatcagcagcgtgaaaatggactaacacagtaaattggtaccagtagaatgaggtgctgctgaaaagatacccaaaaatgtgaaagcaactttggaactgggtagcaggcagagggtgggacagtttgaagggctcagaagacaacaggaaaatgtgagaatgtttgcaacttcctagagacttgttgaatggttttgaccaaaatgctgataatgatatggacaatgaaatccaagctgaggtggtctcagatggagatgaggaacttgttgggaactggggcaaaggtgactcttgttatgtttcagcaaagagactggcagcattttgcccctgccttagagttttgtggaactttgaacttgagagagatgatttagggtatctgctagaagaaatttctaagcagcaaagcattcaagaggcgacttggatgttgttaatcgcattcagttttataaggtaagcagagcatagaagtttggaaaatttgcagcctgacaatgcaataggaaagaaaatgtcattttctgagaagaaattcaagctcgctgcagaaatttgcataaataacaaggagccaaatgttaatccccaagactatggggaaaatgtctccagggcatctcagaggtcttcacagcagcccctaccatcacacacccggaggtctaggaggaaaacatgatttcatgggccaggcccagcgttgtcatgctgtgtgcagtctagagactcatgccctgcatcccagctgctccagccatgactaaaaggggccaagcatggcccatgacttcagagggtgcaagtcccaagccttggcagattccacttggtgttgagactgcaggtgcacagaagtcaagtactgacgtttgagaacctccaaatagatttcagaggatgtatggaaatgcctggatgtccaggcagaagtttgctgcaggagcagcactctcatggagaatctctgctagggcagtgcagaagggaaatgtcaggtgggagcccccacacagagtccctactggagtaccacctagtggagctgtgagaagagggccaccatcctccagaccccagaatgatatatccaccaacagcttgcaccacatgcctggaaaagctgcagacactcaacatcagcccatgatagcagctaggaggaaggctgtaccctgcagagccacaggggatggagctgcccaagaccatgggaacccacctcttacatcagcatgacccagatgtgagacctggagtcaaaggagatcattttggagctttaaaatttgactgccctgctggatttcgaacttgcatgggccctgtagcccctttgttttggccagtttctcccacttggaatgggtgtatttacccaatgcctgtacccacattgtatgtaggaagtaactaacttgctttgattttacaggctcataggtggaagggacttgccctgtctcagatgagactttggactgcggacttttgagcccatgctgaaataagttaagactttggggaactgttgggaaggcatgattggttttgaaatgtgaggacatgagatttggcggaggccagggtggaatgatatggtttggctgtgtccccacccaaatctcattttgatttgtagctcccctaatcctcacatgtcatgggaggtactcagtgagaggtaattgaatcatgggggtgcgtttttcccatgctgtttttgtgatagtgaatatgtctcatgagatctgatggttttacaaagggcagttcccctgcacatgctctcttgcctgccactatgtaagatgtgcctttgttcctcctttgccttccaccacgattgtgaggcctccctagccatgtggaactgtgagtccattagttttctttttctttataaattaacccagttttagttatttcttcatagcagcattaaaatggactaatatacaccctaaatgttatttactctgtgtatgtattcatatttagaataatgactcaaatttaatcatagttaaaatgattaacttttaattagaaagtattctagtaaaataggtaaattttatggttaaactttccttaaacatggataattattgcacctaatttactaggttgttgtggaaatgaacaaactaatacatgtaaaatacatgtctcatcctaagaagtactaaacaaatgttaactattgttatcattatttgttttgttttctttgttttgagacggagtcttgctctgtcgcctaggctggagagcagtggtgcaatctcagctcactgcaagctccatctcccaggtttatgccattctcctatctcagcctcccgagtcgctgggactacaggcgcccaccaccacgcccggctaattttttgtatttatagtagagatagggtttcaccacgttagccaggatggtctcgatctcctgaccttgtgatccgcccgcctcagcctcccaaagtgctgggattacaggcatgagccactgcgcccggcccctgttatcattattttattgttatcgttgtcaatccattattaacagaaacccatagtttaacaataaattgtgttctgttctacctgtataccattctggaccagaatttgagatattaggaacttctttttatagtttttctgattttcctaatgactgtgactacatgtataaataaatgaggaaagagacacttgggaggcaaactccaaagtatgacccatgacttccttttctcatttctgttctacataataaagttctgattgggatagacaaaaagtgcttcagacactccaaaatatcagctggagctgaagagaccagaattagaaacacaacatccagtagaaccaaggtctcaacagccttatttctagttttttaattcacttaaaaactttacttgtttggaaacatacagattttgttgttctttcttttcttcttctgctgctgctggtaatgatacacacatttgctttttatggtgtctttttctctcggaaagatatatgtgtgagaaagcatatcatcattaaaatactttctcaatttcaaaataggatttgcagtataaataagcaagtattaagaggaaacttcaaaatgttcatggaatatgtgtattatgaaaaaatatggataaatttctaaattattttgcatcaaaataaacttgtactaacttatcacatgtctgaacaggttctagtttaaggcactaagaggaataagacataaacctctctcttttgtacattacccagtctcaggtatatctttatcagcagtgtaaagatgaactaatacagctaccatggggaacagtatggcaatttttttccaaaaattaaaaatagaatgaccatatgatccagcagtgtcacttcaggggataaattcaagtgaactgaacacacagtcttgaaaagatatgtgtacactcatgttaatggcagcattattcacagtatctaaaatgtggaagcaatccaagtgtctaacaacagataaatgaataaataaaatgtgacacacacatacaatgggatattatacagccttacaaagtaaggaagttctgacatatgcttcaaaatggatgaaatttaaggacgttatactaaatgcaataaactagtcccaaaaatgaaaaatactatatgattccacttatatgaagcatttagagaagtcaaaattgtagagacagtagaattgtgattgtcagaggctatagggcggtagaaatgggaagtaattttttaataggtatagcatttcagttttgcaaaatgaaaagaattctggagatggatggtagtgatggttgcacaaccatatgaatgtacttaacaccactgaactgtatacttaaaacatgcttaagacggtacattttatgttatgtgtattttatcacaaaaaaatattggaagaaaaagtaggctattacaatctagatagtgcatctcaaaactcgtcaggctaatatatatatatgtcttatttttcagtattactaaatctggagttagatctcagttcaattatatattactgtttcttcaatcaatacatgagaattttcagaaattatggaagatctgaatctgtttactgacacctatttaggatgacaaagcaccataaaactaataataatctcttgatacatttagtagtagtctagtattgctcaaaaattaatcaactgttttgaaaacaaagtgtttaaaatgtcttgttttagaggcagagaattcagcctaccttaataaaaagccaaattgatttttcaacccctttttttctttgcaattttattgttatagagtgacaacagtaaagtctcccttttaaattgtatttatgaccaatctctctatatttctaatagtgttaaatcatacaacttaatttatttccagtactctttgaagacaagagttacacttgaccaatctcagtacttaccacagcaatcagtgcaacaacttaatactagtgcttcaaaatgctttaacttggatcaggattcctagaattgaagattattaagtcaaaccttgaggctgagtttagttttcaaggaggctgtgacctcagggcatgattactacaaaggcatcatatcaattctgtgctgtgcttttgttcttgttttaattataatttaaccagaagaaaatatttcagatgtgctcaagcaatattttcacagttcttaaagcatttctttattatcttcaaaaacttacactagttataatgacatcatggttttcatggcattaaaaagaatagaaagcattacttttcaggccaacaatagaaagaaaaagtacttcccatgcctctattattttctgtttgtccaggtctatccaaaaagaaatgtgcaattttccctaatttttaaccatctttaaatttaatttttaaaaattattatatcaaagaagagatacttgggaaaaactataatcaaattgatgtatataaaaagcaaactgtgaccaggtggtacttataataataaataaacatgaatggtttaatttaactacaaataactattattaaaaatattatttaaatttgaaaactcttttttttgtttgtttgtttgttttctactttattccaagatcacatccttggatattctttgtataaaataattagtcacaaaagagaaatacagatttttaaaaaatgaaaaaggcttgacatatgtatgattctagccatatgaaaattagacatgagatgtgaaaatgatcaaggactatgccaaatcttccctcttcatcctaaataagcacaaactgcctgcctatttgaagaaggaggaaaggtggatgatgtatccaatagctcagacctggcataggcaagcatacaacactaggtacattctgtcagctctcaaggggccactgcttgaccaaacctcaggaagggagcaatgaagtcaacagtagttcttccagactaattaaactggaggactctcatcattcttcattctgaaaggggccaatgtctgttgctttgttcctactccctggaaattaaaggatataagagttttaagcgtcttccagtcctggtgtagcctggtgtaggtacctggaggtgaaacattgcttcggtcctttattcttcagaccttctaaagtctcaaatcagcatgtaatccatgaaggcacagatatctcttctgtctcatcaataacacacacaacaccttctgtggacatcttccacaggaggaataggtgaaaggcaacaggtcttcagacatcgagttctctcattacagcagatatgcaaatgtcaacatgtcgaaatcagccctcaaaaactttcttttctaaatccactgttaatagctaaaaacttatgcctatttttagtatcaaacatttcatttaccagattaagctgtatcacagctcacaatcaccagtcaaatgttctcaatcataggcatattggctcatattttttaagtggactttttaaaaagtgcctctgcagctagacttactaaaataggcatggcaagaatatgtttttgaagggatcaaatcacagagcaaaagtcttaaggcaggtaactagggctgttttcattgtaactttgcagctgcccacaaagacttcatttagtcctgctcaaaatctaacaaaggtaaaatgtctctgatattaaccagatgtgactatcagatattttagaagagaggctctctttatggttcccaaattgttaacctcaagcttccaagaacccctaccctaccagtaaagatctctgttagatgcctcagggagctcaacagtggtatgaactgaggacaagtcaggagggagagtgttttgaccagacctttcctgagtttatccaatttacactctattttattagataacctctagtgatttcatctgaacgaagaattacaaatgttaaaaaaaaaaaagttgaaaacctctgtcctagataaacccccttgatcttaaaatcagcccacagggaaatcactgagctaggtaacccagtagagccattagctagtcagttcttccactcacaaccagttccctctgacgacagtccagaggaattagcaaggagatgctgttctagcaagttgaaaaaaatccaatttctttagattatgaaacacatcacataaagcctactaaccaaaaaaacctttattttggcaaattgtagaccacaaaatatgattgtgagctgccactactcacaggggagattttatggtattagagagtaaatgccaggactctgtgggagaaatctatttcatctgggattctcatccagaagtgtcttcccaagaagtgtgtaaaatgcctgccattgtcatgactcctgaccaccagactttcatttcaaaggtgtagaagtagggaggaaaagcacatcaacacccccttgccaaagaccaccagaagcacgtctttagttaacaagctgggtttgttacacgttgctgagatggagaacgtacagcagagggaaccatgagcatctcagtaagagactgttgaaaagaacctattattaacagcatttgggctttggctgggtaattttgagaaaagtctaaagaagtagagcatttttctagattggatgctatcagaaagtggggacgattctatgattgaatatctcaataattcttacctataattagggcagactagagcaaggataaagctgtaattggtaaaggattaacagtcactcatacatgataatattgactgagaacaggaaagggtcaatgctagacagaaaaagacattgttcttgattgttcacactgggtaggaatcattgtcaattcctttgtacaggaaaccctgttgatttcagaaactcactgagtaatatctatgtctagatcatattccaggccatagctacatacgtcactcaaggcattcttctgtcctctttgataaagcctatgttaaattgcctttcatgcgatcatctcatacagttacctggataggtaatatgatgatttcagtcacatttctgatgtccagaatgggcgaaatcagctaagtgtcactgcctgtttctcaaactatctatggtgaagagacagtttttctccccagtcagtaccagactagtattttagtacatataaaataaatacaatttgataaaataaaaactaattactagaataataaaatgaaaaaagacagaaaacaccaacacatttttaaaactgttattattagacccaacagacacattaactgtcaaaattgctataaaagttcctaaacacttagcctgactattggtatttgtcttgtcacaaacctgagtctacgtagcacacttaaccctcaaccacaaaactgaaaagcaacatatgggtattaaatttgaaaatgaagaattgaagccaccgcacagaaagtactgcatcttgcattcataaagtaatgttatttggacaaattctgacagagaatctgctcatttcccacattagaattctgtgaggaagctaaagaacactttcaaaatactttctttacgaggatatccaaagtttccacataaggagtaaaatacggtcattttgaaggaatctatgcttctttggaaagttttcagaatactttgaacaaaataaggaaataaaatcttccaatgtaatacaaggaaaaacattaacaaaaaaaaatgctaaaatatttgacttttgtttcttggaataatgtcgtcttcgcattattccaagaaacaaaattgtcacaaattaagccaaaatgcatatctttgacagcaaaatgctttctagtgtctttttctgaacttaaaatgtaacataacaatgaagcctcctttccacctccaccttccaaactatgcagaagccatggctgcactcccagcacctgcaaacatacgcacaaaacagaaggagtcttaccagaccatcacagttgctgatggcaacagaggttcctggaatgtccacgatgtcaccaacataagcacagttagtctgcaaaggctctgttctccggattctatacgtagcacttcctggttgatggttgttaatgggatcggttatattcccaggcaccagagatgtctcatgccactccacaacagccccaggagctactagttgagtgttgggctttagtcgcagatgaaaatcttttccaaatgccgtgatgttaaagaacaactgctcagggttggaagacacgtccctcgctgacctctttttgtgactcgcagaaagagtatgggagagatagcgtccttctagatttgtgctgactggagtcaccagctcatactctctatatctctttattggtaaatctgtggggtgaaaaacagaactgtcaaaccctgtacaataagagaacacaggagaacataacacagacaaaagctgcccacctcacaagaccatacttcaatgtgcataatatagacattcctgaatcagctcataaatattaaattttgagaacaaaaatcatttctcaaatgcatttaagtaaccctgtgttcaatgaatcattttttacttaaaatagtattaaaattacattgtaaatatttacatctcattaatacatttgcaaacacgaatataatgtgtccataaactataaatggcttgcttaaaatcaaggcatgcccttaattaatttattattggcataactgacatctgctaaaaacttttaacaaggttattatgtagaaaaaagaattctgattgttttcattttttccctgtagaaatcctggaatttagactaattacaataactatattacatgagtctgtaatgtatacactgtagcttacaatgctgtaatttatacacattttttccaccataacaaccctaacaaccatacttcacaggtgagaaaactgagattcaggggtaggaggtcctttgtccaaggtcaaacaactgcaaagcctgaatataaatccaagttgtactcctaagcccatacactcattctatcctaccatgctttcctccataaacctccatttttagaaaattagaagaatgggtaaagaagacataataatctttaaatcaaatatgcaggtactggttagtcaagagggaacagcattctcattttgcaccttattccttaagtgggacagatatctattagaatatgaaagagtatttgggacccaccttacaatatgggcagacacttacatgttaaactgaatttcacaattagcacttaaacccctggcttagccaaatataagtattttgtctatcaaaatgcaaacacccttgggaaatagaacactttaaaggaactattataagaatgattttaagaccacaggacaatggatactagagaaggaaacaagcagcagggcaacaagggtaaaaaaaaaaaaaagaagaagaagaagaagaagaagaagaagaggaagaggaagaagaagaagaagaagaagaagaagaagaagaagaagaagaggaagaggaagaggaagaggaagaggaagaggaagaggaagaagaagaagaagaagaagaagaagaagaagaaggcatagaaagggaaatctaaaaacatgaactaaaaagtttcccactttcacaattctagccttacgctaatcctatagtgtgttaaagtgccctaaaaaatggtatgattcacaaaactgctcacctatggagatcacgagttttgtcatccaataatgtatttagagcatgagatctgtaaatgaacctacgtcttatgctcataaagtatccttgtagaatcactattttcattattttcttgctttttaaaaacctcaggcaataagtgaaatgccagaagacaaataaaggcatttacttgtgcaacattttaattctttctgtgcatgtttgctgtaattatgcctcttaaaattaccaatgtatttaaatgaactatcccattttactaaatgaatacagcaagcaacacttgtaaatatttactaggcaaagaagcagtgaggactgtagtatgagtcaagtgaagcctgattccaaaactggacagacagtgcagtccctgctgaactagactaggcaccagtataaacacagacttggtcttccaagaaggttgtgaggaagatttggtcttcctccatggtgaatacttttataaactctggtttagagagaaaaacaaactcaaaatataagagaatgagcacaagtgtcacgggtgcagagtgacagaggggaaagtttccaaagtaaggagatgaatcaagcccttgtatgtgtactgacaaaacatagcccaaattaactacaaagtccttaaagacaaagaactccccattcaacttggtactcccaataccatcatacaagattttgtatgtgtcagggtgtcttgccagttgaatttgtttgatgcttattaagttagtaataccggtaaccagagaacactcgccttgtctaagctgctacacacactgacttacaagacacattacccaggcccatgagtgtctggctgtcccagtaatctcagttatagctttttctctaaccatcggctgaccatttcaagggaaagaggaagcagtgcttaatttcaatgtatggatttcccatctccactgaagggaattcacaaaaccaaagtctaaatcagtatattgtactgatgcatggattaagtgactagagaacaagaacatttagaaaaacgcagggagccttctccatacccaagaggatactcacagcctcatacgtacagtaagccatacatcctagatgtatgttccatttttatactgtcaggtattatgttctaaatttttattcaaaatatgaatggtatgtttctataaagctttattttctctaatgctaaataataaatcattcctaaaaagtatacataataaacatttcttaaatgtttgaatgagtcatttttctgttggcaattaaggtaatgaggaaaaagatacgattggcaaccctttggattaccatctcctggatggtagttaatggaactacccagtcacctgccatttattagcagaaaaagctccaagctctatgatttgtgtttgagaatatatcatctctaatactcacaacaatcacagtaggtaaatcctattacccctattctataaacgagaaagcagacctagaagacttgacacatataagcaaagagccaaaggaaaattcctgttctgatcattttgactctgaagaccatgctcctatgctctcgttcacttctgaatagatggagcatcttgctgtcaaagtctaatttaagatctgatttataaaagagaactaccacaagaattacaatgttctacctacctgcagccagtcaaccaatttttcctctagtgtagcatcagaaatttctgtaaaaggctcttacattctaggttttggaggaagaaactggaaggaggggcagaagctcaaagcaatcaaaagaattttaatctcagattacaatcacagaagtaaaaccaaattatatccaacgttaatttactgcattcataattttcacattttacaggcccaactactttcacaaagcaggaaagcctatggttattgaatgaactgcaaagtcagaaagcactaagttgagtccacttgtgatcttcagcaagttctttattttctcttaggctcagtttcctcaactgttaactggaggttagtaatagttacaacttcataggtttggtgagagttttacataaaatcatgtagaagattcaataaatatcagctattactaatttaagtgtaagttagccactcattaaaataatgttgtggttcaactttaaagttagaaactataaaactgttagctgaggtggctgaggggccacagtaataggtatgtgaaggcttttgtgggccgtaagttccacaggcacaatttcgaatgtgcttcttaactgttctccttgcttctgctcttccccttaatggattatcctcaaaatagagccagaataattaaagtgtcaaatcttatcactcttctcctcaaacccatcccactcaaagtaaaatggctcataaggtcccagggcttgaagctggggattctcacatctcaaagattttgtacttgctgattcctctgccaaaggatctttctctcagctgcctggctcactctctcaattgcttcagacttttgcttaaatgtgaccctctcagtgaagtctttcctgaccactagcaaccattttaccctctgtcccccttctgtgtcttacctttcgccataaatcctgtcaccatctgacatcctataaattttacttatgtgtttatttatatattcttatatctaccagcatatatacttcatgaaggcagaagattttatctgttctcttcacctcatttccccactgcctaaaaaagaacttgaagttactcaataaatatccatgaatgaagaaatgaagaaatgcgtgaatgaatgagagcagtttgagtcggaaggggtatgtgaaattagcatgcatcttcttttggctaaatagtcattttatcaccaagccattaatgacggcaaactgtacaagtcatctacctctaaagccagaattttgcttggaaagcttgtgtatatttctcacagttgctgctgccctacaaaccaaacatttcttagtatccaggtcttaccttttaagctaccaaaaacaagaaatggatctaatcattaaaacagacctcctgtaagacatacacagagccctgcattcttaagagcaggaagcaggaaattagcccccactctgccatctctttggatattcatagaattataactatacaggtcaaaaactaaaaagacccagaagttagggtccctaatccctgctctttcttacagttcagaaatctcaagtagatgggattattttttctcaagttagtggtagagagcctttaacctgctcctgctctctggaaggaaaggtttttctctgagcactccaggctgctctctatcccttcactcacccttccctggtggagaagagtgaattatgtggttgggaagtctgggaagcataagaaatttgcaaacctcagcacctcctcctcattctgcttcctggaaatgagtctgataaggggtacatgttctcttccactcagccaggggcagcgctgctctggattggggaggcctgacaggcacagggtggagtattagtagccagtgcacttgcctgtcaaagtggaagcctcattctccacttcagccttttctgtaaaagatattttctttttacctacatctttagtttttctatttctcaacttgttcagaagctaggcagtcaagaagggtattttttattcaggatctcctcagtaacttgaactacccccaagaaaaactgttgtcatatctccactggcagcctaattataatgtaaaaaaattttcttgtcagggaattctcttttatctaaattcctcattctagagtttaatgtaattccttcttcctccttgtactatgtgaaataaccacatttttgtatatatgtgcatgagtgtatttgtgatatgcatataaatttgtgcagacatatgcagttaatatgcacaacctacatcaaaagctttgaagaggcaatgttctttatttcaatatacttagaaattttttactttctatgttaatgtcaaccatgttagattttcctagtggtttccaaactttaatcattatgcctttacacatatctgtgttttagcatgataccctgcaaatagtaaaccctcaataaatataggttaaaagaaaatttcccttaaactataacctgaacggctctgttctctattgagaataacttgtcttactctctcttcatccttaatatatctaaaccaaactgaatgttcacctatttggcttgccctcctgacttcgctatttctgttcatgatgtgctgattctcccaaatcaggctagagagctattttatacatgtcttataactttcccccatatgacatcattcaagtcctactgctgtttctttagcaatttctctcaaactaaccccttttcttctaattgcttttaagatctcatcacctcacactgaaaagctgcaagtaccaagtccaaattccccacacagaatttctcactactaagtattatacaaattataccaaaatactgtctaaattgctgtcaggaaaattattttaaaggtccagattgaaaatacttaggttctaccacttactaccctagtgatttgggtcactacattagctcttatctgtaaattacgggtaatagtattgacttcataggcttgttgtaaaatttaaatgagctaatcaattcacagtgcttacaacactgtctggcacatagtaaatattcaataaatgctggcaattaatgtcactacattattccacctaactagcctcagtagctcaccatcactttaggataaaagatatagattcacaaaatctgtatctttttcacgtcagacctaaaatttgcttaaagaccatctactaatcaaaccctcccacttcaaaagtagaaaacagaaaatcagagattaagtaacttaacccaaataaaaacttaggtttggtatttaaagccctctgcactctgccccttatttcttttcaatatcatctctcatattagcctactgaaatattctgtctaatgtgctcacaagacctggcttaagcatgcctacattcacagccctacactgcagcatcactacagtagaggatcactgttttctctccaccaaggcaaactgaatggggccgccaaggcctatctcaagccccatcttttccaagaaaccttcttggcaacttatccacagagtacagacctcctggcctgagcttccatagcactccctgtcaaggcatttaacaaaaactcatgcaatgtctgtacaaaagttttttaaaaatctctctgggagaagagttatatgcttatgtttcatcctttcagaaactataagatctttgggtcagaaatataatatcttaactatgtttaaatggcttggtatgtttggatctgtgtccccactgaaatctcatgtcaaattgtaatctccacgtgttagaggaggagcctggtgggggtgattgaatcatgggggtggacctcccctttggtgttctcgtgatagtgaatgagttctcatgagatatggttgtttaaaggtgtgtagtactttccccttagctccctctctcctgctgccacatgaagatgtgcttgcttccccttcacccttccaccatgattgtacatttcctgaggtcccccctgtcatgcctcctgtatagcctatggaactgtgattcaattaaacctcttttcttcaaaaattactcagtctcaggtaattctttacatcaatggcaaaacccgcaattacttttgcaccaacctaagagcagtgtgagaacagactaatacatagccttagtgtatattacaggaaggaaggaaggaaggagagggagggaagtctaaccaatggctctgtctggaagtggagcttcttgggagattgctctgtgctggggctggtaaggtgcactgtatgacatatgacagacacagtggcccatgctctaggatcatcttaactcctttacatgttcagccagatatgctacaacttgaaacagatatcttggtttccttctaagtatgtagcagaatgagacacaaatatcccctaggggataccagatgtccccaatacattgcaaagaccacactatagaactgtaaaagaacagaagtcttcagtagtattgtcaacattgcaatgactttgagcgacttcagtataaatctcttatatgtcacacaaatttttaagggtctaatcaataccaaagctaccccaggcacatagaatattgaaatacttgtgattgatgcatatggctccaagcaaggaagagatttgggtatgatggttgagcactaaaggtctggagtcagaaagcattgcatttgaattctagttcctgactgatgcacgctttggcatcttacaagcaaattctgaaaattaaggctcgcagaggttatctgtaaaaataaaaataataatggggaccaaatgaagtgaagtatacaaaggacttggtccatctaataacactttaataaatgaaaagtgagctgttatcatcacctctaactagagctatagaaaaagaaagccagtttcagatttcttccaagtcccagcaccccttcaggcctctctcccctataatcccacccagcctgatgtgatacagttagaaggaccttaaattccacatcaacagagggcctaaaatccaatctggctgtaacaatccatgccccattacccaatctaaaagactggaattctctcccaagaattggctggttaactacgatgaagtggcagttcacacaggcaatttcttttatcaggtataaattctcagtatgcaataatctggcctcaagaatgaaatcgaataagcattttcaagatcatctaaagaagcagctccaacaacaacatttccaaatcctgagccaagagtaagagaatgactttcatcagaaatgatgggagccagctgctccaggaaagatgcaagcagggcgaagaatggacattaaggaggacgccaaatgccaaagggctcagcaaagccgtaaacacttaaggggaatggtacacatcttccctcaaaagcaattaaaaattaattgtgacacatgctgaaattctgaacacagtcaaattcttttttcctcacttcaaatcctctaggctcttatcaccacaagtccgacaccctctttggtgtgtcttttattttaattgcaaatctattttcatagtataatatttttatgaaactatttgaaaaataaaggtcatggcttttttattcattattaagaaagaatgaatagttgtgtacttaaattcttctagtttttaaaaatctggcttattaataaatatttgttgcaattgcacaatatttatgttcaaaaaagccatttaggaaagaacaacacattctttactgtactagaacatgaaatcaggtaagagaagatatttcaaaaaaagaaaaagcatgctttgaagaaaaatatccaagcattttatttgctacatcttaaaatgaccaaataatcaataacaaaataagtaaaaaacattttgtttttaagtgaagcccaaatgccaaaattttaatattccaatctcagtttttaaataagtacttctgcttatttagcatcattaagaatcttacagactcgagagctatgttaggcactctaaaaattaatatttctcacacctcttataatttttgctagatagaactttgaaagattaatattgagtatagaatttgaagctataaaaattaacatttgtctccaagagcaaagcctggggaaaataaaataaacaagaaatgtggacagcactgttaaaggttttcactgaaactttacttgcgataattacattttccaaatctaaaatagcctggctcatacttttgtcaaaaagtaggagaaactgggacagtctactaggtcactgagctaaaatcaagtcatcagcagggctgcattccttttggaagctgtaagagagaatctgtttccctgctttttccagcttttggaggccaccgacatcgcctggcttatggtcccccttcctccatcctcagaaccagcaacaggggactaagtcctcctgctaccacctctctggttctctctctttcacctccctcttccatttataaagactcctaccctgataatccaggataatctcgctattttaaggtcatttgattgtcaacctcaattccatctgcaaacttaatccccctttggcatgtaacataacatactcgcaggttccaaggatccaggcacagacatctttggcgtgccattattctgcctgccacagccactatctcccacccaatgtgctggaaagctattgcatttgaggtattactgtatgatgtgtgactcttcagcatgcatccctcctttttctttaactgcacaccgatttcccttcaggttaaccatgtcatactccagtcacactccttacaaatcagaggtaaaatgccccaatccaggtgaatcaaagtactgcatcccctgaccacagtgaatgattcaagcttatgactaaatcaagtagccaataaaatctctaccaggaaatgtactggaactgtcaaaaaagaggcatctctcttctggagtgaaaggtagaatgacagcctggagatgacagcaacagtctttgccacaacttgtgggaggtgtagggggaggtgaaccaatcctactctgaaagagaaataaaaccaatacagaggaaaaatgagaaagatacaaggaaaaagagaaagagggaataagagaaagagagagagtccatgagagtatcatttgaactctagatccaactatacctgactttgaaacctcatcaattttgttttccttaacctgtgtgaactaggttcctgtcactagcatccaaaggagtcatgacttctacatgacttctgttagcaaactggaatgaagggaattccaacaaaataaggtgtaagaagtaaaagagttgtatctggtaaacataaaatatagttggcatggaatccatatggaataactggttttgcaccattcctttctcaactccctctctctactgctatattacaattaattaaacaatactacactgagatacaaacatgaagataatacatgaaaacaaaactctcaaagagctgtcacatggtgagctgactggctggacagtttacaagtccatggcacaggaaattaaagttcctggaaattcatggtgataggcagacctacctaaaatgtacggattagaatgaagtacctctctttgagtaaaagtttttttaaaaaaagaaaaagaaacagcacaagtcaaagacacactaataacaatagttatgattctatcttgtttacagcgtagcagcattttatgaatgctatgaagtaaatagtagtattttcacaagactatggcaaagtaatttatggattcaatgctattcccattaaactaccattgacattattcacagaatttttaaaaaactattttaaaattcatatggaaccaaaaaagagctcatatagccaagacagtcctaaacaaaaagaacaaagctggaggcatcaaactacctgacttcaaactatactacaaggctacaataacccaaacagcctggtactgacacaaaaacatacacacaggccagtggaacagaacagagaactcagaaataacactgcacatctacaaccttaaacctgacaaaaacaagcaatagaggaaggattccctatttaataagtggtattgggagaactggctagtcatatgcagaaaattgaaactggaccccttccttacaccttatttaaaaattaactcaagatggattaaagacttaaatgtaaaacccaaaactataaaaaaaaaaaacctataaaaaccctaaaagaaaaatctaggcaatatcattcaggacataggcacagacaaagatttcataacaaaatcactgaaagcaatttcaacaaaagcgaaaattgacaaatgggatctaattaaactaaagagtttctacacaacaaaaatgttcattgcagcactattcacaatagcaaagacatggaatcaacccaaacgccaatcaatgatagactggataaagaaaatgtgatatatatacaccatggaatactatgcagccacaaaaacgaacaagatcatgtcctttgcaggaacatggatggagctggaagccattatcctcagcaaactaactcaggaacagaaaaccaagcaccacatgttctcactcataagtgggagctgaacaatgagaacacatggacacagggtggggagcaacacacgctggggcccattgaggggtggggtggaggagaagagagcactaggaaaaatagctaatacatgctgagcttaatacctaggtgataggttgataggtgcagcaaaccaccatgacacacgtttacctatgtaacaaacctgcatgtcctgcacgtgtaccctggaacttaaaattaaaattaaatttttttctaaaatgtagtattatgcatatgttacacacaagaaagtaacactttgagaggttaaggttaccagctagaaagcggtggagttaggactttaaactactcagtcaacagtgtctgtgctcctgaccacttgatagaggaaatatgagtattaacaggtcctctcctggatatatagatttagattttagattaagaaatggggccagggccaggcacggtggctaacactgtaatcctagcactttgggaagctgaggcgggtggatcacaaggtcaggagttcaggaccagctggccaagatggtgaaactcgtctctaccaaaaatacaaaaattagccggcgtggtagtatgcacctgtagtcccagctactcgggaggctgaggcagagaattgcttgaacccagaaggcagaggttgcagggagctgagattgtgccactgcactccagcctgagcaacagagtgagactctgtctcaaaaagaaagaaaagaaaaaggaaatggggccagtgtagtcccagctactcgggaggctgaggcaggaggatcgcctgagctggggagatcaaggctgcagtgagccatgactgcatcactgcactccagcttctgttacagagcgagaccctgtctcaaaaaaaaaagaaagaaaaaaatgaactttacatgtaaaagagagaggttcttacacgtaaaggaaagagaactggaactcatgaataatgccatcaatcattctttttgtttgcatatctaaataaaaatatacttactaaatattaagaaaaattgttggaaatgtgatttactatctaagaccacagtacctgaggaatcatatatttaatcctgttttacttgctacaagtttcctaatgactatttttgttttatcaatcacttcaagagcaaggtataccttttcatgctgctcacaatttgttctaaattccatgcagattcatcatgctgaatttgtggcaatcattttcataaacaagagactgacattttaccacaaaatttctcctagggatttacagttagtcagcaaagtcatgtaaacttctttggaaaatcaggaggtataaattatatgtgggaacagaggttgctatgctaggaaacttcccgtgcttcactgtccattttcaggaatatacaactctcagattgcactgtatgaggtagatgagtcttctcgcagtactaataaaattacaaaaacatttgtataatatgattattcatatttattgggtacttgagagttagaaaaattacgaattcgctgcatctttcagattgcataaccaaatatttaaaaattatattcaaatatcaaaaagaagaaagaaataattctaaagtgaaattttaaaaatcaatactttcctaagttgctagtaggagttcagatcatacagacttgttcaaaagccatttgtcaaaatgtatcatgtgaatttgtttttactcagtaaccaacttgtggggctctctcctaaagtagtcacttgaaatgcaggcaacgacatatacatacacaacactgtgtggcaacattcactatcatgggaaaataaatactgttaggaaaatgattatacaaattagagtttattagtatgatgagattaaaatgaagttcagaaggagtttgtaattatgttgaaaaattgtactaaaacattaaacaaaacaaaaacagttatacaaaaaatacagtgtgtgtactgaaagaagtttgaataagaacatgctaaattataacagcagtttgggaactggaatgattttcaaaaatcttaagaatccagaaaaattaaagaatataattacagtgggcacttgtaagacatcaacaatctgggaaaacactgactaattaaaaagaaaaaattcaacaacttataataatagaagtagtatagtttaggaataaaatttgatctctactacacgaacactaaagagaagattctcaaaattctgataatagcaatcctttttaaagaagcattaaagttccattgaagtcatcattgtcaatatatcctttccaagcacaataacccaactcttcatatcaaaattactcatgattttgccaggcaatttggaatggttcctaatggatttccaagataatctgggttggctactcaaagtaaagaatgttttaagatcatcattctggaagcagaggcgaccttgagggttttttaacatttctgagcaatattataattatttggtacaatgacaaggaaaagcagtgaaagcatggctaaacaccaacactaagttgtgataatggtgatacatagcatgctgcacttaataaaattttcacctaagaatcttgaagcagttaacattcaccataatcatgctcaatggagggacaaaagataaatcagtaaagccaactccattacctttagttacaagaaagaataatggcttgagtagctaaaattctaaattttacaaaggatccccctaaacctccttcaccacactttctagtactgctgctggcaaattggattgacagattttaatcttagcttagcttatctttcctgatgccagcaatagggcaaatgatcccaagtaggctgtagttaaaaaaacaaaaaattagttggcattccaaaactgcacatagaattcaattcaatttaccaaatacttattgagtacaaacagaaaagcatacaaaaaatgataggcctaggtccctgtgctttgtggggtggaagaggagtcccaagaggccttgataacattgaataattaattgtatagccattgtcaccatcttcattttcttagggaccaattcagcctggagaaaggcacaaaacaagagcattcaaggaaattcagaacatagataaaccttaatataataatatcctgcttgctagatctattcattgaataaccaatatttgaggacccacaagctaccaagcactgttttatgtactagagatacaattggcatcaaaacaaagtctttgctctcatgagggttaatctagtgacaatgtttactggtcaataactaggtaagtgactcacactaaaccttacaaactgaaacctgaaaatggtgaaaaattatctcttagtaaactagatatctgagagagtaagattagcaactttatttttttaagattgggatgtaatggaatttgcaactgaggaacagaaataggacagatgccccaattccaagaggaatcaggagatggaagatatgccccaattccaagtggggtcgggaaagggaagacagcttaacactaaaggatcacaatgctttttcctcaaatgatactcaagcaatctcagtggtggcttatgaaacaaaaggactcagagaattctttttcagattttccagtgtctacagaactatgattatttcctaagccacatgtgtcattgagcaagcctccttacccaattggaccagccacaccagtttcccacaattaactcaggcatcctaccaaggcaatactctgagtcagaaatgacagtgctccctgatacgccctagaagtatgtcaatgatctcatgaaacatacttacacatatatacagaaacatactcaaacacacagatatatatgtatgtatgggtataggtaggtggttagagaggcagttcctatctggttgacaaagaggcacacaactaggtcagggttcaaaacctatttacccattttttctagggtgaatcctactttcccacataccaagaaggtattattccactggctgaagagagaaggaaggaggcaatatcctgcatgagacactatattggtgacatagctatacatattctaacctgtccccatcacaaactgccttctctttacctaaataaaagccttcctagtctagagggttgaagcatataagatatatttttgaaaattgaccttctaagttaaatactaagaagtacatatcctgtgactctagttacaaagagcatgaaaaactgacacaatcaatttatcctgttagaagtcaggagagcagtcacctttcataacgggagaatgcttggcagttggcatgagggacgtacagggattccagtaatgttcaacttattgatccagctgctgactgctgactgcacaggagcattcactttgtgaaaaatcagcaaagtacacttatatgcaccctcctacatctatactacacttcagtagaaagtatttttaaaatttagtttcttaacaacttgtggtttattactcatttatatttaacccttcctgaaacattaaattatttagaaattattcagggccatgaaatttattttctagccaatttgttgaaaaataaataaataaaatctacaaacattatttgtctttcctaatgtatttctgatcaaataacacgtccccaggtagttatataaaactacttctaaatcagttaatagaaaaaaaataaataacgtgttcaggagtgcatttcaccaaatctccaggttagcagtgtagcagtgcctttacacatgggaacaggggagcaaaactaatcactgtacataagattttcttacatatgatacataaaccaaagtgaaatgatagttatacttttgctatcacaagacctgtgggccaaaatctattttattcaatctgttcttctcttcattcaactggaaaacgataaataagaatggtaataataaaagagagaaatcccataaaacagatgaatatgggaacaagtaaatcttcagcactacaccctaagagggctccgcctcctctctttcatactgacttatctctcctctgccaaatttaaggacacctgtactattttcttccctttaaaagggctaccatagtaatttacattagcaaaacaactgaaccaaacttcggttcaatccagggcctcttatatgagagcatcctaattctatcttaaaattctaatcaaagctatatattttatgaaattttttggtggaatgggtgatcttaagacatctttttaatttgcatattgaaaagttgggacgtgtaagtaatcaaatatttaagtaattaaaaataagacaactttcttctccctacttaagagttggttaaaaaaaattctttaaaaagataaggattgatggctgaatgttatcaactacgaatgacaagtatctgatcataaacactgtacttttagggcagttctcagtgcctttcctccccactgttctcctcttgccgtcgaggtctaagcttgggaaatacatccaacaatgctaagcactgagtaggaaggagcattttgatatatgctcatatattacaggctacatatacacacctctgggcttagctcttgggtttcttagttaacaagtgtgaatctccactgtgtactataacaggtagctatgcaacctctcaagcttcattttcctcatctctaacataggcacaatagtatccccacctcacagtgtggctgtgggaatcagttgacataacacatgaaacaatcaacactgtgcctggcatttaataaacggccaatgacttgtaactatgtttgcagcagcagttataaaaacttttcttctaaaagacagctttacaatatcacctgacaaatacagaattgacagagactaatactctgccaaaaagaaaaattatcttttaaagtaatccaagtaaaatgtgtatgaaaagactttgaatgtagcctggcttcttgccagatgactttcagcctccgcattcacaacaaatacattattctaaacagcttcaagaaagaccatggacttctgagtgacctgttgcaagtcacttacactctctgaatctcagtctcctcacccataaaatgggagtaagaatctccacaccatcagaagagtactgggattttagatattagcaaaaggcctaacagtatctttcacattaggagataattattttaaagcagattgaataacagaagtcatcagaggatttacccaaagcaggaaagattgtaagagaaaaatttccatgctctgtacttcattgttctcttctatgtagcattcttgccttctgttgtactcaaatgtgctcctcctaaatgctacagaagttgatgattttatttcattcatctccatatcatcttacagcccctccatcatcttccaagtacatatcagtggcttgtacaaagacagtaataaactgatgcttgaaatgtccaactgcaggagaatttttacctcactataatttagccccaggaaagtgggaccttcctccagaaagaggaagagaagaacagaaatgtttccggactacagattattttttttaaccaccagtgggaaacatttcagaaacaatattttgcttagctcacttcattcccttactttcaacttaagataagagtgacatctgagaacaaagcttacctatttgcaccatttcttcattaccagcctggaaaggagggggaaagcaagaaaaagaaagttactgggtttcatcttatcaccttgtgagttttatttctaccattaatggtttccaagagctaactaatcaggagatgctagagactgggattggtgcctaaagcctgcaccttggtttgtagaaggttccatgagccaattccataacaatttggggaagggagttgtttgccccttttcattttaatttaacacttatgaagccagcaaaaatacatacagactctcaatgctctcttctgaaatgtcgtactgggtctggattagaaaagaaagtatgaatttaacaggccaaaatacacctaacagggggcctgattaatcagatttaaggtcaggaatcaactagacaattctctactttttaccctatggtcgttcagaccaggccgaccggagaagctacaaaaactaacagagaaattctgtacccaaagtcccatcggcccagtgctgatatgatttactacaaacagctcccctggcggagccttctcaaggactcttctgagagcatcgggcttcaccttgagcctccaaagggttgggggcagggccgaaaagaaacagagctgcactcaacttagctttaaaaagaggaggagttgtgcagagggggaggggagaaggcggccggcgcctgcagcctctgcccaggaaaacggagggcaggaaacgtctccagcccccctccccaactgtcaaatcctagcccggccgtggtactcccaggacacgtgtctactggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactaggaattgttacgaatgtcgcagactggtgaagccctaggtgtgacaagactgggctcccggagtgggagtcgtaacctcccgtgcaactcaaccctctacccccaaaagcccgcacgctgcgcccagccctcaaaacaccgtttctgaacgcaaaagataacagggaagggtgggaggagaaggaggaaagagaggagggtagagaggggaggaacttttcgggaaaaggttgggtttgagtttttttttattgttattattttccacttacttgtccatcagctgaagtcctaacctctaccagagcggctgctatcaaccaaagtgacaggagaaccatcacgagtcgagttcactttccaactactgggcaaagc

SEQ ID NO: 809 - DNA, 109467 bp, Homo sapiens
atgttttcaagttctgctttattattaaagttgtaatcccttgatatttacagagcaggcacctcggtgccaaggaccaggccatgcccgttctggtctgggaggcagaacctggggttgggtgagccacggggtctgcaggttgcatccgagacccccaggtcctattcttccaccccgtaacaaaaccagaaacctccccaaggcagaacgccaaaggccaggtgtcacccacaccccagcagttccccttagcgccagatggggctccctgagccctgtggctgaagtggggaacacggccatggggcttgtgtggactgaattctcatgtggctgcagccctttctgtagtacagactggggttgttaacatagttcatggtgcctgcagccccttcatggtgggggtgcctggtttgtcctcccaggagaagcagatggtaacactgctggacctggctggaaggagcctgaagcatcggccacgtccactggcttacctgcatgtaacctttcccaatctcagcctcataggatactacacttatggcaaggctaaaggagaggggataagtcacagccccagcacccagcaacacacacggtgagcggccgggctggagtgcagcagcatgatctggctcactgcaacctctgcctcccgggttcaagtgattctcctgcctcagcctcctgagtggcgcccaccaccacacctgtctaatttttgtatttttagtagagactcctgacctcaggtgatccccctgcctcggcctcacaaaatgctgggattcccgtacctgggccgggctgggaattttaaccatgactctccactccaaaataggtccagatccttggcagccaaagatgatttccagccccgggctcagggcagccagtgcgtagtcctcacatccataccatagggccaggttccgagggcatcatggctgctaggctgaaaaacccgcccttctccaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagggtgggggtttctccatctctggaagctctacacttaaacattttaagttaaattacatttatatagtattttcataatttatattgcttaaaattatgatttgcatgctaagatgcaaacttacgtgatatcttctttagacataatgctattaagagcacatgctttataaaataaaactggtctcattcatatcaggtgcagaaagccagtcctgaaagcatagactatcccttattctggctgttattaaggaaaaaattcatttaaaaaatacagtaaagattgaaaccaagtttactgtttcttgaacagaataggaagaaaatattttaaatggctgagctggtcattagactattactcatttatcttaaaggcagaaacttgtcaacccaactacgtgaaacagagaagcatgatttgcttaagcaggcgacattagagttaggcctctccactgaagcttcccgaccgtcagcacgtggcagacaggatgcgcccatcattccgcaagggagaaccggagaggcccgggagagtccttggctgtcctctcatcgaatgatgggtgccgagcgatcattcgtcacagtcgggcggagtttcacagtggcaaaggggttttctccgctgcaggggataagaaaaatctttcagaacttctgctctacgagggaaactggattttaacagtgctaataacccgttcttgccctgtgagactgggcggctgaccacctccccagcttgtacaggtcccagcagcgttttctgagtgtgaaagttttgttcagtgatgattcctacaccataccacctgctgcagaacgatcccaggttttaagcgttctggacgtgggcacccacacctctttagtcctgcattgtgtgtgacatgggggtcactctggggtggggaagccctgctcccagcgtggtctaaagtagttggtaaagcgagcagggggctgcactcccccatggctccacaggccgaggcctttctcaggctggaccccctgggctgggcaccgaaggcccttccgggggacactacagggaagagcaatgtcacacactgaggctcacgtaggaagccacgcctacctgagaaaaggcggctttgcagtcccgttggcatcgttctgtgagaaagataaagaagtttatggagggcttagaattggtcttttaaaaattattttaggtagagatggggatttgctatgttgcccaggctggtttcgaactcctgagctcacgtgatccttccaccttggcctcctaatgtgctgggactacaggtgtgagccgctgcgactggcctgtattggagatttttaataagacccgaaggtaaagacatctaaaacataagggatgtttaaaagtgccctgtcccaatctgttagactgtctaaattcacttggaagaataaggcaagaacagaaaacgctctgaaaggcggtagcggccctcccaggtgtcagagcgtgaacagagcatggcactgcctgcgcgggtcacccgtgatgtcgggagctcacatgtgaacgagccgcctgctaaactcggaaacagtttcacaaaatgaagcttgagcaacagagcgacatcacagaagaaaacatttgtgccaaacagaacctctcagactcggggcaaacagagatcccacaggtcctcagccacggtcttttgaacgcagaatctagtgactgggatgtgctttttgggagctgactcctgaagcatgacaaagaaacaggaaataaaaataaaaccccactggctttggggctgctagagccagggatcttgtaggaagctcaaactgaggaaaagagaaggtggaaccaaagtgcaaaggtgcctacagggctcgggtggggagcaactccttccagcacctgccacccagggcgagccagggccaggtgtgtgcgcgccttctttccctcactccaaaaagcctggagggtttaacactctttcctgcctgcacacagggagtggagtcaggcagccgcccaggagagggcagtgtaacactgtgtaaccagcctgtggcccggccacaccgtcctgacagccccaggaagcgtcccagcacccccagggggtctcagggagcacgcagacctctcaagattgacttaggggaggccctctcatgcccgatgccagcgctagagcgcaggccgttcctggacatggaggcccaggccaggcctcctctgggatggcctccactgcatgttgggtgtacaggctgtggagacggaaggcagtttgggagccccagggctgtgcctgagacctgtcccaccctccccagatcccctgggcagggcatctggggccaattcattgtctgcttttcatcactggagcacaaagccactgacctgccttgcacatcctacagggctttaaatggccgcaaaagtgacttcctgcggggcactcaacgcttccctagcaggcctcagaggaagtccttgctggtgtgaggtgcatgctctgcgattatgatgggctaatttatgatttaaatgcaccagggtgcctgtcgcatgtgctcacggtgctggcattcgtggactctgttgcagaagggccatggctgggcctgaggcacgattcatgccaatcctgactccactctgccctcccctcctctcccactggagtcatctgactccttggggccaacaccatctccctcacatgtgcagcttatgctaggggaaggcgcttcccaaactagaaaccagaaacaccctccacccaccccaagcacaccccggagcttgttcagagcctcctgggcccccacgggactttaaaaaggtcccagtaaatcctcacaaagaacgcagcaagaagcaccgactcctgccaggaggactgaggaggaaaaagaacgcttaagatgacagctggaagccactcagtgttgggccaaccccgtgcacgcatgcctggggcccaacaatcctgctccctgtaggaacaagcagggcacacacccatgggcaccgagacactcgggcagccctggagaaacagcccagaccagaaacaccagacgcccgtcaatgggagagtcagaaccagcttctgtgcagacagcaggtcaccacacagcactgagcgactgtccctacggggccaccccagacagccatctctgtgccagggcttggggagtctggtgttggagaagggatggtcacggaggtgggccatgctgggtgatcgtgggggccgggaacgtcctgctgggtatacggagtcacatcatgaaaattcattgtgtgcttttctgtctgtggtattctgtaatacaatgtttactttaaaatatgtattgggccagggacagtggctcatgcctgtaatcccagcactttgggaggctgaggtgggcgcatcacctgaggtcgggagttcgagaccagcctgaccaacatggagaaaccccgtctctactaaaaatacaaaattagctgggtgtggtggcgcacgccggtaatcccagctactcaggaggctgaggcaggagaatcgcttgaacagggaggcagaggttgtggtgagctgagattgcaccactgcactccagcctgggcaacagagtgagactccatctgtaaaaaacaaaaaaacaaaaaaccaacaaaacaaaaacagaaacaacaaaaacatattggacgtgttcaggcagatttcccgtttaacatctgcatgtttctcagggacctgaaaccccagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtctcaaccgcatacctcacactcagcccactgtggtggtcactgaacatagacctgccctcctctctgttccctttccttgcagtgggggacacctccaagccacaggcagcactgccaccggcacccagggccccgcgggcactgcctgctgcatgtcctgtgtccccaacaagacaggagaccactaaggccacgaaaccagcagccactacgagagtggttgggctgcaactggagactatagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtacggagcttccagggtgcccaccacatagccatgcgcccaggttgggggactagttgacctggctttcagaggggtcccgggcagctcggagcaccgagcaccactttttcccttgggctgcagcagagaatgctggtggccctcactgcagagggcaggacagagtgaacagggccagtgcaggtggccttgctcctgagcagaatggaacagccctaaggaacatttccaagccagctggaggccagttactcgcaacaaaagtggccctcactgacacctgtcttcagtgtgaaaacccattccagtcctcgtctgtggcccggacttgtcttccagttcacttctgatctagttcaacccctttattctcaaaagggggacgctgaggcccaaacagggaaaagccaactgctccgagccactgggatctttttggaagccgaggcacccatgttgtgacgcaaacgaagatgcgtgcaggcctgcaccgggggcactggcggctctcaggaggggctcacgccacgtgagggcgcgctgtgaaatgcaggcttgcttttacaaaggagagctgtgtgcttatttaaaatgttgggagggagccaatacttcctcacttggaactgcagtagaaaatacgtaaattaaaaaaattcaggccgggcacagtggctcacgcctgtaatcccagcaccttgggaggccaaggcaggaggactgcctgaggtcaggagttcaagaccagcctgggcaacataacaggatcttatcattgttaataaaaacttaaagagatatcacgtgacctgtggcaaacccctagcttgagtcctggcaagtctcccctgcccccttgggagaagcccctgctctcagatcgtctaataagacgcgccgtcacaggacagctgtggggcttcccaggtgagtgggatgctctatggacacctaaggttaagcattccagtgtcacacgacctgtaactcacaggagctggatataaaaccatgtataaaaatgcttttaaaaaacattaggggctgggtgcggtggctcacgcctgtaatcccagcactttgggaggccgaggcagacggatcacaaggtcaggagatcgagatcatcctggctaacacggtgaaaccccatctctaataaaaatacaaaaaacttagccaggcgtagtggcgggcgcctgtagtcccagctactcgggaggctgaggcaggagaatggcgtgaacccaggaggtggagtttgcagtgagccgagatggtgccactgcactccagcctgggtgacagagcaagactctgtctcaaaacaaaacaaaaaaaacatgaggatgctttcccagctctcatggatcccagtgtttggcctgggatataacacagctttccccaacatcatcagctggtttaggcattttggttagggaaagctaagttattaatcgaggtggacataaaaaggctgagacacataattccaggactgtgtccccagccctcaagggtgccagaggcccccggggctttcaggtggcaaaggctgccattgtttttgagacaggtcttgctctgtcacccaggctgcagtgcagtggcacaatgacagctcactgcagcctcgacctcctgggctcaatcgatcctctcacctcaggctcctgagtagactacaggtatatgccaccatgcctgactttttaattttctgttttttggtgttttttttgagatggagttttcctcttgttgcccaggctggagtgcagtggcgtgatcttggctcactgcaacctctgcctcccgggttcaactgattctcctgcctcagcctcccgagtagctgggattacaggcgcctgccaccatgcccagctaattttttttgtatttttagtagagacagggtttcaccatgttggccaggctggtctcaaactcttgacatcaggtgatccacctgcctcggcctcccaaggtgctgggattacaggtgtgagccaccacgcctgactggttttttagttaattttctatatagacgaggtcccactatattgcccaggctgatctggaactcctaggctcaaatgatcctcccgcctcggcctcccaaagtgctgggattacaggtgtgagccaccgtgcccggcaggctgccatcttttgagcctcagccatggtacctgcttcttgaccaccacgttatggatcaagcttatttttatatatagagagagatgggtcctttctctgtcgctcaggctggacttgagttcctgggctcaagtgattctaccaccttggccttccaagtagcagggatcacaggtgtgagccaccgtgcccagctagagcaagtttttaaatggaacactgtactattttgtatgatctattcctaactgtccaatgtggcaaccactagctgtatatggctacttaaaataaaatttgccgggcgcagtgactcacgcctatattcccagcactttgggaggctgaggcgggaggatcacctgagatcaggagttcgagaccagcctggccaacatggtgaaaccccgtatctactaaaaatacaaaaattagctgggtgtggtggcatgcacctgtagtcccagctacttaggaggctgaggcgggagaattgcttgagcccgggaagtggaggttgctgtgaaccaagatcatgccactgcactccagcctgggcgacagagcaagactccgtctcataaataaataaataaacaaacaaacaaatgtaaacgtctagttccttcgttgcaccatccgtttttcaagtgctctgctgccctgtgtgccctgtggctgctggactgggcagggaacatttccatctgtgctgctcgtctctgacacacacatgcttgatccatgatccctgctggtgaggaggctgtgaggccaggaggcccagaacacacagccattccccctgctccctgctcccgcccttggagcagcaccaatgcgtctgtaggctgtttcccacagctgcgctcccggaactcctgactgggattggtctggatgaaacgtggtcacttgtctaacaggagtgctgtctacagaggctggatgcgggtgacagttgcagtccctccccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagccaggatggttttgatctcctgacctcgtgatccgcccacttcggactcccaaagtgctgggattacaggcgtgagccaccgtgcccggccaagccttctagctttcaagacagaaagggggaacctgaagatgatggtgtgtgtgtgtgtgcacacgcgcgtctgtgtgtgtggtgggggttagagggagggtggtcttggggaagtgagctttggcaggtgcggcctgtggaggcagccggggactggatgactgggaatctctcccgtggaggggacagcctgaagctcgcgggtgtgagctgagaataccagctcaggtgggaagggtggtggtggtgtccacatgggccagctgcgctggtggaggctgcagggcaccaggtcaccccctgcaggcagccccagctcagcccaaccctccaggtcagggccctcggggacagtggtgtgcttaaagctctgctgcccgaggaagtgggaagccggtaagaggcgtgcaccgtgcgctggcagtctcccgacactgacagaatgtcatgatccagccaacgaagaggtttaagaatgaagccaggtcacctttccactccccagtgctaagtaaggaggaatctgtcattactgagtacactgatacttacaaccaggcttcttccatttatccaattccctgcagtaagaatggcggcgacagtactttcttcaccaagctttatccacacgataaatacgctgacaatgacacgttttcattttctaacactgaagactatccagggttggccaaagtgtcagtgctctcacttacaatgccagagctgtgatttttgggggcaagattcttttaccttaaaaggcattatccaacctcaataaagcagcaggctaggcgaacatcaacagctactaacatcacaaaaagagatggacgtccacacgtgcctcctcactggtgaaatgctccagcaaaacacaacagtcaaacaagcaaaacagcaacagactctgagcagggcctgaggtctaactaccaatttacagaaatacaggagacacgggggaacgcagaaaggacaccaacagcaaaatccagatgggggacaccctccaggacaaatgactggttcttctacaaagagactgctaaggacaagaggcagaggggggacctgtagctagaaaaggcctcacgagccctatccaccaattataatgtatggagctgatttggatccagattcaaacaactacactgtaaaccatttttctttttttatgagacagggtctctgtcatccaggctggcatgcagtggtatgatcacagttcacagcagcctcgaacttctgggttcaggctatcctcccaccacagcctcctgaacagctgggactacagacatgtgccaccgtacctggctaattttttatattttttgtctacatagggttttgctatgttgccagtttggtctaaaactcctgggctcaagtgatcctcctgccttggcctcccaaagtgttggaattacacagacatgagccattgcacctggcttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaacctcagccaacccagcccgggagtgatgtccagccgcgctgctccccaccacgccatcacctcaccttgtgttattctctgcatggcttctagtgtcagtgtttttgtttattttttattgtctgcttcctatcactagaacagaagttctgaagaggcaggcagagtccggccttgttctcctctagctggagagcccacaccagggcctctgtgcggtggcgggaatggatgaactggttccgggagcccaggacctccatgctgggcccccagaggcacgttagggttatctttcagggttatcgttaaccctaaacgccgtgcctagaaggtttagggttaaagataacatccacagtgcctgggagtaaagactttctgaagaaagatgaagttaccacttttaatgtaagcctctcttcagaaaataagaaaatgaaagaaaatggtgattcaatggctagaagactgcagccaggcaggaaagataagaaacctaataaaatctagcaaactagaggcgactgtgtgtaaactctcactgacaagatagagtccacatgaaagaagggctgaagtcaaggaggtgaaaggctgcatgacaaagaagggaatctagaggatcaaaggcagcaagtcccctcctccctcctccccggggacaccactctccccctggggacagagcagagcaaggcggtcaccacaggacctgcgcctcccagtcggggatggcgagtccaggacccaggacgccctgctgcggctttactcacaggagccgcggtctcgggcttggacgctggggccttaaaggtggatgtcgtcctggccgaatctgctctcctgtcggcagctgcccccatggacaagcattccaagtagtcgggtggggggatgacaacactgctattctcagacaagttcacggtgctgatgcttctcactggtgtggggctcaaacccaaaaaggacacagcacgtgttagataatgtctcaccaccaaaccccaaacatcctctgtgtccctgaccaaggacaacagtaatagtacatcaccaatcaaaacctgatcttgatctcacacacacagacacacacagtacatatatcaatacaaaacactgtattttttaaatttttttgcgacagagtctcactctgtcacccaggctggagtgcaatgacatgatgtcagctcactgcaacctctgccttctaggtttaagtgattcttctgcttcagcctcctgagtagctgggattacaggtgcacgccagtgtgcccagctaattttttgtatttttagttgagatggggtttcaccatattggccaggctggtcttgaactcctgacctcagctgggattacagcatgagccaccacacccggcctaaaacactaatgtttttagtggtttctaaacatatcctcacaagaaatttttttttttttttttgagatggggtttccctcttattgtccagggtggagtgcagtggcgcgatcttggctcactgcaacatccgcctccctggttcaagtgattctcctgcctcagcctcccaagtagccgggattacaggcgcctgccaccacgcccagctaatttttttgttttttgtttttttttttttttttttttttagtagagacggggtttcattatgttggccaggctagtcttgaactcttgatctcaggtgatctgcccgcctcggcctcccaaagtgctgggattacaggcatgagcccctgcgcctggccaaaaaattatttaaaagacatgacaaaaggagaggaaaccttttaaattaggggctggctcttgattgatttaatctaaggaaagaaattggagactagcaaaagctggagtgagcaatgagctaagagttaaaaaaaaaaaaaatgtaaacacttgaaattttaacatcctaaaagtgttactcagtttttgttccccagcacaatggcattttagctcttctgctagggatgaagattgcagacagcatcagaccctggggaatgcaacgtcggacctggaggccttctacctggctagctggatgggttatgggggttctgtgaacttcgatcctcccgcctcagcctccagagtagatgggacaatgggcatatgccactatgccctggctaattgtttattttttttgtagagatggggatcttgctatgttgcgcaggctggtcctgaacttgtggcctcaagtaatcctcctgcctccatctcccaaagtgctgggattacaggcacaagccaccgtgcccggccagtttcctcattttttaaagtgggggcccacctcatgggtctgctgtgagaattaagtgaaaaaatcaatgcaaagtcctttggacagtctctaggcaataactactgttagtatctgatctggaatacggatttgggggttttcggcatggaggtgctcagcaaagcccatcagtgtatttcaagccatgggagtggatgagatggcccagcacaggcaggaaggatggacccagggtgactcccaagaacactgatgtttaattgatgggcagaagaggggtgcaaagagctggtgaggcagaagacaaacagagcacaggtcaagcagccggggccagagaacattccagaaaaagcatacaacagcgttaagggctgtaagataagaacggtaagataagtgtaagataaggacggaaaacacatggcttgggtttagcgaccaggaggggcagggcacagggagggagtttcagagggctgcaggactgcgaggagtaggtggcctgggctgggtctcctcacagcagcaaagctcggggacaacagaaatcacggcagacagcactgtgagccgcggtctcatctctgactagtccacgagagctgaggcttagggcagggcctgcgacacagctagatggtggtgtgttacagaaacgacaaggcaggggtttctgtcaccgggagagctcagccacgttcagggctaccttggcgtgggcacggtcactgcttctgtctcattttcttccagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaataggtaaatatggactttcacatacactgaacaatgtgtattgttaacaatttttttttaatagagacagggtctcgctctgttgcccaggctggagtgcagtggtgcgatcatagctcacagcagcctcgaactcatgggctcaagcaatccccctgcctcagcatccgagtagctgtgactagaagtgtgcaccaccatgcctagctaaaaagcaatatatgttgtatgtataacattaatttgatttggattacccctttttttttccatattggttttatttaatacatctgaacaatctgtctagaaaactgacaagctagttacaggaaggcttgtgcacataattatggctgaaattaagaggattgcattcaaactacctacgtgctaaaccttaacaaagtatatctgatatgcagattatcttcaataaatcaaatgctaattttatttatttttttgagacagagtcttgctctgtcacccaaggctggagtgcaatggcgagatctcggctcactgcaacctgcgcctcccaggttcaatcctgcctcagcctcccgagtagctgggattacaggcgcctgccaccacgcctggctaatttttgtatttttcgtagagatggggtttcaccatgttggccaggctggtctggaactcctaacctcaggtgatctgcccgccttagcctcccaaagtgctgggattacaagcatgagccactgcactggccaaatgctaaattttttttaaaaacaaaagaatgtttaaactactttcagacaggtgacttcatacgctctaataactatgcatgcaccaaatgtatctctacatgcacagacatacagaaaatagcctgggatcgaataacttcagttaactaaactagaactaaaccataaacttaactttggctaaaatgtgagcatgtccacgaagacagtttgcagcttggctgctctggaagggaggggccgtctggtgccctgcggggaccatcacgcccagacttacgccttggacacgtcgtgttctccatagagccagccatccttctcctcggggatgagcagcgtgatgacatctccctgtgcaaagctgagtaaggtcttgttggagcccgcagtgtgcgggaagatggtcttcactttctgcttcttcatcatgttcagtcccgttgcaaccgaaactgatcgctgtaaactgggatcttcggaagtacctgttggagggagtgtagcagtaatggcttttcaaagcatgagaatcaataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctcttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaaaaaaatatatatatatgtatgtatatacatttgagacagagtctcactctgttgcccaggctggagtgcagtggcaggatcacagctcactgtagtctggacttcccaggcttaaaggatcctccctcctcagcctcctaagtagctgggactacaggcacacgccgccatgccaggttcatttttaaatttttttgtagagacagtgtctcgctatgttgcccagcctggtcttgacctcctggcctcaagtgatcctcccagcttggcctcccaaagtgctgggattacaggtttgagccactgcttctggccgttttttttttccattcaaattttcccaggctagtaatacaacaagcatctttaatttaaaacaatgcaagatctctttctgctttattcttgcagattcttcatgattacaacataaacctgcgcccccttaacctgccactctctacttcgctggtgttgaacccaccagcagttttctttcttttttgagacagagtctcgctctgtcgcccaggctggagtgcagtggtgtgatctcggctcactgcaacctctacctcctggctgggttcaagcaattctcttgcctcagcctcctgaacagctggaattacaggcgcgtgccaccatgctcggctaatttttgtatttttagtagagacagggtttcaccatattggccaggctggtctcgaactcctgacatcgagatccacctaccttggcctcccaaagtgctgggattacaggcatgagtcaccgcgcccaatcctccaccagcaattttcattctgcttttaccaataagaaccagagtcatctgaatcactgggatgcacagagtattacatactttaactgtgtattttagttaactgacaggacttccttcaaaggcaaatgcctgcagaccatcatcttcctctactgggccatcctagtcatcattctggaaaactctgttcttttgcccaatagcttcacacgctgtggtccagggctctctctcacaaacagcttgactgccgcaaccttcacaccatgggggcctgtgagacaccccacgtggatgggttggggccatggcacaggtctcgagggtcctgggtgctaaagactgtgcagaaggacggggtctgaccagtgaagcagccggcaacatctgcagacagtcactggctccaacttttgtttttgtcactgtgtcacccaggctggagtgcagtggtgcgacctcagctcattgcaacctccgcctcctgggttcaagtgattctcctgcctcagcctcccgagtagctgggattacaggcaggcaccaccacgcctggctaattttttgtatttttagtagcgatggggtttcatcatgttggccaggctggtctcaaacaactgacctcaggtgatccacctgcctcggcctcccaaagggctgggattacaggcgtgagccaccgcgcctggcctccatttatttgtaaatagataattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctcttacctgttgaattatttaccctttgtgaattcggggcagccgtggctgggttattaaacatatcgatcaagggactggtatatgctctgcctgaaggagcggggggcatctttggtgagcatttagaaagggtgtcgtaatctttcctaacctgtgaaaaattctttattagtccaatattagtatagtgcagaaccggaattacacagattcccaaggctgttttttttttttaaataataggctatttatttatttattttgagacagagtctcgctgtgttgcccaggctggagtacagtggcacgatctcagctcactgcaacctccgcctcccagtttcaagtgattcttgtgcctcagcctcttgagtagctggataacaggcacgcactaccacatctggctattttttgtatttttagtagagatgaggtttcaccatgttagccaggctggtctcaaacttctgacctcaagtgatctgcccgcctaggcctcccaaagtgctgggattacaggtgtgagccaccatgactggccacatttcagggggtttgagatgggcagaaagagtggatccatgtgttcaaagtacctgctgcatcccaatctccacagagcccaggttcaaagatcagcaaactacaaatgtgtgaattcattactgtgaatactttgatgcctattttttttcctgaagtgccttacgttgtgatgaatgccatcagagtgtgtctaatttattctgagacacctatacttccttacttgggagtaaacttagttggaatgattacaaataaaaacagtaagtatggttgggtgcagtggctcacgcctgtaaccccagcactttgggaggccgaggtgggcggatcacgaggtcaggagatcgtgaccatcctggctaacatggtgaaacccggtttccactaaaaatacaaaaaaattagccaggcatggtggcgggcgcctgtagtcccagctacttggaaggctgaggcagaatggcgtgaacccaggagacggagcctacagtgagccgagattgcgccattgcactccagcctgagtgacagagcaagactgtgtctcaaaaacaaaaaaaataaaaaaaaaacagtaaggataaaatttccaaaacaaagataatagcgccaaacatagtataaaacatgtgcccaacttatggtggctcatgcctgtaatcccagcactttgggaggccgaggcagacagatcacgaggtcaggagtttgagaccagcctgaccaacatggcaaaaccctgtctctactaataatacaaaaattagccaggcatggtggtgcgccccagtaatcccagctactgaggaggctgaggcaggagaatcacttgaacccgggaggtggaggttgcagtgagccgagatcactccactgtactccagcctgggcgacagagcaagaaagactccaccttaacaacaacaaaaaacaaacatgtgcccagctaccttcgcccctaaaggtaaggggatagaggtgcgaaaaggtggtcctggaagtaataaagggggacctgtgattcccaccaacacaggcaaatttggcccagatcaagttaggaaacacacgattgaaatctggaagagaaaactggctcctaccacattgcttctctcgatcatgggtgaagcctgaggagttccagacacgggggtagaggctggggtctttatttcttcgatcatattcatgattttctctggcactttgatggcatcaacacaggtctcctgccaccgaggcagcttggaattcagtagttctgcagactgcaaagccaaaagaagaagactaaagacaaagaagattgtctgaagagctgagaaaaatgacatcacgtcatatcgctgataacagattactggcttagcaccaggagtgtgggggccctgggttaaactcggtgagcactttaagcacctagaggatcagctgtgtctcaccggctgagaggggcaaaggctctgactcaaaaggaaatttcctgatccctcagtgtgaatacagagcatgggactaatacggggatggtaaatggttaagagcaagaacagaaactcaaagggagggagggagcaatctgtatgaatcccgttttccaggtggccccagaaacgccaaccatcactttctccctcccactcctactaaaagcagcacctccaacacaggccacgggccccgtagttgactctgaccgattcagacattagagaagtgaatcagacactgtcctgagagtctgtctatggggaagagggactgggtgagtggtgggcagtgctgagggacgcccccaccacaggccaaacaaggttttgcagagcagacctgaccagcaggggtgagaacccgcaaccctggaggcagagtgcccctccagcacccacaagcctggctctgctcctgacaactggattctcagaggccccccaagcgcttccagtgagcaccttttctgaagagcactctggttgggaaaggggaggcaggagcctgtcctgcggctgtgtgcatggcagtcacactgcttttactcagcctctgagtttatcaagagtggtggggggctgatgtcagtcctggggaagggcaaagaccccctcacaccacccctgtccccaaatgccaccccacccccaactgtcaccccacccccaactgtcaccctgacactctgcagcaccgtggaccagctgcttgggcctgcttcatcccaactccacagaaaggactgaggcgctttagctgaattaagggaagccacaaaaccagttttcagatactcgaagaaacttccagcatagaaacgagcagatttggtctgcgtcactctagaaagcattactgggaccgatggttaagtctaagaaagactctgctgataactggagctccctgaaaaggtgctaggctgcctcatgacacggtggggatatcacgcaggaagagaacctcaaggtcacctctgtcctctccagcctgcgaccctggtgccacaggatgccctcactctgggaagagaagattctaaagtgaactctacattcccgaaactagtacagacatgctgttgacaaaagtgatcacctaatacagcaactatttcctttgctgtaaccattttcttctgcttttttgagagaggattttggctctgtcacccaggctggagtgcactggcacaatcacagctcactgcaacctcgaactcctgggctcaaacaatccttccacctcagcctcctgagtagctggggccacagatgcacatcaccacaactggctaattaaaactttttttttttttttttggtagagatagggtctcgctatgctgcccaggctggtctggaactcctgggctcaagtgatcctcctgccttgggctcccaaagggctgggattataggcatgagccactgtgcctggcctgctgtactaattttaaatcttatttagggagctgaatactcctttttcttcctttttttttttttttttttttgagacagagtcttgctctgttgcccaggctgaagtgcagtggtgtgatctgggctcactgcaacctcagcctcctgggttcaaacaattctcctgcctcagcctcctgagtagctgggattacaggtgctcaccacatgtgattaatttttgtatttttagtagagacagggtttcaccatgttggccaggctggtctcaaactcctgacctcaagtgattcacccactttggtctcccaaagtgctgggattacaggcgtgagccaccatgcgcagtcctgaatattccttaaagttgtaaaaagtttatagaaaatacaacatttgcatacatacaaggccaaagtatttttcctttaaaacaaagacaaagctgacttatattcaagctcttgcaaagcttctcctatattggaacactctctaactttactatgaacaacaatgaatttctgacctcaaccagtgctagttttggatgtttacaaaggcccaacagagttcataatttaaaacaaaggaaaggaaatgtgacatgtgttgcatcatgattcctgggggttcgaacctcacagctgtgtgtgttggaaggagggtgatgaggtcattcagttgaataaaccaggaaccaataccaccaagaggaatgaacgcatcactgagcccagctgtcctgatgcgcgtgaatgggggcccgtgggctggggcagagctgcccgtgacccccggacacggacccatgaagggagcatctcaaatcgcccaggtggggtagacctgggcccgctgggactcaccagcagccatggtgaagacactgatgctgaggacacatcagaaagggcctggggaaagctgactcgcaggtgagaagagcaaacatgtgctatttttcaatgatgaagcattattttatgaaggactttaaatatggatgtattattaatttattaaacattatacatggacgtttgaccatttcagctgtatttctataagtttatatgttcaagttggccaaacacagtttctctggaatcttttcattggcaaaatggcccactgctttatattgggcatgtgtggaaggtgagtggcgtgcatgtgtgtatatctctgtacgtatggactgattgagacagggtcccgctctgttgctcaggttggagtgcagtggcacaatcatggctcactgcagcctcaacttcccaggctgaagggatcctcccacctcagcctcctgagtagctgggactacaggcacatgctaccatgcctggctagttttttttttattattttttatagagacagagttttgccatgttgcccaggcccacctcagcctcccaaagtgctgggattacaggcgtgggccacggcccagccttctggggcatttaaatatgaaataaagttattaatacgctcaaggcaatttgccaccacacccacctgtaagtgataataatgtatgtggtttgcaaagccacagtgcttatcaaccagaaagcagaagcgcctcttctcttcaagcagagcctctttgcaaccatctgcaatgaatttctggatttcactctgacgagaagtaacggtctccacatactaaaaaaaaaaaaataataataataataattatataagcatgacatgagcatcagatagcgtgcagcctgacgtttatcttctgccatctttacacctgctttatttgaataatagagtaaatacatgagaggaaagaatgctgtaacctgacctaagtagataccatcgttctccttgaggtccctgactcgtgtgcagagagaagttgcccaagggcttgacattcccacggggcaatttgcacaaatattactttgtacttcagagatatgatcgtgtcctactggaaagcaccacgggctttggaaccagaaagttccaggttcaaacccagttccaaatgccaacaataggtgatatgctttggctgtgtccccacccaaatctcatcttgaattgtagctcccgtaattcctatgtgtttggggagggacctggtgggaggtaattgaatcatgggggcaggtctttcccatgccattcttgtgatagtgaataagtctcacaagatctgatggcttcataaagggagtttccctgcacaagctctcctttgcctgctgccatccatgtaagacgtgacttgctcctccttcccttccaccatgattgtgaggcctccccggccatgtggaactgtgagtccattaaatctctttcttttgtaaattgcccagtctcggggtatgtctttaccagcagcatgaaaatggagtaataaaatatgatttaacctaagcctcattttccccatctgtacaatgggaatagtaacactgatcatggagagtcccttcttctttcagagccaggataaaaagcccatgttttggcaggaggtcactgattaattatacttaactcagggaaactctacagccttcagctctcagtcaaaatgcttatttttaaaaactgatagattatatatttatagggcacatgtgataatgatcaaagcagggtccttgggtggccatcacctcaaattcttattgtttctatgtgttggggacattccaagacctctcttctaactattttgaaataatgcatcgctgttaactatagtcaccctactctgctattggacactagaacttatttcttttatccaattgtatgtttggacccattaaccaacctctccttcatccactccccagtcaacacaatgaccatcctcagctatctagagaatgacaggtaaccatcattctactccccacttccatgagatcaacttcaaaacttttttttttttttgagatggagtctcattctgtcacccaggctggagtgcagtggcataatctcggctcactgcaacctctgcctcccaagttcaagcaattctcctgcctcagcctccgagtagctgtgactacaggtacctgccatcaccccagctagtttttgtagaggcaaggtttcaccacattggccaggctggtctcgaactcctgacctcatatgatcctactgcctcggcctcccaaagtgctgggattacaggcgtgagccaccgcacccggctaacctcctcttaaactgtgcaaattgtcaacaacaaaagaaaacaagatattgttgaaaagctcacctcaatttctttgtgttcatatttgagtgcgtttcggcttccttggcttttccttctgatcttcttcaactcagcttgggatttctccaaagactctaatttattcttgtgttctgtttggtatctttttagagttgcctgtaagttaaatggctgtgcttattttactgtggcaccacacgaattgtcacacagtttgcctttactcacacttccactgtgtgtggctcaacggggccctgacaccctcacttcacaccatcctcacactggctggggcccccacacccacaccagttcacaccatcctcctgctggccggggtcccatgcccacacttcgcaccatcctcatgctgaccagggccctcatccctcagttcacaccgtctgcatgctggctgggaccctcaccctgcagttcacaccatccacacactggctgggaccctcactcatttcacaccatccttacactggctgggaccatcaccccgcagttcacaccatctgcatgttggctggggacgctcaccacacagttcacatcatcctcacactggccggggccctcgctcatttcacaccatctttacgctggctgggactgtcaccccgtagttcacaccatctgcatgatggctgggaccctcactctgcagttcacaccatctgcatgctggctgggaccctcaccccacagttcacatcatcctcacactggccggggccctcactcatttcacaccatccttacgctggctgggaccctcaccccgcagctcacaccatctgcatgatggctgggacccttactctgcaactcacaccatctgcatgctggctgggaccctcaacccgcagttcacaccatccacacactggttagagccctcacccctcagttcacattgcccccttcatgcaactttaatgtcttggctttgttctaaaggttactgtttaaatgaggagcccccgaccagaagccaagtctctaaggacatcttctctttcttttattccttctttcctcaaaggctttttgatgctgggtggttaactttcttctgccacccaaagtctcaaagttccatccaaagcacttagccaccaaggtggttgcagcaagctgagatcgcgccactgcactctctgcctcccgggttcaagtgattcttgtgcctcagcctctccagtagctgggattacaggcgcacacaaccacgcccggctgtatttttagtagagaccaggtttcaccatgtcagccaggctggtctcgaactcctgaccttggatccacccgccttggcctcccaaagtgctgggattacaggcgtgagccaccacgcccagtgaacacagggtcttaaacggacccgcgtcagaattcaaatccttgttttccctataatctgtgaagtgcagataagaaggatgtctggccggcatggtggctcacgcctctaatcccagcactttaggaggccgaggcaggtgcaccacgaggtcagaagtttgagaccagcctggctaaaatggtgaaaccccgtctctactaaaaaatacaaaaattagccgggtgcagtggtgggtgcctgtaatcccagctaattgggaggctgaggtaggagaatcgctggaacccaggaggcggaggttgcagtgagccccgagattgcgccactgcactccagcctaggcaacagagcaggactccatctcaaaaaaaaaaaaaaaaagaatggtgtctatgttttggagtttctgaaggcatagcaattagataacgtatgtaaatcacttggcatgaaatgcaccttagcagctgtccgggtcctgtggcctcctgccgggagggtgcagccaggcagcagtcctcacgaggacgacaggggagggatgattccagggcaactcgcacactcactgccacatgggggtctgggtgagcaggaaggggactttgggtggcaggagaaagttaagtactctatagagcaagggaagatggcaagagccctcaataccgggtctgtagggccaccctgaaggggacctggataaacctgctgaaatggacaaaagtggatagagaaggggcgccatgcaggagcggtctctgcagatgggccagggcacaccgggagccccggacggtgctctcccgcacaccacccacagcctgaagtgctgctggcttaggaagtgttatgtctgcatcagctgcagcgacagaagcacaaatgtcctacagcgtgaatgtattctgtgaagacaatgctttctggaagcagtgtgatttcctgcaatactttttcctatgccttttttttttttttttgagatggagtcttgctctgtcgcccaggctggagtgcagtggcgcaatcttggctcactgcaacctccgcctccccggttcaagccattctcctgcctcatcctcccgagtagctgggatgacaggcatgcaccaccatgctcagctaatttttttttgtattttgagtagagatggggtttcactatgttggccaggctggtcttgaactactgacctcaagtgatccgcctgccttggcctcccaaagtgctgggattacaggcatgagccaccgcacctggcccctatgctttctaataagatcccaagtgttagcgaaaaccggcccacacagcccaaagagagcttgtcggtttcatgcatctgggcatcatcaacacggagcttctctcctgtctgctgctgatgagtcaacagtgggaacgagttctccccaggctgggaggtcaggcagcccaaggctggggctggaggaaaaccatgcacttacgttcatatatttcacgtcaagttctatcttcttctccagctcatggataatctctttgtggaattttttaaactgttaacaaaaggaaataaattcataccaggtttgagattttaagcaaaataagttctaaaacctgaaatgagtgtattttgtaaatagaaacacagatcacgtacattttcatcaagactctcgttgagtttcttgtgggtacttgaaatctctatgaggacatgtcctgggaacaaaaccagatatgttagcgggaagccattgcgtatttttttgttttgaaatggagtttttgctctgtcgcccaggctggagtgcaaaggcacgatcttggcccgctgcaacctccgcctcccgggttcaaactattctcctgcctcagcctcccaaatagctggattacaggtgtgcatcaccatgcctggctaactttttgcatttttagtagagacagggtttcatcgtgttggccaggctggtcttgaactcctaacctcaggtgatcaactgccttggcctctcaaagttctgggattacaggtgtgagccgccgcgccaggcccattgcacagttttgtaaagtattaggaaaagtgaaacagaacagggaaacacagaaatacactgtcctcagggtctctaagcatcatccctgagacacatcaggagcacaacagggtccccacagtggcttccagggggacacagctgagagcaaacagcttctacaacataattaatcagacaaatgcaaactctgttcaaattcacatgagtctttctgttctgtcttttgttttttgagacagggtctggctctgtcacgcaggctggagtgcagtggcacgaccttggctcactgcagcctccacctcctgggttcaagttatccttccacctcagcctcccgagtagctgggactacaggcgtgcaccaccacactcagctatttttttgggacattttgtggggagggtttttcaccatgttgcccaggttggtctcgaactcctgacctcaagtgatccgcacacctcagcctcccaaagtgctgggatgacaggtgtgagccactgtacctggcccacgtggccctttctatatgcactttttccctaagccaagttctatatatctgattcaaattttgaaattgtctcacaaatgattacttcggtcatcacagtagctaactctaggaataaaaaatgatttatttttatcgaatccccagagtaatctgattatctgtcaggcacgagagataaaggctatttcttttttctcacgttagttcttacaatgttttggaaaatactaacgccaggggaacccgcagcaggaagagtgctcagccctgcctctgctgggaatacaccagcccctgaaaccaagcacagtcacatgatgggcaggatgctccaggacagagaagcctcaccgccgagggcagcaatcacgcccccgggtttgcaatcatatctctgcagtgagtggcagtgcgccagctctctgccacctttctacaggtgacatctgataaaggtgaacaagggcctctctctgccaacttatctgcaggaaccaaacgggtttcctagggtctgacacctaagaaatggagaaacacatagactcatctggaaccaccgttaccaccaccatcaaacaatgccgaccaacagcaagatgtgccggcggaccatcctacagctcagcggccagataaaaatgaattccaggccgggtgtggtggctcacgcctgtcatcctagcacttttgggaggctgaggtgggagtatcacgaggtaaggagttcgagaccatcctggccaacacggtgaaaccccgtctctattaaaaatacaaaaattagctgggcatgatggcacgtgcctgtaatcccagctacttgggaggctgaggtgggagaactgcttgaacctgggaggcagaggatgcagtgagccgagatagcgccactgcactccagcctgggtgacagagtgagaccctgtctccccgccccccaaaaaaggaattctagtggggaactgagaggctgcaggggaggaatcggaatgaggactgtggtagaatatggggagagagagaaagcacagactggactatggcctcggctatgatcaccatacaaatgaccctatcatgtcctgttctaggtacatctgaagacatctgagtctgacactggccacccaggcttcccttgtcccagctcaggattcaacccttgctgaacacgaccacgcagacgtcccattgggcacacctcatcctcgacatgtctcaaagtgacctctctggctgccctgcattctctaattccagctctcagctgccagccagccaaggatcaacttctcgcccatgtgtaatacctgacaatcccttggggataggaggccatcatcggagccacctgtagggtgcagccatgtcccttcctaagctctgtggtctcttccctgcccaggagagaaggcatggggcatggcgtgtgaagtcaccaagacatgttcaccaggtgatctgttccaccagagatggcggaggattctcccatccacccccagcactcacgtcccaccacgtgggctttcgaggaggtcctctctcatgcctgcccaaccccaatgcctgcttccatccctcatcctctctctggactcccagcttgttctttcccagatcaccttcctcacagatgccagggatctttccaaaatgcaggcgtaacatgtcgctcccctgctcccgccatggtgttccagggaaaccagcttccgagctgtacttcagagccctctgcaaacagtgctacctagacaaggtggggtcagaggctctcagataagcagaacttgcagggcttgtgacaggtatataacctagtccttaagccctgtgggattttacagcgctctgacggagtaactcgatggctaaacacggggagtaaagacagaaccatcccagcactcagggctccaccctccgagtaagcgagcttcccactccacatccttagcaacgctggcttcatcttccagaacggggcatgagaaaaccgacagaccagaattcttcacaaaagctgccttcacacagccaagagcataattccattaatatgccattttatagcccctcagtcatttcagatacaaactcagttactttcacatctattttaaacccacaaacaattcctcattggggatgaaatataaacaacaacaaaacccgctccagttatttagaaaatcagacactctattcttggcaaaggagatctacttaaaatacataaataaataaacatctaaaaataatgtggctcaaagcattcggtgatttgagctagaggaaacgcattcacattttttccctcatactgttctctttcatgaactttatttccacaaccttatataatgtggatctctgggaagcatggtgccaaaaccaaggtgtgtgctagggtggacgccaacaccgttgaacctggtgctctggcctggccgggcctctgggcacgctccatgctcctgcccgtggcttcccgcagcatggcggagaggcgcagtgaagcagctctttcactctgcgggcaggcaggcaacacctggccttgttattcctgtccctcactgctcctggaattcagatgccgacctcacagcagctggccgccgcggagtcagcggtcacagaaaggattaacacacatcttggctgcgattctgcaagtagccgaaagagtatcttgaagcggaagatgaaaacaccctttatgttcaatctgcagaagtttcatcttaaatagagcaagtgttactttatgtttaaaatgcgatgccacattggtttgtttgctcttagttcggtaacctactttttcagaaattacatttgaaaagggggaaaaaaaaaacccggagggtggggcgaagcaggcacagcctggactcagaagaagcaaagctaagcatgcgccccaataagaaacacaccactgtgctgtgcacactggggcgcctgcttcctttttcccccggttacgtttggagtcacccttttgggaagaaactcagcgccgtcattacagtactgtgattcagtctgaataagtggcaatatacacgtatttcaaaagcaggaactcaacataactcgaagacattttctgccatcaatttttcctcaatattcgcagaaataattcacacagagtgttagagctctgcaagagcttgtctagcaggttgtggaaatctccaacaaaaaaagaatggttaatggtggtatcactctgattttagaaactgtgaacaaatatgcccaacattttggacactattgtataaagagatgcatttagccaataggtggtatggagttaaaacaaaaaaaggacaaaacttcaggaagattattggtatgaatgcctagaacattttcattggaaacacagggccaggtgtggtagctcaagtcccagcactttttcgggttcaggcgggaggatcgcttgaggccaggagttcaagaccagcctgggcaacacagtgagacctccaccatctctacaaaaaaaaattaaaaattagctgggcttcatggaacatgcctgtagtcccagctactcaggagacagagcaagaccctgtctccaaaaagaaaaataatacagtcattggactattaatatattttcttcatcagttcacagtacaaatttagaggaaccagatggagattactaatgcacctgaactgcataggacatgtaggcataaagattctttccatttatatctgatcatggataatcagaacctgcttcatttccagagaacgcagagcaacgcctgagtcacgcactacttcctacacatcactacaagtggagtcagacagtaaaaagtggaagcagccaatctagtactgttctaaagctatgctgcagagattaaagtaaaattgattaaaaatatcattggaggccaggtgcagtggctcacgcctgtaatcctagcactttgggaggcggaggcaggcagatcacaaggtcaggagttcgagaccagcctggccaatatggtgaaaccctgtctctactcaaaatacaaaaattagctgggcatggtggcaggtgcctgtagtcccacctactagagaggctgaggcaggagaactgcagaggtggcagtgagccgagatcaggccactgcactccagcctgggcaacagagcaagactctaaaataaataaataaataataataataattggaggccaggtgtggtggctcatgcctgtaatcccagcactttaggatgctggggtgggtggatcacttgaggtcagtagtttgagaccagcctggccaacatgggaaaactccatctctactaaaaatacaaaaattagccgggcttggtggcgcgtgcctgtagtcctagctactcaggaggctgaggtaggagaactgcttgaactcaggaggcagaggttgcagtgagccaaggtcgtgctactgcactccagcccgggtgacagagcaagactttgtctcaaaaaatatatacatacaaaaaaaaaataaaaatgtcattggaaaaaggactgaatttttctgacaattttccaagtttcaaatggaatgaggagaaaacagtggaagtaaaagcaaaccgctccccagcacacacacgggatgcattaaacgagcgtgagctctgaagattagagtcaccacactgaatcagtgcggaggcagatgagcaaccacaaacgtgatcaaatttgaaaggctcggtcagcatctgagaacctgcagtccctggacgcagttggaagtgaggtgccctcctggggtcagtaccaacactgcacaagcagcggggtgcaatggctcacgtccgtaatcacagctcccagttttgggaggccaaggcaagaggattgcttgagcccaggggatgggccacacagtgaaaccccatctctccaaaagatacaatgataagctaggtgtggtggtgtgtgcctgtggtcccagctactcgggaggctggggcaggaggatcacttgagcccaggaggctgaggttacagtgagccatgactgtgccactgtactccggcctgggcaacagagcaaggcacagtctcaaaaaaccaaaacaaaaacacgtacaaacaaccaatgtgcttgtaggggtgaccccaaataagtgatagggtgagcattgcctggatcattcctccgtgtctagctgctgacttaaataacaacggcaccacatcctaatcaatgtcttacaaggagacattgtaagttactgtacactgtgctcaaaactaactaactaacttaactaactagcgggtatgccacaagagccggcttgaaggagctagtactggccatgtagaagctcatactgggacaacttgagcaccaaaataaaggcagtcacaaattacaagtcatggaaaagtctaggaatctgcgagtccacagtaaacagattagaaaaaagaaatgggggaccagggacagctcttgctagaagtagagttgcacagtgccaatcagtaaatgaagagggagtacagagatggaaaatcatcaccacagggcagggaagacttgtctggacaaaaatcatcaacagatgctcaactagggcacaagtgttgacaaggaaagagaggtttgtatggtctgaaagtgttttccccacaaattgcttactagtcgtgacaaaaaaaaaaattaactacacagtgtagagatcagacaacaccttcaatggacaatcaaaacaaacataacaaatgagaggaagatgaacactgtgtgctgaaattttatactcagcggacataaaatgacttggacagtattccagctgagaacacacaatctgaatctaatcagggagatctggtatttgaaagtgaggatcccggccaggcgcggtggctcatgcctggaatcccagtgctctgggaggccaaggcagatggatcacctgaggtcaggagtttgagaccaacctggccaatatgatgaaaccctgtctctattaaaaatataaaaattagtcgggtgtggtggtgcacatctgtaattccagctacttgggaggctgaagcatgagaattgcttcaaccagggaggcagaggttgcagtaagctgagatcatgccactgcactccagcctaggcaacagagcaagaccttgtaaataaataaataaataaataaataaataaataaagccaggcgtggtggctcacgcctgtaatcccagcacttttggaggccaaggcaggcggatcacctgaagtaaggtgtttgagaccagcctggccaacatggtgaaactctgtctctactaaaaatacaaaattagccgggcatggtggtgcacacctgtgatcccagctacctgggaggctgaggcagaagaatcacttgaactcgggaggcagaggttgcagtgagctgagattgcaccactgtactccagcctgggtgaaaagagcaaaactctgtctcaaaaaaaaaagaaaagtgaagattttgtattcctgactattcatccttgtttagcatttctgatgtgggttcgtgcctgtgccaattctttattgcactactaaatggatttacttatttctttttagagaggaataaattgatttcatccacctccggcggttaatccagtgtggttgagggaggtaagggggaaatggagaagtgtgttaacaggataaatattattaacgctttgcttaacagtaaaatctctggcaacctcaattttagaaaatgagagacatggctgaagacttggaggtgaaaagccaaaaagagctgcaagcagaaacccgaacattgtttttttttttggagaatgggttcccttttagacacagcacaaatacaccttcattttatatataagtctagaatggattgctcaaaagacattgatttttttcatactaaaaagtcagaagcgactgctgacctctgagtaatagaatacaagatctttaggaagaagagctcatgaggaagatgggaaggctggctgaggaggccggagaagggccaggcaccacgaaagggaaaagactggacgcagcttcagaaggcagaaggttctggatcagcctctatagagaactcaaggacacgaagacggggcaaaggtcacagcatccgcaggaagatgcaatgacatcagacaggcctcttagtacctgtgcatccccgggaagttccctaacctctttctgcagtatctcttggagctgtggtattctcatctgtgtagagtgcctgctccacaggcttcggtgggtactgtgctttccagtgttctggagagaaacactggctgctgaggtgccccagtccagacacgtggagcagatgggttcaataatgcactggcttatacctggagtcccagctacttgggaggctgaggtgggaagactgcttgagcccagaagttggagaccagcctggcaacatagcaagatcccatctcaaaaaaaaaaaaaaaaaaaaattcatgatacacaccaacaaaaatgtgcccacacactcctcaacaggccattttctaggcgagtacttgttttctggaaataaaatccacacatgtgattgttcagcctgtagtcaccattttttggtgcactttacacatatccatctatacactcagctcgacacttctgtcatagcctttctttccccagtcccggagtcctcaaaggaaaaactgtcaatctcctgttatctaagggaacatacctgtagagtatactttattttcctctatcttttaaaaccttaaacagaatactgagaacctcagtctgaagtgctgacatttctcctatagtttaagttgcatccatcaggattgatccatcagagaacacacacatctggtcaccgttgatgcaaaaacaatcgcaaaggcacttccggtttccactccagcacgtctaagagcttagaggtcgtcactcccttataataagaaaaagctaaacaaatggaaacaagctaaaataagaaacagtaattctgagacgcatgacaggactaagctcacagggtgaagatgtaccctgaaaaccagacggacaggctgacgcagagactcacagttcacagggagcagagaccaatgctggggccattcctggcagaaactcttacaccgcagtggaagaactgctgggggcttggcatggaggagtctgagagttgcaaacttcagggggtcagtctttgcgggcggtccccacactttcatgagttttacgtctaggagtcccaccacattctcaaggggaggttggataagcttcccctgaggcttctggtagagggggtgggaggtaaacattctgaaatatgcccagagctttgttctgttccagttatgttctctgtacggaaggccgggcctcaagggaatctgctgtaataaagccttatctgaccagggaaagggcgacttgctaactccagccccctccagtcttcctgtctcaagtaaagggatttaaaaaaaaaaagactcagaaactcttccaaaaggcatcccaggaactctggcctatcaccccacacccatccaaacacagggatttaaacataagaggaagattcttcccctccccagtacttggccaccaagttatccatcaacagggctccgggataatatctgtggattacagcacagagccgtaagtaagacacaggcttcatttagaagaattttcttgggaaaaccaaagacaacagcagcgagaaaaaacaaggacatcagaggaaaaccaaagcctctgactccgttacaaatacagcttcctctatcgttaaatccatgctaactcctagccagataaacataaatcctcacactaaaggctcatctacctcagttcctattatctgacacgtcatgttcagcttctaaaagcagcaaacattacaggcatgctaagaaaaaaaaccagattcagatgtggtagagaatctggaattatcagacagagaactaaccaccaccatgactaatatgctgagggttctactgggaaaaagtgggcaacgtgcaagaagagatgggtaatggaagcagagagatgatgtgttagtccgttttgtgttgcttataaagaacacccgagactgggtaattcattaataaaggaggtttaggccaggcgtggtggctcacacctgtaatgccagcactttgggagaccgaggcgggcggatcatctgaggtcaggagttctagaccagctggaccaacatgatgaaaccctgtctctactaaaaacacaaaattagccgggcgtggtggcgcacgcctgtaatcccagctactcgggaggctgaggcaaaagaatcgcttgaaccctgtaggcggaggttgcagtgagccgagatcacaccattgcattccagcctgggtgacagagcaaaactgtttcaaaaaaataataataaaaataaaaaataaaggaggtttatttggctctgggttctgcgtggtaccagcatctgcttggcttctggcgagccctcaggaaacttctactcatagcagaaggcaacgtgggcacaggcatgtcacatggtgtgagagggagcaagggagtgggaggggtgccctctctgttaagcaagcagatcttatgtggactaatagagtgagaactcacttattactgcaaggagggcaccaagcctttcacgaggaatctgcccccatgacacaaatacctcccactaggcccccacctccaatagtgggggtcacatttcaacataaaattgggagggggctgatatccaaactatatcaaatagaaactcaaagattcaaaaagaaatactagaaatcaaaaacactgaaatgaagaaacaaagaatgcctttgataagttcaccagcagactggacacgaccaagggaagaatgaatgagcttgaagatacgtcaacataaacttccgaaactgaaatgcaaggagaataaagaacaaaaaatgaaacagaatatccaagaactgcgggaaaattacaaaaggtataaatagccacaatggaaataccaggagaaaaagagagaagggaacaaaaacaataaaaactgatgtaataatatgagaatcttccaaagttactggcagacaccaaaccacagacccaaaaagctcagagaacacaggacaggataaatactagaaaatctgcaccttggtatacatattcaaactgtagactagcaaaaagaaaaatctttttttttttttttttttggagacagactttcactcttgtcgtccaggctggagtgcaatggcgtgatctcggctcaccgtgacctccgcctcccgagttcaagcgattctcctgcctcagcctcccgagtagctgggattacaggcatgcaccaccacacccagctaatttcgtatttttagtagagatggggtttcaccatgttggccagactgtgtttcgaaatcctgacctcaggtgatccacctgcctcagcttcccaaagtgctgggattacaggtgtgagtcaccatgcctagccaagaaaaatcttaaaagccagaggaaaagaacaccttgcttctagaggaacaatgataagaatgacatcagacttctatttacaaaccatgcaagcaagaagagagtggagtaaaatacttaagtgttggaagaaaaaattcaccaacatagaattcttcagtaaaatcatccttcaaaagtgaagaagagataaagacattctcagacaaacaaaaactgaggggattggttaccagtaggtctgacttgggaaaagatgttaaaagaagttcttcagagacaaaaatcacataggtcggaactttggatctacataaagaaaggaacagggctgggcgcagtggctcacacctgtaattccagcacttttgggaggctgaggcgggtggatcacttgaggccaggagttagagaccagcctggccaacatggtggaactctgtctctaccaaaaatataaaaattagccgggtgtggtggcgcacacctgtaatcccagctactcgggaggctgaggcaggagaattgcttgaattcaggaggcagaggttgcagtgacccgagatcgctccactgcactccagcctgggtgacagaacaagactccatctcaaaaaaaaaaaaaaaaaaaaaaaaaaaaaagacaacattctagatatttaatgtcaccttttcagtgaggtacaatctagtcttccaatacctaaggtagtacttagtaaagatgtctcctctaaaaagtataacaaagtatacaggcctggcgcagtggctcacaccagtaatcctagcactttgggaggccaaggcaggcgaatcacaacgtcaggagttcgagaccaggctggccaacaaggtgaaaccccatccctactaaaaatacaaaaaattagctgggcctagtggtgggcacctgtaatcctagctactcaggaggctaaggcaagagaatcacttgaacctgggaggcagaggttgcagtgagccgagatcacgccgctgcactccagcctgggttacagaatgagacttcgtccccaaaaaaaaaaaaaaaaaaaaaagttagctggcatctctcctcagttgacaacctccagaagccccatctgcacccggggttaagaggtagagcccttgccaggactctcaaagccctacgcgacccagcctcatgccttctgtctgcagacctcatcctcgcctgcccctcagccacactggcttacatgtgtgacccaagcccactaaagcctcagggcctttgcacttgccagctcccactagaatgttctccccagacacctgcctgatgagttccccgcagtgcacgtccctgaccaccctacctaaaacagctgcatcccaccccttctatcactcagtggccccttgccttattactacctggatattagacttgtttatctgtccaccccactagaatgttagttccctgatggcagggacttctgtttcattgatttatccccagcaactagaacaatgcctacgagacaggagatgttcatttaaatgagcacactgggccaggtgcggtggctcacacctataatcccagcactttgggaggccgaggcaggcggatcacctgaggtcaggagttcaagaccagcctggccaacttggtgaaacctcacctctactaaaaatacaaaaaattagctgggcgtggtggtgggcgcctgtaatcccagttactcaggatgtcgaggcaggagaatcacttcaacctgggaggtggaggttacagtgagctgaggtcatggcactgcactccagcctgggcaacagaggaagactctgtctcaaaataaataaataaataaatataaaataaatgagcacactggtatttaaatatcaaagaaaaactactgcaatttcttgattattagacatttggttttatgtcattttcagaataccaagggataactaccccgcccaccctccccaaactaagggacaattttccccacgaaccaagaagaaacaaaccctgtacccaatcccagtactccagtcttcatcttcctccctggctcacggctccacgatggtgccaaggctcatgtgtggaatgttacattttaaaaagcggtgcacaaagtctataggcacagggtttaattatgtaaaaagaggcatttaaaaataataaagttagaaattgagtttgatgtttattaggttcatttctcagtaaaggtatacatttaaaaaacacataaagtatattttaattcccattttaaaatgaaagtacatttctaaacttcccgggggactcataagctattttaaaatgttaatatgaaatgagaaattaggcagaagaataaacatggcctaagattaaaatgtttaatcaaataagaagaaaaagagagatcttagtaggtaacaaatttctatagttataaaaatggaagctactaacagccctgccttcgagtttaaatgcctgagtcacacagatcagcatcagtgcacccaagagttataggaacaggcttactctggagtctaaaagtccagcttcattgtaaagagctcaccatttaatatgcctcttcagtcacctagtaatttttattttacctttgaactcatacttctaaaatattagtcagtttttttttaataactcaaaaccttttagtcctaataataccaattcttatttcaatttgaaacaagaacatacaaacccagaatctgcagcctggcacacaaaataacgaggctcattaaggggtttttgtttttttgagacagagtcttgctccgtcacccaggctggagtgcagtggcacgacctcggctcactgcaacctctgcctcctaggttcgagcaattctgtctcagccttccgagtagctgggactgactataggtgccccccaccacgcccagctactttttgtatttttagtagagatgtggtttcaccatattggtcaggctggtctcgaactcctgacctcaggtgatccgcccgcctcggcctcccaaagtgctgggattacaggcgtgagccaccttgcctggccaagtttttaaaaatttatccctggctgggcgtggtggctcacgcctgtaatcccagcactttgggaggccgaggcaggtggatcacgagatcaggagatcgagaccatcctggctaacatggtgaaatcccgtgtttctctactaaaaatacaaaaaagtagccgggcgtggtggcgggtgcctgtagtctcagccactcagaagtctgaggcaggagaatggtgtgaacccgggaggcggagctggcagtgagccgagatgacgccactgcactccagcctgggtgacagagcaagactccatctcaaaaaaaaaaaaaaaaaaaaaaaaaaatttatctcccatgatcctctccatgagccctaaatcccaggtcaatggaaatatcccatcccttctctctgttcccttctccagaaaagatcaccctttccacttccaacgctgaccatggggatattacatatcataccctgacactcagtttccctccacccccacataggtgggatcatctcttcctatgaaatcctataggctttgtaccattttactctagcattccatcctgtattaaaactatgagtataaatgcacacgtgtgtgtgtatatatttcatcatctcctttactgcgttgcaggtatcttgaaggtggggaccaagtcttattaatgctgtaaataaggaccttgatttcaagaaagcccagataaatctgattcattggattagagcccaatactcttatctgatacactcattcagtcaatcaacaaacatttctaagctcatccttaactatatccgattctcacatccttgcctcaccagaaatttataactgaggcaggcagcagtggcacaggggtggtaactgctgccagctcccccgctgggactcctctccggcagatgcccctgaaggaccaccgggacaccttccctcagcttcagtcccattcttgagacactgcagcggcacagccgttcacagttcctgtccaggttttacagaagggcttgtcccaaggccattttttatactgaaccaaattctggcttcctggatcctccttcaaccagactgaaggaatgatagacagggggtctaaatcctccttaaaaagggaaatcatgtcctttgcagtagcatggatgcagctggaggccagtatcctaagtgaattaacgcaggaacagaaatccaaataccgcatatctcacttataagtgggacctccacattgggtactcgtggacataaagatgggaacaacagacactggggactatgagggggggtgggagagaggggaataagggttaaaaaagtaactattgtgtgctatgctcaccacctgggtgacaggatcagtcatactccaaaccttggcatcacatgatatacccaggtaacaaacccacacatgcaccccccgagtcaaaatataagttgaaagtaaaataaataaatgcataaataggccaggcgtggtgactcacgcctgtaatcccagcactttgggaggccgagacaggcgaatcacttgaggtcaggagttcgagaccagcctggccaacatggtgaaaaacgctgtctctactaaaaatacaaaaattagctgggtgtggtggcggatggctgtagttccagctacttgggaggctgaggcaggagaatcgcctgaacccagaaggcagagcttgcagtgagcagagattgcaccactgcactccagcctgggcaacacagcgagactttgtctcaaaaaaataaaataaaataaatgcataaatatatcattctcttacatgcccagtcttccagtttttgaagactgctttcatgatttgctccctgcataggcatccaacatttaagggtcgcccttaagaaagagaatacaaaactacaaattgaaaatgaagtgccctacaaggttttagaaggggtggagagactggaaaggcctaaggttgagtgccgtgagttttgtggtgaatatttcactatccatggaatcaaggactttgaatttaaaccccagctttgctccttacctgttgtgtgtactccttagctggatgaaattagacaagtcactcaacctaagcttccattttcttgtccataaaatgggaataatctctcttacctgagaggactgctgtgaaaactaaatgagactcctgaatttcgtatttccattaatgctaataaaattcatttactgtgcaaagcgcactgagtcagggccaactaaaactcttcacggggtcacggcgaggttacgaggcagcgcacgtgggaagtgctggaaagtgtgtggcacattgtctgaaagatctctgaccaaccaggacccaattctggttttcagataccattttttttttttttttgaaagagtctcactctgttgcccaggctggagtggaatggtgcaatcttggctcactgaaacctccgcctcctgggttcaagcaattctcctgcctcagtctcccgagtagctgagattacaggcgtgtgccatcacgctcagctaatttttgtatttttagtagagacggggctttgccatttgtccacaatggtcttgaactcctgatctcaagtgatccacccaccttggcctcagataccttcttgtgtgaacagttgaggagaataaggcagcaatcagatgttaatggcattgctgccagactgcctgaatattccagagtgccagaaaacactggtcaaataactgctactcctacaggtttcatagttgggtatgtggccgggcgcggtggctcacgcctgtaatcccagcactttgggaggctgagaagggtggatcacaaggtcaggagttcgagaccagcctggccaacatggtgaaaccccatctctaataaaaagatacaaaaattagctgggcttggtgacgtgcacctgtaatcccagctactcaggaggctaaggtgggagaattgcttgaacccaggaggtggaggttgcagtgagccgagatcacgccactgcactccagcctgggtgacagagcaagactccatctccaaacaaacaaacaaacaaatatgtacagctagcctcttgagttattacaatgcctattttactgattttagtatgaattcattaggataccccatattggcatacttaactctttttagtggtataatatacaaaagtttaccaagggtaacattagtacattcacaatattgtgcaaccatcaccactacccagttcacaatcatcttcgttaccttaagagatgccgttaggcggggcatggtggctcacgcttgtaatcccagcactttgggaggccgaggcgggtggatcacgaggtcaggagatcgagaccacggtgaaaacccgtctctactaaaaatacaaaaaaaattagccgggcgcggtggcgggcgcctgtggtcccagctactcagaaggctgaggcaggagaatggcgtgaacctgggaggcggagcttgcagtgagccgagattgcgccactgcactccagcctgggccacagagcaagactccgtcttaaaaaaaaaaaaaaaaaaagacatgccgttaagcagccattccccattcccctttctcgcatgaagcctcaaaatctgccttctcccttgaagcctcaaaatctgctttctatgtggatttgctgatgctgggcatttcatataaacaaaatcatacaataaatagcctttttatctggcttctttgacgtggcacataaccaaggttcacccgtattgcagcatatagcggtacttcattctttttcgtgggtaaataatattccattttgtttttccacttatcagcaggtggacatctgggctgcctccaccttttggctattgtgagttgtgctgctctgaacatttgtggtcaagactatgtgtgggtcaggtgtggtggctcatgcctttaatcccagcactttgggaggctgaggtgggcggatcacctgaggtcaggagtgtgagaccagcctgaccaacatggagaaacaccgtctctactaaaaatacaaaattagctgagtgtggtagcgcatgcctataattccagctacttgggaggctgaggcaggagaatcgcttgaacccaggaggcagaggttgaggtgaggtgagactgtaccattgcactccagcctggccaacagagcaagactctgtctttaaaaaaaaaaaaaaaaaaagactttgtgtgggcatatgtttcatttcccttgggttggtgtctagaatggaatccttggtcatacggtaattctatgcttgagttttaaggaactggcagacagctccaatgtggctgctccattttacatgcccaccagcaatggtcaagggttccaatttctctgcatctttgccaacacttgttattgtctgactttttaattgtggccactctattgggtgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctcttcagcctgtcacgggagctacgccctttgctgctacctgtgcgtgtgaccgcagcagctctttcttggcatgctctcaaccccactccccaatttgggtgtcataacctagtgttttcgttcctgacccttcactgcaggcccagcatggtgctgtgaaaaagttagaaatccacacctatttgtaagaggatgtaagtagcgcttgtgaacaaggatggtgatgatggcagaggcacagccccaggtcctttgcgccaccccccctcgccatgacaggccaattatccggcccagttgttgcagctccttggccagcggtcctttggctgtggctgacagcgtgaggacagggacacttacgctgtctccatcttgagttactaggacacacaatatacttcaaggagaaaaagaccaatttgagtaactgtgaaaactgggtttaaacaattttctgttcaaacacttaaaaatccaaagatttaagagaacgggcaaacataataaagttacaatgaaaaacaggaaatgacgtttcaggttgacacttaggatgtgcccagtgagcaatctggaagcatgaagtgtgaaatggctaatctgattcaatgattcagcttctacataagtaatatttatttctttatttttttgagacagagtcttgccttgtcgcccaggctggaatgcagtggcccaatctcggctcactgcaagctctgcctcccgggttcacgccattctcttgcctcagcctcctgagtagctgggactacaggcgcccgccaccactcccggctaattttttgtatatttagtagagacggggtttcactgtgttagccaggatggtctcgatctcctggcctcgtgatccacccgcctcggcctcccaaagtgctgtgattacaggcatgagccaccacgcccggctatgtaagtaatatttactaattatagtacattgagtatatatatactcacttcaaagctgagagaaggaatgttcttcttgtaacaacttttgtaaacaagtacaatttataacacagaacatcttcctaaactttaggaatgtacacatacttacaccaatgcgcctacacgacacatggacttccacagtacatgctcttacaggtttttttttttttttgcaggggacagagtttcactctgtcactcaggctggagagcaatggtgtgacctcagctcacctccgcctcctgggttcaagcgattctcctgcctcagcctcccgagtagctgggattacaggtgcctgccaccaggcccagctaattggttttttttttttttttgtctcttacaggttttataaattataaccctacctttctaattattctagctgagacctttcctgttccaaaagggagaagaaagaacatccacccaaaaattgagatgagaaaagccaccttcaaggtctaaaggcatttatcatgtgcttgcttccaggaaaaaaattattttccaaaccccaaactgaaaatactcaagaaaaaaagctggaataatgatcgcattataaatgcttctaagtaaaaccagcaaaattgtgattacagctgagaaaaatccaacaaaatacagactcatactcacatggttagtcagcatggaccatatgatggtttgcaatttaacacaatcctttattttgctgaactctaattggcaggaaaatctgacagccataaagtaaagccgttagaaaagcacagtccaggtgcagtggctcatgtctgtaatcttagcactctgggaggctgaggtgggaggactgcttcagcccaggagttcgagaccagcctgggcaacacagaaagacccccatctctaaaaaaaattttttattttttaaaaaagcacatcttttggacatatagaaaattaagttggcagactaggtcatatacctggtaggtagcctggggtccaatgaaccagccactgaccagatacgcgacctcagcaagttactgcctttgtacctcagtctcctcatctataaaacggaaataacaagcatgggcctcacagtgctgtcatgatgattataggagttaatattacatttataatgtgcttagaactgtgcctggcatatagcaggtacagtgttcagtaaataaaatctcctcttgtttctttgctatttttgtggaagaattttaatctctttaaagtgagtctaacctgtaactaaaagataagtgattttggtcaattataactgctgtggctcagctcagctctttccctactgtggtatgaattcttttatccagatcttaggaatatatttgtaatattgttgtgaattagtaacatttcaaaaatgtttcagaaatttttttctgatttttttttttttttttttttttttataaagacagagtcttgctctgtcatccaggctggagtgcagtggtgtaatcatggctcactgcaacctccgcctcccaggttcaaatgattctcatgcctcagcctcccaagtagctgggattacaggtgtacgccaccatgcccagctaacttttgtatttttagtagagatggggttttgccatgttggcctagctggtctcaaactcctggcctcaggtccacccacctcggcctcccaaagtgctaggattacaggtgtgagccactgcacccaggctgagccaccgttcctggcttctgctctaatttttagaccaaagactgtcagattggattctgagtatcagcaagacaaatctataatgtagtttttaaaaattgcatgatccataagcattctatcaatgattaaaggaaatctatgattttctaggttccctgatagtgaggagataaaatattctgttttgtgcccaatttcagaaactggcccaaacaataaatgattcaaaatgcaatggctgactaaactacaacaaaataacatagcctaaatttacataatggtgagctctaaaaagctcaaagcaaatttataaactccccaaagaaagtcttatttcctgagaagtcaatgagaacatcctttatttttctctgctttaaggatgaaaaaactgactcaaaggttcttctaaagattttggcaaaacattttccccttaccatttctgttttccctttcaccttttcaatattttctgagttataaaaataaaccttgcttgatttaggaacaaaactggaagtttatgaaaatgtcagattccttttttaaatgggcactgctgggtagctgtgctgccttgaactgaactgtgtacaggtaatgaaggattaacctttatcacgtgtgataaaggatttaactttatcacacgtgataaagtcacatgagtgactttaggtacacccactgacaatctgttgagtggcatgaatttgaccccatgacctattatttaacaattaaacagtgggagcggccaggcgcagtagctcacgcctgtaatcctagcactttgggaggctgaggtgggtggaacacttgaggtcaggagttcgagaccagcctggccaacatggtgaaaccctgtctctactggaaaaaaaaaatacacacacacacacacacacacacacacacacacacacagacacacacacacactagctgggtgtggtggcaggcgccagtagtcccagctacttgggaggctgacgtgggagaattgcttgagcccaggaggtggagcttgcagtgagccaagatcacgccactgcactccagcctgggcaacagagccagactctgtctcaaaataaataaataaataaaaataaacagttggattaaaatatgttactggccaaaccctgactactgatctctggatttgggttgacggtttgtttgctctgcccaacaagacgaagaggttaggacttgagtatcccatgctactgtggttgttaggattatgtcgttaatgcaccttaaatccagacacttagctagctggtagtaaagaagtgctttttctttggagaaaaggataccaaatccctcacaagattatcccaattgaagcaagcaactgtatgacacaagagatcttctactgtctgggtaagggccaaattgcaaaaactttaggccttgtgggccaaacgtctctgctgcagccactcagccctgctactgtatcctgaatgtaaccccagacaggaacaaatgggcacagctgtgttccaataaaactttcctggccggcacaaaggctcacgcctgtaatcccagcactttgggaggccgaggcggacggatcatgaggtcaagagatcgagaccatcctggccaatatggtgaaaccccatctctactaaaaatacaaaaaaatcagctgggtgtggtgggtacctgtagtcccagctatagggaggctgaggcaagagaatcacttgaacccggtaggtggaggttgcagtgagctgagatcgcgccactggcactccagcctgacgacagagcaagactccgttccaaaaaacaaacaaacaactttctttacaagcaggccctggtcatccctggctgtagtttgctcacccctgcagttaaggtacatctggtaaaggtgatattttagcaaaatgaaattgaaaggtttcaaattatatgttaactcttatcttcaagtcattgagaacattcagcatgaaaacaactagaatttggtatttctctttaaatcatcaatatttttctatcactttcaaatatacttgaagaaagagcaaggacacattttctgaatcatctatctaatagaatagattctattcataaaggaccttttattttaaggaggaaaatcaagaaatgagttctctggtgggggtaaaatgtaggtctgacagatttgccgatcatttaaatccatcattatttcctaaattttagatactaacttgcaaattttgcatatgtatattaaagtgtatcttcttcctaagaagtaggctgggcgttgtggctcacgcctgtaatccagcactttgggaggccgaggtgggcggatcacctgaggtcaggagtttgagaccagcctgaccaacatggtgaaaccccgtctctactaaaaatgcaaaaaattagccaggcgtggtggcacatgcctgtaatcccagctacttgggaggctgaggcaggagaatcacttgaactcgggaggcggaggttgcagtgagctgagatcgcgccattgtactccagcctaggcaacaagagcgaaactctgtctcaaaaaaagaaaaacaagtgaactatattatttttcagagactcagagaggctctcccattgcttggcatttctacttttcatttcctggtgatttccaatggcaaaacttttacatcttccatgaggctgaggcaggagggctgcttgagcccaggagttcaagaccagcctaggcaacatagcgagaccctgtctttaaagacacaaaaaaatttacatccgcaataaagaggacaaccagcctaacatggaagagaacaataagaggacttgacaaaacccttacagaaagaatccttcatgaacggccatcaagagatacaataaaaacacctagcagaatttgactctcaagaacttcaagcaacggaactgctttataaatgacaaaagtcaatttgcaaactcaataataaaaaaaaacataatttaaaatgggcaaaggatctgaacagacatttctccaaagaagatatgcaaatggtcagtaagaacatgaaaagatggctgggcacggtggctcacgcctgtaatcccagcactctgggaggccgaggcgggtggatcacctgaggtaaggagtttgagacgagcctgaccagtatcgtgaaaccccatctttactaaaaatacaaaaattagctgggtgtggtgggggggtactgtagtcccagctactcgggaggctgagggacgagaatcgcttcaacctgggaggcagagattgcagtgagccgagatcgcaccactgcactccagcctaaaagtcaatttgcaaactcaataattaaaaaaaattaatttaaaatggtcaaaggatctgaatatacatttctccaaagaagatatgcaaatggctagtaagaacatgaaaagatgctcaatgtcgttagtcactagggagatgtgaacgaaagccaaaatgagagcccacttcacactacaggatgtgtaaaatcatttataggatggctatactaaaaaaaaaaaagagacaataacaagtgttaaagatgtacagcaaatgaatggttggatacggttggagttaaatgggaagcaactgctaatgggtgagggtttctttttgcggtgatgaaaatatcctaaagttaattgtggtgataatcacacaactttgtgaatatactaaaaaccagtgaactgtatactttaaatgggtaaactgtatctcaagctgctataaaaataaatacaacaaaaaattaatttgcagatttcagaaaagaactaaataggacttccagtaacgaaagacaggcactaaacaattcaatggaaccagcagttaggaaataaaaatttaaaaataccatttacaataggacaaaacacataaagaatgagtctataaaaaaggaggagacttccacaataaaaaatacaaagtagtgctacagaaacgaaagaaatctcaaataaatgaaagcatctaccattttcatggattagaaaatccaatattgctaagatgtcaactccacctaaatccacccgtaaattcaatgtattccaatcaaaattccaagtgaattttttaaagtggaaattgacaagctgattctaagatataaacaaatgcagaggtcctagaatatccaaggtactctcaaataaacacaaagctagaggacttatgcgactagataccaagattagacagttgcagtaattaagacagtctgctattggtgcaaggacagcagagcatccccacagacagccgagtgtgtagctgcgttgcctccttgtctcccagtgataacccaggcgatgttacaaaaatgagtaactacaagagaaactgctaacaaaactgaagacacagaaatgaaatgggaaaagtagcaacactgagtcaaacgtagatggaattagagaagaaacagctgactggaaatgctgacactgttggcctttgtggcactggatgaacggccacaggaactgagtgaggccaaaacttaccaacataattgagccaagtggctgtgatgaaaaggatgaagatgtttcagggaaagcgatgccagcaaaacaacaacaacaacaacaacaacaacaaaacaaaacaaaacttcaccttaaaggaactcttgaagatacttcacaacattgtaattgcaaggatgaaatgttggaagctgatccaaatttggcaaggagtatggcaatttgctaaagcatagaaaagatgctcgccctatcctaagccatgagaaggtggtaagccctatttacaccactcctggtaggatttttacaaataaaaactctaattcccaatgtttctaatgctttaaagtgtacaaatattagttttactattttttaatttccctatacatttataactgacagtgagtgcgtttttaacaaacatttttaaaggtcatagaacaacgtaattttgcagtatcaaaatgactttgtgtggtttcagcttgcacatttttatgatgccattaccatgcaaaacagggctgcctgtttttaaaattagtgagttaaatgtaccacttaagaaattagaaaggccaggcgcagtggctcacgcctgtaatcccagcactttgggaggccgaggtgggtggatcaagaggtcaggagatcgagaccatcctggctaacatggtgaaaacccgcctctactaaaaatacaaaaaattagccgggcgccgtggcaggcgcctgtagtcccagctactcgggaggctgaggcaggagaatggtgtgaacccgggaagcggagcgtgcagtgagccaagatcgcgccactgcactctgtctgcccgggcgacagagcgaaacaatgtctcaaaaaaaaaaagaaattagaaaaagagcagccataagaaaggatgagttcatgtcctttgcagggacatggatgaagctggaaaccatcattctcaggaaactaacacagaacagaaaaccaaacaccgcatgttctcactcctaagtaggagctgaacaatgagaacatggacatagggaggggaacatcacacaccggggcctgttgtggggtgggaggctagggaagggatagcattaggagaaatatctaatgtagatgaccggttaatgggtacagcaaaccaccaaggcacgtgtatatctatgtaacaaacctgcacgttcttcacatgtatcccagaacttaaagtataataaaaaaaagaaatgagaaaaagaataaaagagtcatttcaaagatacatgaaagagagtaaaggagagaccaatgaaatagaaaacaaagacacaatggagagacttgaacaactggttcatgaataatcaagaaaaatatatattctggccaggcgcagtggctcacatctgtaatcccagcactttgggaggctgaggtggcctgatcacttgaggtcaagagttcaagaccagcctgggcaacatgacaaaaccccatctctactaaaaatacaaaacttagccgggcatggtggtgggcacctataaccccagctactcaggaggatgcatcacgagaatcgcttgaacccgggaagcagaggttgcagtgagccgagattgcaccactgcacttcagcctgggcaacagagtgagactctgcctccacaaaaaaaaaaaaaaaaagaaagaaagaaaagaaaaatgttatatattcttttattacttactttatgagaagaatgtcaatgaagaaaattgtcactgtttttaaattctgaaatatttgcgaatgtgtgaagtagaaagagagaggcatccttctagtctttgatacagaagccacaaggcacatcatctcatttcatctaatgacctggaaggcgtggctgtcacctccatggtgagtaaataacccactgccgaaggtgaagtgttgcccggggtcacacaagttaacagcaggaatgtggcaacgtcaccactcccgagcatctcttaggtgccaggtggcatgctatccagcagtctcaggggaaagtgagatgtggcctggccttactgtcctgggtcaaaggatctttcccggactcgcctgggcggggtgagctctgcaacccaggcagcacccatgtccctaccatccctggaggggtaaccacccccacagtccatgctctgcctagcttggctgcaaaaccccttgctggggacatgtgacccaatgtggttgcccatggaggttatctcttaggcccatgtagaaaaaggtgacagctacgtttacccttagggcctatcagccaccctgaggaaaaacactgcactctgcaacccctgaggaagaagtcacccaggaggctactgaggatgaaatgagacaacagaagtgcccggcacgcggtggacacatccggagacccgtgtttctgtatggaagcacgtggcgcaagggcagggaaatacttctaagacggcacaagagcggagcaatacttctaagaagagccacgcccacgctacgcctctgtgatttccactatccttaccccgtaactcctggcgtttatggttggaaccccagtgaaaccaccatttccaaggggactgtgaccgctaatcatgacacctgccagccattcagacactaacgataacctctcatccccttcttgaaaagtcccctgtcagcctgggtgcagtggttcacacctgtaatcccagcactttgggaggccgaggcaggtggattaccttaagtcaggagttcaagactagcctggccagcatggtgaaaccccatctctactacaaaaaaaaaaaatacggccggggatggtggctcacgcctgtaatcccagcactttgggaggccgatgggaagtttttgtttgtttgtttgttttctgacatggagtctcacctcagggcggatcacctgaggttgggagttcgagaccagcctgaccaacatggagaaaccccatctctactgaaagtacaaaaattagccaggcatggtggcgcatgcctgtaatcccagctactcgggagactaaggcaggagaatcgccaggcatggtggtgtatgcatatgtcccatctacaagggaggctgaggtaggaggatggcttgagcccagaagatcgaggctgcaatgagccatgatggcacagcccgggtttcaaggtaagaccctgcctcaaaaaggggggaaaaaaaaaaagaacatactgactggaaaacaaggctagaaagaaagacaaggatgataaagcgtctgccttagagtgctcacatctcgggtgatggtttttaattttctctattccccctgttttcaaccacgagtcagtggctgctgaccagaccattcaggtaccttggcagcgagaaagatgagcaggggaaatgcaccagagtccatggttacaagatatccaaaggcttaaaaaaaaaaacaaaacagcagaaggctgggcacagtggctcatgcctgtaatcccagcactttgggaggctgaggcgggcagatcacgaggtcaagagattgagaccagcctggcaaacatggtgaaacaataccgctcctactaaaaatacaaaaattagctgggcgtggtggtgtgcacctgtagtcgcagctactcaggaggctgaggcaggagaattgcttgaagccgggacacagaggttgcagtgagtcaagatcgcgccactgcactccagcctgggcgacagagcgagacttcgtctcaagaacaaaaacaaaaataaaaaaacaaaaccagcagaaaaaacctacagctaccctaaggccccctaccccacagcccctatttcttcctctgtgcttagatctccccttcccaaatagaaacagactggaaaggatggctgtggtcttctgggggaaaaaagtgggagggccctggaaaaacagcaattatgaagtttttgtttgtttttttttgagatggagtctcactctgttgcccaggctggactgtagtggagcgatcttggctcactgcaaactctgcctcccgggttcaagtgattctcctgtatcagcctctcaagtagctggaattacaggcatgcgccaccatgcctggctaattttttggtattttttttagtacagacaggtttcaccatgttggccaggctaggctcgaactcctgacctcgggtgatccgcccgccttggccttccaaagtgctgggattacaggcctgagccactgtacccggccacaattatgaagtctgaagtatatgcatgctggtaaaaccacacaccagcccacgagggagaaaaacatcactccactcagacacacaaaaaacgcggaagcaccatgtacacccagagcaccgctaacatttctatcagtcctgccctttcactgaaagttgttgaaaacagacctttaataccagagatgccgacgtgggggctgtcaccaggccatctcctaacagccacatcctctctgacctggtgttccttggctcatgcctggggagctttgctagcagctgggtcctgggagtgtgatctaaattgggccgtggggtataaggggctgtgtgctggagctttggggcaaaggttgtcagcacacctgagaagaaattccccttcctgcctttggagacaatggggagagagaggatgtgatggttggagaggcagtggcagccatcctggcaccatgaggaaatgagtatgaggatgagaagacagagagaaggaacctgggtccctagtgatgataaactgacaacctgctgctcctcatgtggaataataaagatgctgattgcttaactcactgttcattgggtattttattttttacttttaggcaaaagcatcctacattattcacacagcagtgagtgagccgatgccaggagagagctaagtgtaagtatccactgctagacatcagaaatggcaccgctgtcacagaggccgaccctcgaggcgcacagaatgaacgttttgaaatgattcatgattttcatgtatgtgataacaccccttcgagttttctcatatgagagttataaagtttcatgatgaagttgtgaataccaaataccaaaacggagtaactagacaataaaatcttcttggaagatgagaaaaatacaatctatctttggtctttttttttttctatgaattgtccatgactcttccatacagggaatttaaacagatacggggtgcctttttagtctgaactgtatcaataaaagaaaaatggagccagtcaaggaagtaactcctcctgagatagcattgtaccatggaattgttcgaaacgagaagaaaaaccagtaactacatgagatagcaagtattaagcaaaaggacagcttgaaactaaataaaacagaaagttatttctgttccctctgaataaaatacatacgcacaagtggctgggcacggtggcacacacctgtaatcctagcattttgagaggcgtaggcgggtgggtcacccgaggtcaggagtttgagaccagcctggccaagatggtgaaaccatgtgtctactaaaaatatgaaaattagccgggtatggtggtgggcacctgtaatcccagttgctcagaaggctgaggcatgagaattgcttgaaccctggaggcagaggctgcagggagccaagatcacgccactgcactccagcctaggtgatggagtgaggttccgtctcaaaaaaacaaaaacaaaaaataccccatagatatatacatgcacatgaaagaaatttcaccatcacaaaatactttcctcactgaaatgaaagttctaagcctgtgttgtttataccaacatcgttgctgtggaaatagctgtttcaacattaggaactcacgactgactcaagtaaggtgtggagcagaagtcttatttaaacagtggcaggacccataaaacattaaaaaggcaaactgggtgtggtgagtcagagcaccatatgttttaatgtaagggtcacacatgttttctttctgatgcatgacaccaataggatgtttctttttattcatgctatttttggaaccctataatcatctcaacgactcccccaaatatcctaggttttgctgtctgcttctgtctacatccggcagcctccgtattttattaaattcattgtgcttagaacagagttactacagttcagtcctcgctggcacatgcaggattatggcaccaaccagggcacaagcaggattttggaaaacttctgcatgtaactgagtctattaaatatagcagtactgggctgggtgaggccagtcatcctagcactttgagaggccaaggcagggggaatcctagaggccaagagttcaagaccaacctggccaacacagagagaccccctaaaatatatataaatatataaatatatttatatatttatatatatacacatatatttatattatgtatattataaatatacataatatatatattataaatatatttatattatatataaatatatatacatacatatttatattataaatatacatatttacattataaatacacatatatttatattataaatacacatatatttataaatatacatatatttatattataaatatatgtatattaatattataaatacatatatatttatatatgtatattatatgtatatttataatatacatatatttatatatgtatattatatatatttttatatatataaataatattatggctgggcgcggtggctcacacctgtaatctcagtactttggtaggctgaggcaggaggatcacctgaggtcaggagttcgagatcagcctggccaacatggcgaaaccccgtctctactaaaaatacaaaaaaattagccaggcgtggtggcgggcatctgtagtctcagctacttaggaggctgaggcaggagaattgcttgaacctgggcagcagaggttgcagtgagccgagatcgtgccactgcactccagcctgggtgacagagcaagactctgtctcaataaaataaaataaaataaaataaaataaaataaaataaaataaaaaattaaaaaatacatagatcgctttctcgcagtactgacttattcactaacaaggcatcacttccagcatatggtctaccgtgtgcctatggctttatacggagactgtgaggacccagatcgcctctgcacccaacagcccagctcctcaactccactgtcaggcctctcatttgtccctgtcttttatgggtcagttaagagcttcccaaacaatcctaaaaaccctcaggccaaccccatcgagaaaccatgtgacttgcccgcaccttcccttggtgatgcccccactcctctgcttccccttcctacttcttaactggacatggatgcacttttctttaaatacgcacacactttaccatgattttcctccggttaagccagaaattttaccctttgtacaataaaacatattcaacaagttttttaaatgagagtgctgtgtggggccgttttaaaagcccacctttccctaacccccgacagtgaagtgttctataaacagaagcccagatcccctcggcagcgggcactgcccagggtgtaaccgccctctctgcctgcacaggagagcgattcataccagcagaaccggaaaaatcacagctgaaagcaaccagggaagaggcaagggccaagagagcaatgtaaaggagtcggattttctactaggtgagtcacaggaaacactctggccacagcccgaggccccaggaggcccggctcgcccatcaggaatgtaggtcaaactcccagcgggaagggtgagagcccaggcacccagggcaaaagctcaagttcctaggagaacagggaggctggccagaaaacaaggcctccactcgccctccggcaccagtcccagcccaccctacgactaagcatcaatttccacagaccgcggtgaagtagaaccacagcatgctggcccagatctctcctctgttctggactgggccatcccacgcgtttctcttggggttcacaggatgacaagtggggtttatgtataaagggacagatcgctcacccagttcagttgacacgggggacccagtggcaatctcaccgatcttggccactccatcgtagtaggcttttcctgccaggatcatagctagacacaaaaggtgacacacaaaatcgtcacttagacaaggaaaggaggaagcaacacaagttttcttccaaacaccccctggtcccttctggctgcaggaaggtttgggctgtggcaggtgtggctctcaggaggtaagacctgtgttgagagtggtgccggggtggaggccctccagccaagggacagccccatgagatcctcgtctctgaccagccccggggaaccttcagcagcaggtgctgaaagtccagagaaggctcagcttgctcctgatgccagtttcagagtggatgcgttcctaacgttgaactagggctttgcctgggcacggtggctcacacctgtaatcccagccctttgggaggctgaggtgggaggagtttgagaccagcctgggcaacatggtaaaaccccgcctctacaaaaaaaaaaaaaaatacataaattagccaggcatggtggagtgtgcctgcagtcccagctacttgggaggctgaggtgagaggatcgcttgagcccaggaggcggaggttgcaagtgagccgagatcatgacactgcattctactctgggtgacacagccagatattgtctcaaaaataaatataaaaaaagaagatacatcctctccagccagaaatcttttctgagctagttcttctccagcactccaggtctgcaacattcttagttaggagttgtgtgaggtggactaggagcctggtcctttgatggcagtgcttaatttttctattgaaaaaggcattttgagccacaaccaaccaacctatttgttgccaggagagaatatatgaaatttgaaatatattatcattccaaaaagcaacacaattgtctgaaaaaataactgaatgctctactttttcttttttggcaaagacaagaaaacttttattgctacaaggtgggttctaattatcttaaaaatagtactgcccccttcgaactgattctgaagactaaattataactatgtaacctccaggggcaaattacttaccctttctgaaacaaaggttgctcatccttaaaatgccctaagaatgtgagtgacagatgaacaaatggaagctgctaatacacttttttcactttacaatctaggtttgagggtattgaagatgtatgatagagacccagcctggttagtgtaattttggagaaaagcatttatttggaattttactctaagattggtttcagacatagaaatcagtttctcctggagctttggagaccacacagttttggagctaaaagagccctcgggaatcccagaggctataccagctgcaatgccgcaatgtataatgggcaattgttttaacaaggtggattttattttattttatttttttagaggcagagtcttgttctttcacccaggctggagtgcagtggcaagatcatggctcactgcagccttgacctcctgggctcaaaggatccttctgcctcagcctcccaagtagctgggactacaggcacgtgccaccattcctggctaattaaaaaaaaaaaaaaaaaaaaaattgaaggggctgggtgcagtggcttacacctgtactcctagcattttgcgaggctgaggtaggaggatcacttgagcccaagagtttgagaccagcctgggcaacataaggagacccccccatatctctactgaaaacaaacaaaaaaaactagccaggcatggtggtggtggcacacgcctatagtagtcccagctactcaggaagctaaggtgggagaattgcgtgagcccagaaggtcaagactgcagtgaaccacaactgtaccactgtactccagcgtgggcaagagtgaggcccctgtctcaaaaaaaaaaaaaaaaaaaaaaaaaaatatatatatatatatatatatatatatatttttttttttttttttttaagagtaggggtctcactctgttgcccaggctggtcttgaactcctgggttcaagggatcctcttgcctgagtcacccaaagtgtttggattatagttgtgagccacagaattaattcatgtgcaggtccagctgaaggtatgaaaagccaaaacagtagtatattttttctggcacattaatctactttaggatttattgtagagttaaaaatttatagccaggtgctgtggctcacacctgtgatcccagtactttgggaggctgaggcaggaggatcacgaggtcaagagattaagaccgtcctggccaacatggtgaaatcccgtctccactaaaaatacaaaaattagccgggcatggtggcacatgcttgtaatcccagctattcgggaggctgaggcaggagaatcgcttgaactcgggaggcagaggttacagtgagctgagattgcgccactgcactccagcctggcgacaaagtgagactcagtctcaaaaaaaaaaaaaaaaagtacatatatatttatatatatataaaagttatggtttttaccatatacatatccaactttaggaaatgcaatattctatctactgcactattataagactcagaacaaccttaaagtgtaaatgtaaaaagaacaatagcaattagcatttatatacatacttagttaatctatccaattatgttgagacacagtccgtaatgtcatcagcccgttgcgctaagggcagcggagtggagatattctgggacatacccaaggtcaatgttgagtcagcgggaaggcacacagctctggctgggcacttcacttcctcagctctaaattatggtgctttctgattctttggtctcgtctagaactaagaaagaagtgactccacctaaaaacaaggtgtgtagccaggaaactgtcaagttgtaagatggaacatcttagtatgaagatgttaagttgtaaagtactgatcatctgaaaagcaaattagtgcgggaatggaatgcaggattacacaatatttaagcaaaatgtttggtttgcatccacacatgaaatcacaatttttcattaattgttgacttacattgaaaaccatgtaaccttctcggtcttgtaaaatatctttgctatgatgataaagttaaattaacttgaaaattataaaatttagccagaagagataaataatactttcataattttgcctcccttttgtgagcacattaagatattttctactacttattgttttaaggaaagaagcatattagttttttgtttttttttttttaagagtcagcgtctcactctgttgcccacactggagtgcagtggtgtgatcatagctcactgcagcctccacctcctggactcaagccatcctcccacctcagcctcctgagtaactgggactacaggtgcacgccaccacacctagctaattttttattttttctagaaatagggtctcactatgttgcccaggctggtcttgaactcctgggctcaagcgatcctcccacctcagcctcccaaagtgctggcattacaggcataagccaccatacctagcatagttctattttagtggttggccaactacttcatcagtctagaccaatctatgtacttctacttgataatttttccttaaaatatggtttcattgggtgaacattctgctcaaagcctttggtgtcctcccactgcccatgaggtaaggtcacacaccccagagcccgtagtagatttttacagtaatggccttccaggaatcacacctcccggaattcccagcgtatgtggtcccctaccaggtggtgtggccatgggacctgctttgacccacgggttatcagcaagcatgactcctgcagggacttgagaggtgctgggcactggggcttatactcttaggacaccactgctactgagtgaggacagagtctggcctccttgaaggggaaagaccccattgcagggctgcatccagcccacagccccacacgggccgcagaagactgcaggtgcaggagtgagcccggagggtctggagaactgccctgccttataggagaaataagaaactgttgctattcaagtgcacagtgatctgaccctatcccgcccacgccccagcagtgtgccacccatgccagtgtggaccccaggtcctggcttacttgctgtcttttttttttttttttttgagacagagtcttgctctgtcactaggctggagtgcaatggcacgatctctgctcactgcaacctttacctcccgggttcaagtgattctcctgcctcagcctcctgagtaggtgggattacaggcacccgccaccacgcctggctaatttttgtatctttagcagagacggggtttcaccatgttggccagcctggtctcaatctcttgacctcgtgatccgcccgcttcggcctcccagtgtgctgggattacaggcgtgagccatcgcgcccggccgacttgctgtcttttatgcgtgcagtagtgtctgcctgctgaaacctaacatctggcagatagctcatctcctgcagggcctcctccctgttccaggccacaccaacccacaccactcaaattcttgtgacactggtctgtacaatgctcctagccattcacctgtagacctgggtttttttttttttttttttttttaatttttttgagacagggtcttgctctgtctcctaggctggagtgcagtggtacaatcacagctcattgcagcctcgaacttctggactcaagcaatcctcccaccccaggctcctgataggtaggaccacaggagcatgccaccatgcccagctaatttttttttttttctgaggccgagtctcactctgttgcccaggctggagtgcagtggcatgatcttggctcattgcaacctctgcctcccgggttcaagtgattctcctgcctcagcctcccacgtagttgggatcacaggcacgtgccaccactcccggctaaattttgtatttttagtagagacagggatttaccattttggccaggctggtttcgaacttctgacctcaggtgatctgcccacctcggcctcccaaattgctgagattacaggcgtgaaccaccgcgcctggcctgagctaatttttaaattttttttgtagtgacggggtctcgaattcctgggctaaagctatcctcctgtctcagactcccaaagtgctggaattacaggcacgagccaccacgcccagcctgccttgtgttctaacgtaactgtggactgcacacctggcagcctcaactatttccaaattctcaccaaggactttacacatttacctacatttctcaatggcttcagcaaaggcacaaccagatggcctgcagaaattctggaaataccttctgaagtatttactccccaggaggtgctaaagtgtcaagagccctttggggagaagccttgttagcaggaagctaagctgtaggcagctcactggctcaccttgtaaaactctgcagctcatgctagaaagaaaaaaaaaaaaagaggcagctcatgctagaaagaaaaaaaaactgcaggtcacagtgatttccttcacaaggacatctaaagcaatgactttgtggccttgtgactaagcaatcttcgagggagagtcagcagtgcacagctctggctttctggaggacaggggcacttgcagaagtcacggggaccactggagggcaagggagcaaaatcccagacctgctgcatttcctgctgctgaaatctccgaaagcacagcaaggcagaagagtaaatgagcagtatacttttccagcgactacacacaatggtgctcctcctcacccagagtccacagtctagccagctcacaccctttcctggggcaggttcatgctgagcgagagtgaggccacaggtttattttcaaaatatcaacagggagcaaccagtatggcaaaaaagataagaggctgggtgtggtggcttaagtttataatcctagcactttgggaggctgaggggagtggattacctgaggtcaggagttcgagaccagcctggccaacatggtgaaaccccatctctactaaaaatacaaaaattagctgggcatggtggtgtacacctataatcccagctacttgggaggctgaggcagaagaatcgcttgagcctgggaggcagaggttgcagtgagccgagattgttccactgcactccagcctgggcgacagagcaagactctgtctgggaaaaaaaaaaagaaagaaagaaagaaagaagagataagaagatgtaaaacttgatctgaagctgccttcaaatctgtcagaaactacatttctacttatgttacttggtgacaaaagtagagcggtgggagagggtgaaactggggtctgagtgttttggggtgatacttgctacattttggggaagaactgtcttgcccatgttagaatttggtgattgctagcgtttttaaggtgatcactgatgcattttaatcacaaagacaggccaatagcaatactcaagttcattttaaatgaagcatatattttgaaatgagaacctaagtccaactgtttaatttagatgtttttccattcaggctaaaaaaaatttcttcttttttttcttttttgagacagacccttactctgttgctcaggctggggtgcagtggcactatcacagctcattacagcctcagcctcccaggcacaagcgatcatcccgccacacactcctgagtagctgggactacaggcgcgcaccaccacgtgcagctaatttcattcaagctaaaaatattgtttctcatgtaactatcaaaagtgacacatcggggaaaaaaagatgaaaaaagtgatacatctaaagacaagaaattcttttatatacataaaaggagaataatttctgtgctgtaggaccctaacttataaatgtctcatgtacacattttatatttgttagtttaccaagaatttggttttaaaagtagaaagcacggttttatagttaaaagacatcacttagagtaccctcactttcattcaattgacttgtttcaaatacgctaatatcattgtgtactgtcattgcaaagttctgtagattaaattcattgtgaacaatttttaaccacttaaaggtatttaaaaattcaatactaagcatttaaaaataattacatatttactgagtggctttatatataatcaattcagaaaaacagacttaccgtttacagctttctcataatttttccccaggtttattaaatttcgcagcccaggattgaactgttccataacattctgccaaacaaacaaaacacacaaattaataaaataaaaaataaaccaagtcatcttcagattttgtcactgtgtggcccaggatagctatggatgcctaacagcacagtctacaaagtaatgaatgctgatgtaaaaataatgaagcacacctattcccttacctgatggaacagggctcacaggtggcaaggtgcccgtaaccctggcagttctcagttgcccaagaggctgcctggaatctgctataagcggagcaggcagcagtcattcatgtctctaccataccctgcagggactgtaggcctggcatcctcttgggtttgagtggattgctaatggttctcattctagtgttaaggaacgcctgtggaggatcagctacctgtacttacttacaaaggcaatgtttcaaatagatttcgatgaatttctatccactgaatagaaatttccaggagattttgtttttactctgcctaattataggggtgtgggcggggagggacgtgaaagggggcattggtagcatgttgctgatggccccaggacacaggcctgcctggaaacttctggatgtccctggcattttttctttttttttttttttttttttttttgagacggagtctcactctgtcatccaggctggagtacagtggcacgatctcagctcactgcaacctccgcctactaggttcaagcaattctcctgcccctgcctcccgagtagctgggattacaggagcccaccaccacacccagctaatttttatatttttagtagaggcggggtttcaccatgttggccaggctggtctcgaactcctgacctcaggttatccgcgtaccttggcctcccaaaatgctgggattacaggcacgagccactgcgccctgcctccctggcattttcccactgattggtttattcaccaaagttgtgtggagtaactaccatgggccagaccctgtgcacacagctaaggattagaaggcacagtttccctctcatggatttcatggtgcagccagtgtccaggtttcatttcaacacgtgttattcctgtatcagcagaaagtcataaagacaaatgctaggacaagtataagacaaataactatttaggacgtgggtctaaattttaaaataccctaactttgaagtacagacaataagtcattcctacggtactcagacttcacgactcacaacacgtggcgattgttatgtgtttgttccatctaggaacaataagcttcatgatattaatcaccccaaagagaccattcaagtctcaccgaccccttccccaaatgcatgctccatttatatagacgaccagatgcaaaaaagaatgaacaactacccaacattcaaagaggcaggtgctttacacacatacccttcagaataaatgaatcaggaggagagagagaataggacgactcttgtttttaatcaaactgtgataacaatgaaaaacaacccatgcctcgacctttccatagccctggtcttatgcccgagagcactttcaactatgctcctatttttgtatttattgctgcagttttgaatattctttttttttttaaatattcttgatttcttgattttggggagtaactgcagcttcctacgacagcagatgaggcctcaggtctctatacctctcactcttcctttccaatggactttctatgcaattagatggcaatttgctgatgaaactatagtcagtgttcattatgactttgcactaaggctgatggttccctttctcagtaaagcctggctgtttttcctgggatggacaattgtttctttccgccccgccacctttgcttagttttctgtttatctaccttaaacttgtccccatgctgtattagacttggctgaggcctatcagtgttatttttcaaatgtacaaaactctcagctaatctcctgttccgtttttcccttgacttcctctaaggactctccaccatcttgctcagtgtggcttgactgtcacgattgccctagcatggccctcctggtggcctgtggcagcgctcttgtcagccaggtaggtccacgtcttcctatttctccaaaatggagatcacattccaaaaatgatctaagaactaatgcgtgagaggtaaatctgagtccccgtgtgtctgaaattatctttaccttgacgtttgctattttgctgagtagagcagagtagattgaaactattttccttagaatttttaagacatcacttggtcaggcgtgatggctcatgcttgtaatcccagaactttgggaggctgaagtgggaggatcaccacttgagcccaggagtttgcgaccaacctggacaacatatcgagactcccatcgctacaaaaaataaaaacaattagccaagggtggtggcttgtggctgtggtcccagctacttgggaggctgaggtgagaggatcacttgagcccaggagtttgaggctgcagttagttgtgactgcaccacttcactccaatttgggtgacagagtgaggatatgtctcaaaaaaaaaaaaaaaaaaaaaaaaaaaaaaaaagagctattactccactgtctttagcatctgggtctgctgaagtcagctgccatttcttcctatgtgacttttttttaaagcttatttctggaagccttctctttattcctgtgttctgaaattgcaccatggtctgtcccagcattttttttgtttgtttttcatttattttaccggacactcagtgggacccctagccatgtggaaaattatgtccttcaggtacaaatatcattcctgttttatttcttgtctcttcattctttctggaactctgatgaagattttatatatcctggatttattctctaatcttttttgattttccactttcagtagttttgttctataacgctaacagatatcctcaactttatgttccaattctattttttgaatttgatatatcttaatttctaagagcatgttcatgtttcttgattgctctttttgttttggtttggtttttgagatggagtttcactccgttgcccaggatggagtgcagtggtgtgatcctggctcactacaacctcggcctcccaggctcaagtgatcctcgtgccccaacctcccaagtagctgcggggggtggatcacaggcatgcgccaccacgcctggctaattttttgtatttttggtagagacagggttttgccatgttgcccagactggtctaaaactcctgagctcaagcaatctgcccgccctggcctcccaaagtgctgggattacaggtgtgagccaccacgcccagccttttgattgcttctttttaaaagtactctcctgttcttgttttatagatgcagtatcttctcctgtctgaattttttggtgtgttttattctagttcccgtatcatctcctgattacctttcactgtttgatatccctgtctttcatgttagagactctcctcaaacgtgtggtgatccctgatggccagtttgtattgaggcgtgcagcccgtcactgccggctggaagctgtgggtgtgtgcacagggtagtggctgacttgctggcttcattccaagccaatggccactctacagtcatcaggggccactgggcttctgctgagaagtttctaatttcctgtcattgggtgggggacaatcatcggatggtcagctttcgcagtcaggaagggggccgggactggacagtttggagctgattttcaggaactcctctgttttcagctcagagttctgcctcctccacccttggctgctgtttccaagtctagagcacctcagattatcctgaggttaaatctctgctctgccagagggagctgctggtggtggtggctggggtagggaagggaagccaggagctccgccaccctgtgcaccagactccgattcctgcccccaccttctgcggcccagtcctcagcctctggggcccctggggtgaatggctcagtttccatcagactcctttccccaggttcttcaggctctctgaggtcactgagcactctctgtccatttcctatcaccccagatttctttaggtctcttgtcaatggatgttttccaggtctttttgcactgtggatttattgggtattgtttttaattcctttgccatcattttaatgggttctcaaaaggaagaaaataaaatacacaaggtgcctctcccatgcctgcctggaagcccgctcacctggtatcactagacgcagtcaggtgcttggcacctacgcgcaaccagtggccaggaagccccagagccagccaactcccccacgatcctctctacaagatggcaaagcctcattacgtagccacagctgctctttttctttgctttgctttttttcttttcttccctccatcccttcttccctcctttcttccttcttctctttctgagacagggttttgatctgtcacacaggctggcgtgcagtggcatgatcaccacacactgtagccccaaactcttgggctcaagtgatcctcctgcttcagcttcccgagtagctgggaggtgtgtgccaccatgcccaggtaattaaattttttttttttttttaagagacagggtcttgctatgttgtccaggctggtctgtccacagctgttatttctgtcatctcttctcaattcttttgttttggagcttctttgaaatagtttaagactcataagagttgtaaaaataatacacagagttcccaggtatgcttcctgcaatggtatcttctataaccatagtatattatcaaacccaggaaactgtcactgctacagttctattaactcaactacagaccttatttggattttcccactttttgtatcactcatttttgggggaaggtttcatcatttcttttttctttgtttgagacagagtcttgctctgttgcccaggttggagtgcagtggtacgatctcagctcactgcaacctctgcctccccggttcaagcaattctcctgcctcagcctcttgagtagatgggattataggcgcgcaccaccacacctggctttttttttttttttttgtgagacggagtctcgctctgtcgcccaggctagagtgcagtgacgcaatctcggctcactgcaagctctgcctctggggttcacgtcattctcctgcctcagcctcccgagtagctgggactacaggcacccaccaccacgcccggctaattttttgtatttttagtagagacgggtttcactgttagccaggatggtctcgatttcctgaccttgtgatccactgcggccagcccaatttttgcatttttaatagagatggggtttcgccatgttggtcaggctggtcttgaactcccgacctcagatggtccacctgcctcggcctcccaaagtgctgggattacaggcgtgagccaccacgcttggccgggtttcatcatttctatgaaattttatcatacatgtaggttgccacgaccatcaccgcaagtaaaatacggaactgttccactaacacacacgcctcttttgtgctgccacttaataatcatgccctcctcctcaccaatcctcacctctggcaattcctgagctcaatctatgattctgtcattgtgagaatgttatataaaaggaatcatggccgggtgcagtggctcatgcctgtaatcccagcattttgggaggccaagttgggcagatcacctgaggtcaggagttcaagaccagcctggccaacatggtgaaaccctgtctctactaaaaaatacaaaaattagcgggcgtggtggcgtttgcctgtaatcccagctgctcaggaggctgaggccggagaattgcttgaatctgggaggcagaggttgcagtgagctgagaccgtgccattgcactccagcctgggtgacagagtgagactccatctcaaaaacaaaacaaaacaaaacaaaagaatcatgggaggccgaggcgggtggatcacaaggtcagaagatcgacaccattctggccaacatggtgaaaccccgcctctactaaaaatacatgaattagctgggtgtggtggtgcgtgcttgtaatcccagctacttggggggctgaggcaggagaatcatttgaacctaggaggcggaggttgcattgagtcgagatcgcaccactgcactctagcctggtgacagagcaagactctgtctcaaaaaaataacaaaaaaggaatcgtatcgtatgtggcattttaagatttgcccttttcacccagcacaatgccttaagatgtatccaagttgttggatgtagtttatcactttttattttttttttttggctagtagcattccatggtatggatatattgcagtttgtttatccacatacttgttgaagacctggcttgtttccaggttttgacaattccaagcaaagctgctatgagcgatcgcatacaggtttttatgtgagcttacgttttcgtatctctaggataacctgggggttcaatggctgcgtcacatggtaggcacgtgtttaactttttaagaaactgccaaactttttttttttttttttcagaacagctgcaccattttactttcccattagcactcggagatttcactcattttcaaaatctgataatttcattagcacacagctactttctaattaaaagacaaaactattttaaagttactgaaaattattacaggccatgcgtggtgactcatgcctgtaatcccaagcactttgggaggccgagggaggtgggctgtttgagcccaggaattcgagactagcctgggcaacgtggtgaaaccccatctctaccaaaaatacaaaaatttgctgggcacggcggtgggtgcctgtagtcccagctactcaggaggctgaggtaggtgaatcgcttgaactcaagagacggaggtagcagtgagatcgtgccgctgcactccagcctgggcgataaagcgagaccctgtcttgaaaaataaaaaattcatatgatattcttatgaggctgggtgtaggtaaaaatataagaaaactgacagagagccgaccctgcccaataacatatgagcaccacagaaagcagcccagatctgttctttcctgcggatattccttctccaaatacaataggaggaaagtctcatttgatttcctaattttttttttttttttttttttttttgagctagagctttgctctgtcgcccaggctggagtgcaatggtgccatctcggctcactgcaacctccacctcctgggttcacgcaactcttgtgcctccgcctcccaagtaactgggattacagatgcctgctaccacacccagctaatttttgtttttttagtagagatggtgtttcaccgtgttgcccaggctggttttgaactcctgaccgcaagtgattcatccgcctcagcctcccaaagtgctgggattacaggcatgagccatcatacccaaccaatttcctgatataattcttaaaatgttcacatataaccctaacatcttaaaatacgaagaacaacaaatgaatgagaacttccacagttaacaccatacacaaatccctatccaaatgattctaccagagggggaaaaaaaaaagttcaactaagacttgagactaggctgggcgcagtggctcacaaggtcaagagatcgagaccatcctggctaatgtggcgaaaccccatctctactaaaaacacaaaaattagccaggcatggtggcgggtgcttgtagtcctagctattcaggaggctgagacaagagaattccttgaacccgggacgcggggttgcagtgagctgagattgcgccactgcactccagcctggcaacagagtaaggctccgtctcaaaaaaaaaaaaaaaaaaagatttgcaactacagtttgtagtcaatactgagtttttaagcttgaaaagttcaacatatatacttctttattactgtacgtaggttcagctacagaaatgttccctcccagaaattttggctttttttttgagacagagtctcgcactgtcgcccagggagtgcagtggcgcgatctcggctcactgcaagctccgcctcctgggttcacgccattctcctgcctcagccccctgagtagctgggactacaggcgcccgccaccatgcccagctaattttttgtatttttagtagagacggggtttcaccatgttagccaggatggtctcgatctcctgacctcatgatccgtccgcctcggcctcccaaagtgctgggattacaggtgtgagccaccgcgcctggccaattttggtctttctaacagtggaaaatccattcctatattggctcttcacctagttattttagctgaagtacatgttatttttaaacccagggacaaaaaaagcaatgctgcctttgtattccagaatctataaagttttatagtagttgtggacacacttgtgaatagaaagggtcccacattttgggggagagctgtagttgaggcaaaggtcggtgctactgcaaggcttgtgaagacctgaattgttaaacagcctacaatgttaagagtcatcaggagtaatgaacaaatccattttaatttaagtttggcactaagaattaaagggcttaggataccaagtgaatcttaacaaagtgaacagaaaaattataaatgggccaagcagcactgttactaagaaaaaaaaatagcaatagcttagtctatatctctatcgattactgcctggcaaggatactctgccaaactggttttaaccagaatgagtttcatttccatccagggaagggcatgcatagttatggttgcacaatacattctaggctaatggtaatatcactcttctacttgtgctgagtcgcataaaaagaagcttggttctaccgcaaaaccttagcggtactggaaaattagtgattagctattctaaataaaatgttggagaacagttccgctggaaccagcacacactattcaccagatttctagctgccctgtttacctcggcatttctactgcctctgtaaagttacagatcataattatgaattaagaataattatgagaaatgaatgatgcaatcttatgacggttttaacttccttagcatatggactttttataactcattttcaaagaattaccagtatggaactatacataaattaactgtgtacatttataataaagtatacattaattcaattatgactagccagataagctgagtggactttaaacttttaaaaattagtttctcttttagtttctttttttttttttctgagacggagtctcgctctgtcacccaggctgtagtgcagtggcgcaatctcggctcactgcaagctccgcctcccgggttcacaccgttctcctgcctcagcctcccgagtagctgagactacagatgcccgccactgcacctggctagttttttgtatttttagagagacggggtttcaccagtgttagccaggatggtctcgatctcctgatctcgtgatccacctgcctccgcctcccaaagtgctgggattacaggcgtgagccatcgcgcccggccctcttttagtttcttttagtagttctgtataggccgggtgtgttggctcacgtctgtaagcccagcactttgggaggcaaggcggtcggatcacctgaggtcaggagttcgagaccaacctgggcaacatagtgaaaccccctccctactaaaaatacaaaaattagctgggcatggggacgggcgcctgtagtcccagctactcagcaggctgaggcaggagaattgcttgaatccaggaggtggaggttgcagtgagctgagatggcgtcactgctctgcagcctgggtgacagaacgaaactcagtctcaaaaaaacaaaacaaaacaaaaattctctatatgaacaaggacaaattatttgatattttagtgctttgtttttctcagctaaaagtgtaacatttatgataaataagcattaaaagtggtttaagaatctctaagtaaatatgcagttctgtggcttgtaacgtatgtatccttgaaattttatatattattttattctatactatctcatacaaattaaccgagtgacatcacaaatgttcaaaccaatcaaggtacatgctaatgtcatgtagcaaaaatagctgtaatgagggttaactgaggatatgtcaagatcgattttggtttttttttttttttttttttttgagacacagtctcgctctgtctcccaggctggaatgtagtggccagtggcctgatctcggctcactgcaacctctgcctcctgagttcaagcggttttcgtgcctaaggagtaggtgggattacaggcacccaccaccacgcccagctaatttttgtattcttggtagagatggggtttcgccatgttggccaggctggtctcgagctcctgacctcaggtgatctggccgccttggcctcccaaagtgctgggactacaggtgcgagccagcacgcccggtcaagatcaattttatttgtaggaaatcttgcttccttcttccttaagtgttgctggaagctgctgttcctggactaacatcaccaatacttgatcacctgctcttcctttagggaaagtattagtaagcaaatctggcaaggagacagctgcctgtgggctaacagatggtcacaagagtcatgctgttcatacccatcatgaatttggagcacaagccaagtacagaaaaattagacaactgagatgtttcctttgaggtattgagttagatcagaaatactcattgaaatatataaacccacaaaaatgctttttgttggtcaaatatgagtaatgttttggttacctattggtctatattagctattatattagctatcttgcattatgtattagtttgcattatctgtaacttataagatgccatctcaatagcaatgggcctggaaggtgtggggaacttggcagaaagaaaatttggccttgaattcttgggcaaatcacatcaccacctctgtgagcctctagaaagcctgagtctcttcctgtctacaatgggaatcatgatactttctagctcatgaggggcatgaggattcagtgaggcagcttaacattatggagtgcttatcatgtactctgcaagcacttgatactcagtacacactgaaccaactgtagtaattaatattctaagagaaaagctctaaaatatgagtcaagtctccaaacagaggaacactcctatttacacaggtatctccaggaacctccacttcctgttaactggtatcagctcttccaccctggtgtcatcatcaggacgagggagatcatgaacacagaacctctggagaagggtacgggacaaaggacattgaaggtgttatgatcttctgctttattcagttgagaacatttatttattttgagatagggtcttgctgtgttgcccaggctggagtatagaggcaagaacatggtttactgcagccttgacctcctgagatcaagcactcctcccacctcagcctccgagtaggtgggactacagacgcaaaccatatccgactaatttttggattttttgtagagatggggtcttgctatgttgcccaggctggccttgaactcctggactcaagcaatcctcctacctcagcctcccaaagtgctgggattacaggtgtgagccaccacatctggccctagaacatttatgtcattaattttttccatttgaggcacattttaacatttacagagggctactatgaatccggctctatgtctaacattttacatggattgtctcaactgatcctaacatcgtggctgttattaatcccacttgatagacaagataccaaagctttgaaatgttgcattttaaaaccctgctgaaggtcctaccagcagcgagaggtggggtggagtcagctccaggcagtttccctactgtcctttgccttaggcctcaatagttccttcaaatgaatggtgaaaaaaagtgagatgaaaatgcattttatgagatcagagcactgacatattttagtatgagtgattgtaggtgtctctatagtacttttttttttctttttagaagctttcttataatcttactcctgatttttggtgaatataattaatctaatagcataatgtcgagcaattctgcctgggcaaatacgtctgaccctctctctcttctttcccataaaaaaaataaaataaaatggaagaaagaaaaaggtgaatctggccaggcatcgtggctaatgcctgtaattccagcactttgggaggccaaggtgggaggatcgcttgaggtcaggggttcaagaccagcctaagcaacatagcaaaaccctgtctctaccaaaaattcaaaaaattagctgggcgtagcagtgtgtacctgtggtcctggctacttgggaggctgagggaggagaagtgcttgaccccaggaggcggaggtttcaatgagccgagattgtgccattgcactccagcttgggtgacacagtgagaccctgtctcaaaaaaaacaaaaaacaaaaacaaaaaggccaggcgtggtggctcaccccataatcccagcactttgggaggctgaggcaggtggatcacgaggtcaggagtccaagaccagcctggccaacatagtgaaaccccatctctactaaaaataacaaaacttagttgggcctggtggtgagagcctgtaatcccagctactcgggaggctgaagcaggaaaatcacttgaacctgggaggcggaggttgcagtgagccgacatccggccactgcactccagcccaggcgacagtacaacactccatcttaaaaaaaaaaaaaaaatttgtgagagtgtagaatccacaaccacctgtagtccccacaagaattactaacagttggccaggcgcagtggctcatgcctataatcccagcactttgggaggccgaggctggcagatcacctgaggtaaggagttcgagaccagcctgaccaatatggagaaaccccatctctactaaaaatataaaattagccaggcatggtggcaggcacctataatctcagctactcgggaggccgaggcaggagaatcgcttgaatctgggaggcggaggttgcggtgatcacacccccgcactccagcctgggcgacaaaagcgaaagtccatctcaaaaaaaaaaaaaaaaaaaagaaaagaaaaaaaattactaacagttaacagtcacactggttccctttgctgaaaaagcactaaagcactagagataaaaggacaggatgccttagtcaccccatccaagtctcataccctttcttttctcccctgggggagccactaattcagactgctgttaaatatctagccgatattttatattttcacacacacgtatatatttagtcaagattaacataaaattttgctttgtgtgttaaaaaatacttacataaatccttaaatggtatcacataatacatttcactcttacatcttatttctttattcagtgttatacttctgagatctgctcaccttggtctgtactgaccaaggttcttcctatttaacttctacacggtatccctttatgatggtttaagtgtccacgtagcaaagctacagtattcagtcaattaaacactaatctaggctaggcacgggagctcatacctgtaatcccagcactttggggggctgaggcaggaggactgcttgagtccaggagttgagaacagcctgggcaacatagtgagaccccgtctctaccaaaaacaacaaaaaaaattagccaggtggggtggcatggcgtgtgcttgtggtcccagctacttagaggctgagatgggagaattgcttgagccagagaggtcgaggtcacagcgagccacgatcacacaaccatactccaacctgagcaaggcagagggagaccttgtctcaaaaaacaaaacaaaaccaacccattggctgggagcggtggctcaagcctgtaatcccagcactttgggaggccgaggcaggcagaacacctgaggtcaggagttcgagaccagcctgaccaacatggagaaaccccatctttacaaaaaaaaaaaaaaaaaacacacaaaaagctgggtgtggtggcgcatgcctgtaatctcagctactcggggggctgaggcaggagaatcacttgaacccgggaggtgcaggttgcggtgagctgagattatgccatcgcactccagcctaggcaacaagaacaaaactccatctcaaacaacaacaaaccaacccactaatctaacacggtgttgtctaaacacagcgttgctatgaaggtattttgtagatatggtcaacatctacactacaacttttatttaaagttgactttaaataaaagagattatcttcaataatcagggtgggtgtaatctaatcagtcaaaagcctgaggacaaattgaggtttccctaaggaagaagatattctgcttaagggctacagagtcagctcccaggctgccctacagatcttggactagtcagccccacaatcatggaagccaatttcttgaaataaatcttttcacttatatatagatatacatatacatacatatcccatcatgtaaagagactgcattttacccatctatttcttgactgacaggcatttacatggcttacgagcttctgctaatgacgacgacgtggtagggaatgatacatgtctccttgtacatacaggtaagaatttacccagaaacagaactgcagagacacagggtatgtgacatatttctccattttgttagatactcccaaatttgaagacagcaactgtagccatttccatgcctgaaaccaccgtgtcaaagtgctgttttgccatgttctccccaacacttggtactgtcatactttttgcctgtttgataggcaaacaatagtatcttttaaaaagtaccatacactaggccaggcccggtggctcacgcctgtaatcccagcactttgggagaccaaggcgggtggatcaccagaggtcaggagttcgagatcagcctggctaacatggtgaaaccccatttctattaaatatacaaaattagctgggtgtggtggcacgcgcctgtaatcccagctactcaggaggctgaggcaggagaatcacttaaacttcaggaggcagaggctgcagtgagccagtatctcaccactgactctccagcctgggcgacagagtgagactcaatctcaaaaaaaaaaaaaaaaaaaaaaaaaaggccaggtgtggtggctcacacctgtaattccagcactttgggaggccgagacgggcggatcacctgaggtcaggagttcgagaccagcctggccaacacatagtgaaaccccatctctactaaaaaaaaaaaatacaaaaattagctgggcatagtggcgcatgcctgtagttccagctacaggctgagaactgtgggaagctgagacaggagaatcgcttgaacctaggaggcggcagttgcagtgagctgggattgtgccattgcactccagcctgggtgacagagtaagactctgtctctcaaaaaacaaaaataaaaacaaaaacgaacaaaaaaaaaagtaccatacactatttctcatcagcattaaaaaataacacgactggaaatagctaagcatggggagagaaatgatgaaaggtagtttcctggtgtgttttagcctcagttctcgtgtccatcataagtgaatgtcatcagtgacttctgtccttttaacacagggtgggaagaggcattgaaagccgggacattccctgcagctgcatgctccacctgggtttgggctgaggcacactggcctccgggctgttctccaaacaggtcacatccattcccacaaactctcagagacaccttccttgacctcttccacaaatggtggcaaccccagcctctctctagctctgttcctggcttctctttctttaaagtacttatcatactgtataagatattccctgtttactctctgtctccttggtagaaactacatgtaatcaaggctagggatgtttttttttttagactaagtcttgctctgtcgcgcagcctggagtacagtggcatgacctcggctcactgcaacctctgcctcccaggttcaagcagttctcgtgcctcagcctctccagcagctgggactataggcacacgccaccatgtccatggctcagcactttgggaggccaaggcagaaggctcactctttttttttttgagatggagtctcgctctgttgctcaggctggtgtacagtggcgtgatctcggctcactgcaacctccgcctcccggttcaagcaattctgctgcctcagcttcccgagtagctgggactacaggcgtctgccaccgcgcctggctaattttttgtatttttagtagagactgggtttcaccgtgttagccaggatggtctcaatctcctgacctcgtgatctgacctcgtggttggccaggctggtctcgaattcctgacctcaggcgatccgcccgcttcagcctcccaaagtgctgggattacaggcatgagccaccgagcctggccaaagctaggaatcttaatgtaaccaccaccgcatttccagcaccaagaacactgcctggatcatctgattaatgcctcacagtgttctcagcagcagcaggttctgacacctgtatttcataagagatgcctgcacccacggacgaaccagctgcaggctgtaccctcagctccaccagctcatctgaacacatcgctacagacacaaaggccccgtgggtcaatcagcctcgaaaattgagcattaggtaatggtgccactgcttgccacttccctagctcaaggcgataactccaaccaaggttcacaaaagctgccaggctcggccttctacctaccaagtcctaacaggcttacaaatctgcaaataccagggctgtctgtgaattttgcttcccaatcctatgtttttctaagctgtcatttaaattccctgtgaaatacaaggcattaatgtggcctcttaaaaaaaatcttgtttagagacaacccacatgtccatcaactggtgaatgaacaaaacgtggtatatccatttaatagaatattattcagccatagaaaaggaataaaatattaagacactctacaacatagataaaacccattacgctaagaagccagtcacaaaagaccaaatactgtatgactctatttacaaaaagtacagaaaagacaaatctgtagagacagaaaatctattagtggttgcctggagctggaagcgagaatgagtaatgatagcaaatggggatgaaggatctttttgaggtgacagaagtgttataaatttaaattgtggtgacggctgcacaactttataaatttactaacaaccattaaattgtacgcttaaaatgcgtgaattttataacgtataaattacacctcaaaaatgctttttttttttttttgagatagggactctcactctgtcacccaggctggagtgcagtggtgtgatcagacctcatggtaatctcaaactctcagactcaagcgatccttctgcctcagcctcccatgtagcagggactttaggtacgcaccaacacacccacctaatttttaaattttttctagagatgggctcttgccatgttgcccagtgtatcagtctgttttcatgctgctgataaagacatacccaagactgggaagaaaaagaggtttcactggacttacggttccacatggctggtctcagaatcatggtgggaggcgaaaggcacttctaacatggcggcaggaagagaaaatgataaagcagcaaaagcggaaacccctgataaacccatcagatcttgtgagacttattcactaccataaggacagtatggtggaaaccgcccccatgactcaaattatctcccaccaggttcctcccacaacacatggaaatcataggaatacaattcaaaatgagattcgggtggggacacagagccaaaccatatcacccaggctggtttcagactcttggcctcaagcaatcctcctacctcagcctcctaaaaagtgctgggattacaagcataagccaccatatccggtccgttttttttttttttttaataaaaaaaaaaaggaaccaccaccaccgccactaccaccaccaccatcgccaccacccaaccacccaacccccgccccaccccttcttccattacaggctgctaaggattcagggatctaaatccctaatgttatggaatggccacaaagatgtgtatgcctttgctcattctttggtggtctctaactagcctgcccacagcacagcccagcatactgagacgcacaggtcatcccccgtcctttgggaacatgggtcccagacagctggacacgcaccactggtctgcaaagcatttatgcctatggagccgtccacagccatttccccttctagggtgaaaatcaatttgacccattagtagaaaatgataacccagctgttttgaggcagatctccggctggcgtagcagttgtttttccagctatgattgggtagggagtttggcaaatgtttttccaggcaaaagtccttactgtgtccttctaaaaggcggggtttcctaggaaatcttcagcgcatggagaaaactctccgtgagaatttcattatgacataatcattgttttgccttcattcttcctttcccatcttcacccacaatctaggttttggtttttacagaattattgctacaaagattgtccttccaggtgcaaaggtcatagcagaaaggaagccaagaggcctgcaggcttaccaggccccatccctagcaacgtggcctgagcctccactgggcgtgcaggtacagtctttgggcttagcctgtcatagaagaatattctcagagtcctgggagcacctatgagagcctgagctctctaaggccaaccaagcaattgggaccagtgtgatcactgaaagacatgcaccgctgcttcttctgatatattactagacgcaatcacgttgctgtgacctttcattcagttgcttaaagagacagatttctgtgacaaactcttggcttcctactccctactcacttaggcagcaagaattattctgcagctaaagcataattaagccaaaaaatggccccaatacactgaggtaagaaagaaggatgtcctacaactgttcacatcttctggacaaaagtatcaagcccgttaagaaaattaagtcccagagctacccccacccacattagggtaaaaatctaagggtttttttttttttttgagatggagtctcgctctgtcacccaggttggagtgcagtggcgatatctcggctcactgcaagttccacctcctgagttcacgccattctcctgcctcagcctcctgagtagctgggactacaggcgcctgccaccacgcccggcttttttgtattttcagtagagagggagtttcaccgtgttagtcaggatggtctcgatctcctgacctcgtgatccgcctgcctcagcctcccaaagtgctgggttataggcgtgagcaaccgtgcccagccaaaatctaggttttcaattgttaatttgaaaaaagagtggggagggagaacaatgtacaggaaaactgagctcagcccatctgagaaggtaacttgaaggaaaaaataatggtctttaacctagttcaagattagaaaatttcagccaggtacagtggctcacgcctgtaatcccagcactttgggaagccaaggcaggaggattgcttgaggccaggagtttgaaaccagcctaagcaacacagggagactgtgtctctacaaaaaataaaatttaaaaaaagactagaaaatttcattctattttaattactagacaaaggttttacatttgcctatgaatggaatggttcaaaatcactttcctttgtagtttaagtgtggatgattatactgggtttaaggtccacagataccataactctatatagttatgtttatttcttggcaatgccaggaaagcgttcaggttgaagctttggcaattagcaagctatcaaactttggaacaatgtctcgtccacaccggcctccatcagatgagggattgtggaaccctgccccagaattcaagcaggttttaaattctgaacttcatagggaataagtaatgcctataagactgaagtaaaaatcatttcttcaaattcctactaggataataccagtatccacgtttgctttgttcttagaggtacatgttcttatttgaaagaatgaaacctgaggtcaggagttcgagaccagcctgaccaacatggcgaaaccctgtctctactaaaaatacaaaaaattagccaagcatggtagcacgtgcctgtaatcccagctacttgggagggtgaggcaggagaatcacttgaacccaggaggcggaggctgcaatgagctgagatggcgccaccacactccagcctgggcaagagaccaagactctgtctcaaagtatcaaaaaagaaacaaacaaacaaaaaaaagaaaagaaaagaaagaatggaaacacaatccttcctattctaagctgctataccaagatgactaccatgtaatataactttcaatctttttttttttttttttcagacagaatttccttcttgttgaccaggctggagtgcaatggtgcgatcttggctcaccacaacctctgcttccctggttcaagcgattctcctgcctcagcctcccgagcagctgggattccaggcatgcgccaccacgcttggctaattatttttgtatttttagtagagacggggtttctccatgttggtcaggctggtctcgaactccagacctcaggtgatccacccacctcggcctcccaaagtgctgggattacaggcgtgagccactgcgcccggccataactttcagtcttaaaagtaacatttcaaccagaatctgaaaatgtgcctcttttctgggatctcctctttgtgtaagtttgtgcatgtgtgggagagacagagaagtaacatgtgaatgtgtgtacttacgtttcattccaccaactctgtaaagtctcacatttcaggctttcaaacacataaaaatctacacatttctgcaacatttattattatgcctacgttgagcccaccccatcctggacccaggaaacacaaagatgaatgaagaaagagctccaggccgggtgtggtggctcacgcctgtaatcccagcattttgggaggctgaggcgggcagatcacctgaggtcaggagtttgagaccagcctggccaacaaggtgaaaccctgtctctactaaaaatacaaaaattagctgggcgtggtggcacgtgcctgtaatcccagctactcaggaggctgaggcaggagaatcacgtgaacctgggaggcggagattgcagtgagccgagatcgcaccattgcaatccagcctgggcaacaagagtgaaactccgtctcagaaaaaaaaaaaaaaaagaaagagctccagtccttggaaatgtaccgtcttacacggaaacaggtacaaagaaataccaaggcaattcacagagacgtggtgaaaataagaaatgcaaacacctgaaatattacgttatcatttagaaatataaaactacagataaatggcatgtattaaggaccagtaactgattagttactgattctgaaatagctgttaaaagatacatactttgaagaccacagagtatactaggctgtttgactaagtgctcttgcctgcctagttactgtttttaaaaggtgtgtcctggaataaaaaagcaatcaataaatttacaggaaaggacatcttatgcactgggttacgttgtttagaaagccccagagcactgaacaggtaacaggaactttatcggatcaaagtacactgacttactgcactagttctttccaaatgctacttttatagtagtatctggaatcattctagctaacttccttcaaccagactctgtgagacagatcattctaccttttttttttttttttttttgtgagatggagtctcgctctgttgcccaggctggagcgtaggtggcacgatctcggctcactgcaacctcggcctcccaggttcaagcgattctcctgcctcagcctcccaagtagctgggtttacaggtgcccgccaccacgcctgggtaatgtttgtatttttagtaaagatgggattttgccatgttggccaggctggtgctgaactcccgaactcaggtgatccaaccaccttggccacccaaagtgctgggattacaggcatgagccacggcaatcaacctcattctattgtcttaaaatcgcagctgggtgggtgcagtggttcatgcctataattccagcactctgggaggctgaagtgggcagatcacttgaggccaggaattcaagaccagcctggccaacatggtgaaaccccatctctactaaaaatacaaaaattagccaggcatggtggcagggacctgtaatcccagctactcaggaggcagaggtgggaggattatttgaacccaggaggcggaggctgcagtgagccaagactgtgccaactgcactccagcctgggtgacagagcgagattctgtctcaaataaaataaaattgcggcctttgcgatctgaggaattgttcaaaaactccaaatgatttaaaaacagtttaaattctttacttttatttctcagataccagtaaggggaaatcatttctttttcttttgagacaggttcttgctgtgttgcccaggctggagtgcagtggcgcaatctctgctcactgcagcctcgacctcccggactcaagcgattcagcctccagagtagctgggattacagccacacgcccccatgcccagttaatttttttgtttttttcgtagacatggggtttcactatgttgtccaggctggtctcgaactcctgacctcaagcaagctgcctgcttcagcctcccaaagtgctgggattataggcaggagcccccacacccagccaggaatcaacatttcttttttttgttgttttttttttcacaaatagcactctttatttgccactatttgaagtctgaactttaaacagattcttggactggtggttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagactggcaagccttttctatgtcttttccaatgctgtctggaatcaatttattgaccacttctttcaagtcatttgtctgcacctctcgggtcatgatttcgatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttaggcagtttttaccctgaacatcttcagtaatcagcctgaattttctaaatgcaacttcatcattctgcaaatcagcaagactcacttcaaacacacgacccttgagaccatcagatgcaattttggttccttgggtcctggtgacgagcgtctttccaatatttcttatactgaacatagcaggtgctttcacatcataccaatctttcttagaaaatggatcaaccactttcttcttggctccctttttgccgcctttcgtaaggcgcttgttcttgccaaccgccatggtgctggtcagagagccaaaagcaggaatcaacatttctacaatgttctttccgagaacttttttttgtctctcatcgacttctctcctatattcaactttccaaaggttttttttttttttttttttttttggtgacagagtctcgctctgtcgccaggctggagtgcagtggtgccacttcagctcactgcaacctctgcctccaggtttcaagtgattctcctgcctcagcctcccgagtagctgggactacaggcgcccgccactgcacccaactaattttttgtatttttagtagagacggggtttcaccgtgttggccaggatggtcttgatctcttgacttcgtgatctgcccgcctcggcctcccaaagtgctgggattacaggcgtgagccaccgtgcctggccttccaaagacttccttaaagactgtacatcgccttaaaactcctctcaaacttaacctacacgcgtattaagcttttccttctttcttcccatattgagacaaaaccaagtccaaatattgaagttgtaaaggccagcccccgctgggacagagggtagggaaggagcaaggatgtttaatttacgacatgggcaggtccaggcggaggagaggggctgcggctactagaacttggggttgctgtcctgtcacagctataaactctggatgggcacagaccttctttgtcttttctccagcgtggtttctggtggtaaccatggtgcttggcacagctgtggtgctcaagaaaacagctgcgggaagaactcatgttggtggtaaaagctcagcccgtacctaacaggtgctcacaacatggcagttgttattactgacacgatctcagtgccaccaaagagttggtgatgatttcagtcacccctgtgtgatcagcacaggtcttcagcatttaaaacacaaaattcttgagttcttactatgcgccaccacgataagggattaaataaaccttcaagggctggatgcagtggctcatgcctttaatcccagcactttgggaggctgaggtgggaggactgcttgagcccaggagttcgagaccagcctggccaacaaagtgaggcaggccctgtctctacaagaaaaaaaaaaaaaattagctgggcgtggtggtgcacgcctgtagtcccagccactcagaaggctggggcaggagaatttgcttgagcctaggagttggaggctgcaataagctatgattgtgccatttcactccagcctgggcgacagagttaagaccctgtctcaaaacaaaacaaaacaacaacaacagaaaccaacaaccaaaaaaaccttcaaggaccatatagctccttcagggagataaaaatgtgtgccaatattttcaacactattctcttatcaggtatttactcagctccacctatttcagtcatttgtaaataaggaggcaggtaataaacagatgaaaatcaatgctcttggtgggggtggggagtgacagtctagtaaacacacgctatgcctactaacagttagccctaattgaatacctacgatgcgccagatgctattctaagagctttcatgtatgactgcgtttaatcttcacagcaaccctaggagctattatcatccttatttacagactaaagcacatcaaatgaaagaatagggcattatcaagtacatacaaccatcggggatgacacaaaggatgcactggttagctgaagaagccttctcagagggcataagagtaagactgagtctctaagcagatgcctgtaatcccggctactcgggaggccaaggcaggagaatcgcttcaacccgggaagtggaggttgcagtgagccgagatcgcaccactgcactccagcctgagtgacagggcgagactccctctcaaaaacaaaacaaaacaaacccatgttttgcatgtttaaactttttggtttacaggcatattgttcctgcatttattgttcagtcacatattgtactgtcagacataactgatgtcctgtatcttaagctgctcaaagtgtaacataagcccatgctatgatgagacataccatttagtccattaaataatcacaactgggccagatgcagtggctcacatctgtaatcccagcactttgggagaccgatgcaggcagacggcttgagcccaggagttcaagaccagcctgggcagcatagtgaaaccctgtctctatgaaaaacataaaaattagtcagacttggcggcacgtgcctgtagtcccagctacttgggaggctgaggcaggaggaacgctttagcctgggacgttgaggctgcagtgagccatgatcacaccactgcactccagcctggacaacagagaccctaagaaattaaaaaaaaaaaacaaaaaacaaaccattcaagttttatccaaaaaatcctggcccctaagtatgaggaattatcattgtgactttcctgatttgtcacctgaggtttttgtggccagaaacagattggtctattaactaagactcaggcaattgtgtcagacaggcatgtgaaggtgacagggggccctgtcttctgtactcctctcccctcccccaacaggcaggggcttccctcctcctaactcagcatggggctgctggattagggtagctggtggttggatctgtcatctgggacctattccaacccctaccccaatcttttctgcacatttgttcgaggccttattttttattttttttgagacagagtctcactctgtcacccaggctggagtgcagtggcaccatctgagctcactgcaacctccgcctcccaggttcaagcaattctcctgcttcagcctcccaagtagctggaattacaggtacccaccaccatgcccggctgatttttttgtatttttagtagagacggggtttcaccatgttggccaagctggtttcaaactcctgacctcaggtgatccgcccgtgtcagcctccgaaactgctgggattacgggcatgaggaggccttatattttaatcatctgagatttcccccatacttttgacaggttattaccacgcttgtacctcttcttgtccctgttgtcacctgcttttgtgcctttcaaagatacagccatgcttttaactgcttgcaacataagaaatgactttttgctctacacattcagagaaacttctgaacaaactatagaaatgacccctgaaagtaaagtcttgacttttaaaaggcagttttaagaactggaatttgagtattttcaattttgttcagctagttgcctgttgcacgtgtagtcttgggttagtaaatttttttttttttttgagaggtagtctcgcactgtcgcccaggctggagtgcagtggcgggatcttggctcactgcaagctccgcctcccgggttcacaccattctcctgcttcagcctcccgagtagctgggactacaggcacccgccaccgcacccggctaattttgtgtatttttagtagaaatggggtttcaccatgttagccaggatggtctctatctcctgacctcgtgatctgcccacctcggcctcccaaagtgctgggattacaggcatgagccactgcgcccggtctcgggttagtaaatgttaaacatgtattcccatacgtaaaaatcaagacagaaatcataagatttaaaattaggtttatctttaaatgggtaatttgcaaacagaggtaggagatggcgaattttagcttagttttaaaaacattatgtccattaaaacggaatatatatatttatctgctttacattaaatattataaaagtaagcaatttacattaaaaaatataaatatggccgggtgcagtggctcacgcctgtaatcccagcactttgggaggccgaggcgggcggatcacaaggtcaggagatcgagaccatcttggctaacacggtgaaaccccgtctctattaaaaatacaaaaacaaaattagccaggcatggtggtgggtgcctgcagtcccagctactcaggaggctgaggcaggagaatggcgtgaacctgggaggcagagcttgcagtgagccaagattgcgccactgcactacagcctgggtgacagagcaagactctgtctcaaaaaaaaacaaaaaacaaaaccaaaaactcctgccctagagttaactagtgcttaattgatattgtttagggactttttagcctccaaagtaccatatgaataaacacaagtttttttgttttgagacagtctctcgctctgttgccaggctagagtgcggtggcgtgatttcagctcactgctacctttgcctccccggttcaagcgatcctgcctcagcctctggagtagctgggactacaggcgcactccaccacacccagctaatttttttttttttttgtatttttagtagaaatggggtttcaccatgttggccaggatggtctcgatctcttgacctcatgatctgcccgcctcggcctcccaaagtgctgggattacaggcgtgagccactgtgcccggcccataaacacagtttaagcaggaaatctgggggcatcttcacccacctgctgttctctcaaaagcacaagcactctaggaggtgaaatactggttagatctctgacttgggctcatctattctgctccctggtttgggaactcattctggtaatattttttcttctattttttaaagaaagagaaaccggcaacattttatctcatttatatgcatctcacttttatccacaaagacttcaggcagctgttacaccaggaactaaaaccattaaaatctaaaacttggccaggcacagtggctcacgcctgtaatcccaacacttttgggaggatgaggcaggcggatcacaaggtcaggagacagagaccgtcctggctaacagagggaaaccctgactctactaaaaatacaaaaaaaaattagccgggcatggtggcgggcacctgtagtcccagttactcgggaggctgaggcaggagaatggcatgaacttgggaggtggacgttgtgagccgagatcgtgccactgcactccagcctgggcgacagagtgagactccgtctcaaaaaaaaaaaaaaaaaaaatctaaaactcaagtcactaaaatcatgataaaccagaaggactcaaggttaggaagacaaacagaagtataaaatcaaggctgaggaaaataaaaacagaaatctaacgtctgaaaggtcacagagctgtaattactctgcacatatctacaagttctaagtttatggggaaaagtatgcctagttattaataggcatgaaatcgtaggtgttctggccaatgtccatattctatatggtacacatgcttaaatactgaaaacacacacacatcccttctatgtgttattaaaaaggaagtggttttaaaagatctacttaattgagctgggaacgacggtgcacgactgtagtccctgttacttgggaggctgaggtaggatcactggagcccaggagttctaggtcagcctgggcaatgtagcaagaccccctcgctaaaaaaaaaaaaaaaaaaaagtctaccttagctgggtgtggtggcgggtgcctgtaatcccagctactaagggaggctgaggcaggagaatcgcttgaacctgggaggcggaggttgcagtaagctgagatcgcgccatttcactccagcctgggcgaacaagagtgaacctccgtttcaaaaaagaagtctacctaactggctagagttcagggaaaggcgcactctcacaccatgcagacaacagcatcatttggtgcatgctttctggagggcattttgcaatgtggagcaaacaggctttaaaatgtacctgccctttgacccagagctcccttctgggaatgtggcttaaggaaaacatcatggatctgcttacagatctgtgcaaagctttgactgcaaccatgcccatggctgagctgtaatagcaaagtactggcaatgatctatgtccaaccacaggggctgatcaataaattatgatgaaaaatggagtcctgtgcagtcatcaaaatgatagagcacagaaaactgacatggggatatgtacggaaaagtatcagaaaaagcgacagcaatagttagtgttatctctggtttgcaggattctgggcacacttatttacacttcttgttctttttgagacagattcttgctgccacccaggctggagtacagtggtgcagtctcagctcactgcaacctccgcctcccaggttcaggcaattctcctgcctcagcatcccgagtagctggaattacaggcacccgccaccacgcccagctgatttttatttatatatatagatatatatatgtaatttttgtaatttttgtgtatatatatacatacacacatatatatacatatatacgtgtacatatatgtacacatatatgtatacacacacatatatacatatatacgtgtacatatatgtacacatatatgtatatatacacacatatgtgtacatatatatgtacacatatatgtatatatatacatatatgtgtgtgtttatatatatatgtaatttttgtatttttggtagagatggggtttcgccatgttggctaggctggtctcaaactcctgacctcaggtgatccatcctcctcggcctcccacagtgctgggattacaggtgtgagccactgcacccggccatgaaagggttttattacataagggatgttgaaagcacagatgaaccctatttaaactggagctcggagtggggtgcaaagttatggttaactgcattttcttgttaattaaatattaatgaaaataccttccttttctttttatgtaacttttctatttatttatttttttttgagacggagtctccctctgtcgcccaggctggagtgcagtggcatgatctcagctcactgcaagctccgcctcctgggttcacgccattctcccgcctcagcctcccgagtagctgggactacagcctcccgccaccgcgcctggataattttttgtatttttagtagagacggggtttcactgtggtcttgatctcctgacttcgcaatccgcccgcctcggcctcccaaagtgctgggattacagacgtgagccaccgcgcctggtttatgtaacttttcttgaaaatgtacctactttggaccaggcgcagtgaggggctcatgcctgtaatcccagcactttgggaggccgaggcgggcggatcacctgaagtcgggagttcgagaccagcctgaacaacatggtgaaaccccatctctactaaaaatataaaaattaggccaggcgcggtggctcacgcctgtaatcccagcactttgggaggccaaggtaggcaggcagatcatgaggtcaggagatggagaccatcctggctaacacggtgaaaacccatctctactaaaaatacaaaaaattagccgggcgtggtggcaggcgcctgtagtcccagctactcgggaggctgagacaggagaatggcatgaacccaggaggcggagcttgcagtgagcagagatctcgccactgcactccagcctgggcgacagggagactccgtctcaaaaacaaacaaacaaacaaaaaaacccacacataaaacaaacaaaaaatccctttcatgcatgcagttatgatagttttagagtctaatgaacttcagtttatgtcttcctctagtgactaccacaactgtatggcctctcagaccagaatttcctaggtcttggtttgtcttctgacatgaaggatttcccacagggctccctgccaaggttacatacaccctacagagaaacggcagatcatcagcaggcctggaacaaacgattttgtttgtgtttactttaaaatttttttgcacatacccacaggaatggcaaaaattaaaaggatgggaaatagcagcagctggcaaggatgaagagcaactggaactctcatactctgctggtggaatggcaactggtgcgtcactgtggaaaatcaatcagcagtttctcctaaagcaaaatatttgaatgtctaatactcagccagtctgctcctgtgtctctatccaagagaaatgagggcctatggccatcagacgtgagccagaacattcataaagcacgactcataatatcttggaatagtctgaacataatcccagctgggcacagtggctcacgcctgcaatcccagcactttgggaagccgaggcaggcggatcacctgaggtcgggagttcgagaccagcctggccaacatggtgaaaccctgtctccactaaaaatacaaaaattagccagcgtggtggcaggtacctgtaaccccagctactcgggaggctgagacaggagaatcgcttgaacccgggaggcaagggttgtaatgagccgagatcacaccactgcacttgagcctgggtgacagagcaagactccgtctcaaaaaaacaaaacaaaacaaaaccaaagaaagaaagaaaataatcccagccaggtgtggtggctcatgcctgtaagcccagaactttgggaggccgaggtgggtggatcacgaggtcaggagttcgagaccagcctgaccaacatggtgaaacccgatctctactaaaaaatacaaaaattagctgggcatggtggcataagcctgtaatcccaactactcaggagtctgagggaggagaatcgcttgaacctgggaggtggaggttgcagtgagccaagactgagccactgcaccccagcctgggcgacagagcaagactgtctcaaaaaaaaaaaaaaaaagttaggagaggggctacccttggaggggtgcagcgactgggaggtggcacgagggggacttcagggagtggccatggtttgctccttgatctgggtggtggttacacaggtgtgttcagtttgtgacaatttagtgagctatgtatacttaagcacaactttatgtatattgctattcaataaaaagttttaaaaacaaattttaaaatatatttgcatgtgtcagcagataagttaaactaaattttatgcagcttttataacttatttttaagctggaatattgagttggaattattacagctttgaatacaggcctgtaatcccagcactttgggaagccgaggcaggcagattacttgagctcaggagtgcgtgaccagcctgggcaacacagtgagacaccatctctaccaaaaataaaaaattagccgggcatggcggtgcatgtggtcccagctacatgcctgtagcttttgatttacatttgtgacactatttcagttttgggtattaattcttgtcttgcacagacctccaagggaaacctaatgtgcatggaattaaaacaaattggatttttattttcttcaacattccacacagtttttagtcaaaaaataatcattttttcttgagatggggtctcactctgttgcccaggccagagtacagtggcaccatttcagtactgcaacctctgcctcctggcctcaagtgatcctcccacctcagcctactgaggagctgggaccccaggcacgtaccaccacacccggctaatttttgtatctttgtagaggtagggtctcactacattacccaggctggcctcgaactcctgggctcaagcaatccacctatcttgaccccccaaagtgctgggattacaggcatgagccaccgctcctagcctcattttattaagagagtttgttcaaaacatgccaatgatgatgaattaacagaatgacagaaaattccagtgacaccttagatcgccacattatgaaaatgtattcggtttgtgcatctttggtcactggaaactaaattaccatacaaacaaaggcatggtaagtgggatgtggcagccggtcactaagagactctaggactcagtttctcaacctggttaacaactatcctggccaacatggtgaaaccctgcttctatcaaaaaatgcaaaaatttgccaggcgtggcggctgtagtcccagctactcgggaggctgaggtgggagaattgctcgaaagtgggaggtggaggttgcagagagctgcgattgcaccactgcactccagcctgagcaacaaagcaagaccctgtctcaaaaataaataaataaaaatagttaagccaacacaatccacattcacctggatggctgatgtttacttagaattaagcactctatgaaaagtatcatcggagggcgccaggagcctagcaaaggacaggtgcttcacacattaaatggataaatgtccattcattcaacaaatatgcatgcctactatgtgccaggaactgttttaagtgcttggaatacaaaaacaaaaacaaagctcattgccttgtagagctcacattctagttggggtgggaagagagggaaagaaacataaataaatacatcacatagcctattctaaggtagtgttatgggggaaggtaatgtagtctaaggtggggctgggagatggatggaggcgtctgcaatctgagagtctgagcatacttccttgaggtgacactgaaaggcttctgtgatatctcccctttgactctgttagcaagattcctgtaggtaggacatccctcgatgctgccacacccgttcttcctccacttcttaagcccttttttttttttttttttttttttgagatggagtctcgctctgtcgcccaggctggagtgcagtggcgccatcttggctcactgcaacctctaactccctggttcaagcgattatcctgcctcagcctcccgagtagctgggactacaggcacgcgccaccacacccagctaatttttgtattttcagtagagacagggtttcaccatgttggccaggacggtctcgatctcctgacctcatgatctgcctgcccaccttggcctcccaaagtgctgggattacaggcgtgagccaccgcgccgggccctacttcctaagtctttaacagttctaggaaggctgtggctgctcttaattaagggtttttttgaactacttcttctaccatgagagcatatactcatcagaaaaccatgcaaaatcacagcaagcttttgagggcaaattatgggcatgctataaagtgtggagtggggagggatttttggctgaactctaattagtaacagcaacattactggacattttggggcttataacatcgtttatgaagtagtaaaatacacacatcctcctgggagttagcatggatctcccataatcatttgcctacgtatacattttagacatttcagcaaatgtgtacacagcatatatttaaggatatttgatattggctacagaggatcattctactttataattcctccttttctctaaagtattcctttatttcataattggagaaacctgagtatttaaaaacaaaaaactaaaacccatactagcaagtcattaaaaaatcatttgcaggtggcttttgtaaacacacctggttgtgttgcatttctattagtaaaatatggtagatggttaggtaatatagaggacatctcttcttaaaagcactagattcatcaacactgccagatttttgccatattaagcttaaactgttttcagcttgaacatcatggggcagggctggatagggggaagaacccaatacaggggcgggaaaaggtttttcagactcctgaattaaaatttcactttgcactgccaaagccaaagcatgggctagcagccttcactatttcatagattacataaacttgtagtctgatgctgtaaatatcctaccacctggacattaaaaaaaaaaaaggtcccaaaacactaacaaggaaatagtaattaaaacgaacaaacatttagtgagctttccagtttgctttcagacacctggcaatggaaaactatcaggtactggtctttgatctccatttacagtgccttacgtctacaaatacgtataaccaaaatgatgaaatccacactttttccctgccgtttccgttctttgggtaataagacatgcccaagtggttggcatttgtgacgctgcaattcgccttggtacggtccctctaaggagttattactaaaagtctacgtcaggaagaagcgggagaaaaaaagcagggtttaactcagaacacctgactgctggtctcaagttgcaatcgcagctcagactgggaagatacacagggctgttcttggaagaagggcggaaggcagtggtgttctgtatttttgcaccccagtggacatcagactctgcctcaaatttgcaatggcctgccttcctcaattacacagtttttccttcactgacagtcaacagagcagccactacttactttccaggtctgagtctggcagaaagaacgttttatttacacacttggtcagtaccccacacctcatgcagcaacgtcttccgggtcatttaaatagtagcaatctcaatacaaatgtaggaatttctcaaatttcgaatttctcaaatttctaaagatcgccctctatgaaggcaacacacgaatagaagagtttttggtcacagtgactgagcatcaaaaacgctgtgtcaactgtgtctactctccctacctgtaaggcataatttatatgtgacagtatacactttgtgtgttaagataaacggaacggatctcttggatttcaatacataacaaaaatgttcatgttcttctcttactttcattcaacaaaagttaatagactcctctgattttaggaattcagaccttgaaaacccagaaactaaaattttaggtttaaaaaagtctatcaaaatgactaaacttcctgattcaagcaccagggacagaaaaaagataaaacacaccaaccaaccaaccgaccaaccatttatttataaccttaaacatgcctatacatgaacttagagaacgttaaagtttcaagggttcgaagcgcctaggctgaattaaaacaaaagttgttttgtgttctattaatagcagatgattaacagatatcttatttcacctggaattcatttgtaagtatgtaaactaaacaggccactaatcctaagtctctgtctgtgtctggaaaaattctctcctaatacatgcaagttaagagaccggctatcaacgcattccttaaggttaggtcaatttcattaaaacctcggttgttctttgacttcaagaacctcaccaaataacccatatataaaagccaagttcaactgaaaggtgggagaggaagggtctaaggaggagggcgtttcccgggagaacgcccagagctcggctcacctggcgatcctaattacaggggagtttcacccccacattcttgggcgctttcttttcttagaggaaactcgagcttgtgtctttggtcccggagggcttaagcccggcagccaggacagcacgggtcactgattccaagaagttgggaggaggacgtgggccccaccgacgcacaacagacccctccccaacttaagtgcactagttgtaaaatgtgtagctggtcaggggatggggggtggtctccagagctctgagggtcagggaagaggagaagggacggggaggagaagggacaggggaggcggagaagggccaggagaggagggggagacacacggggaaggaggaagaaccaagaggagggggagggggagggggagggagggggatagactggggagaagaagggacaggggaggagggggagacacacgggggagaaggaagaaccaggaggaggggagggacagtgtcgaggggcaggggaggagggagagtgaacggggagcggaggggcagagggagaggtacagcggggcgggaaagagagacagggaagaagcacagggaggaggggagggaaggaggaggaaaagtaggggggaggggatggggagggactgggaggaaggagagggccaggggaggaagaagaggggctgtggagggccaggggaggagtgggagagaccgggagaggtggaaggacgcgggggaggggagctggagggagggaaagtaccttcccgcgtaaagtccccttctgaaccccgaggtggaaagccctgacctccctgagccccgggccctgggcttacccggtaggtgctctccgtgagccggttcacctcctcgggcccccgggacatggctgcggccgccgggcgagcaagcgcgggaggacgcggctgggcctcgtggccgccggactccgggcagcgggagggccggggcgcgactaaggggctctggagggtcggccgccgccgcagccgtcggcccgagagtgcccgcgcgcgtctccgctgcgaaaatgtcaaaacttgcggcagcgccgccctggccttcttcgaggagcagaggagaagcggccggacgccgccagaggaagctgggcgggccgggcggcccc

SEQ ID NO: 810 - DNA, 225549 bp, Homo sapiens
gctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctgggtaggaaccccctttaactttggggagggaaagacgtgcagacgaattaggccagggtctgggaggaggcgggggcggggtctgagtgggatcgggtccgggtggtatggggaggggcggagaggcgggggttccagggcctgagcctgtaaggccgagcaggaaggaaaaaagcacctgggaagtaaagaatgtttgaagtgtaggggctggaactcaggcaatgtggattgtgttcaaatgggtcaggttggcgttgaggatttggggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaattaccgtgttttcttccagttttgcaggtggagaaactggggctgaagaggtaacttgcgttaagttaggccacacagctagaaaatggtagcgctaggatcagaaccggatttgcccactccaacagaacttgagatattgacttggctcttgagctaagactgtatatgtagtactttgttgagcatctttagtgtataaggcatttaatgaatgaaaaaaggcacacacacgcatagatatgtacacacacacacatatgcacacaatacacattttattttattttatttttgagacggagtctagctctgtcgcccgggctggagtgcagtggcgcgatcttggctcactgcaagctccgcctcccgggtagctgggactacaggcgcccgccacctcgcccggctacttttttgtatacttaatagagacggggtttcaccgtgttaaccaggatggtctcgatctcctgacctcgtgatctgcccgcctcagcctccaaaagtgcttggattacaggcgtgagccaccgcgcccggccacaatacacattttaaataattcatagacttttatttttttaaagacgttttgttttgttttgttttgttttttgagacagagtttctctcctgttgcccaggctggagtacactgcaacctctgcctcccggattcaagcgattctcctgcctcagcctcccgagtagttgagattacaggcatgcgccaccacgccaggttaattttatatttttagtagagacggggtttcaccatgttggtcaggctggtctcaaactcctgacctcaggtgatccgcccacctcggcctcccaaagtgttgggattacaggcgtgagccactgcacatggcgagaagttttaagtttacagaaaattgagcagatagtacggcgagttcccatataccttgggtctccctcactcacagtttccgctattatttacatcttgcattagtgtggtacatttgttacaatggataaacatatatatttataatatataataatatattatatattattattattatatagatatattattatagatacatattattaactaaagtccatagtttacattagggttctttgtgttgttcagttctgtgggttttgataaatgcatgtcatgtattcaccattccattatcatacagaatagtttcactgtcctgaaaaatcccctgtgctccacctattgatccttctccctccccctgcagcccttgccaaccactgatcttatggtctctaaagttttgccttttccagaatatcatgtagttggagtcatacagtgtgtaaatttttcagatgggcttctttaacttagcagtaagcatttaagtttcctccatgtctttctgtggcatgataactcatttctttttatttctgaataatattccattgtatggatgtaccatgcacatcttttttttttttcttcttctttttttttttttttgagacaatgtctggcactgtcactcaggctggagtgcagtggcactatcacggctcactgcagcctcaacctccgggctcaagtgatcctgctacctcagccttccaagtagctgggactacaggcacatgccaccatccctggttaattttttaattttttgtagagaaagagtctcactatgttgtccaggttggtcttgaactccagggctcaagcaagcctcttactgtggccttccaaagtactgagattacaggtgtgagtcactgcacctggcttacatctttttttttttttttttttttttttgagatggagtttcactcttgttgcctaggctggagtgcaatgatgcgatctgggctcaccccaacctccgcctcctgggttcaagtgattctcctgcctcagcctccctagtacctgggattacaggcatgcgccaccacgcctggctaattttgtatttttagtagagatgggtttctccatgttggtcaggctggtctcaaactcctgacctcaggtgatccacccacctcggcctcccaaactgcttggattacaggcgtgagccaccgcgcccagccaacatctttttaaatgaaaaacaattctggtttacattttgtttaacttattttaaaaattaattttaaaatattttttaaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatatatatagacatatatatagagagagagcttaagacagtgaccacatccattaatcagctaaaaggggatatcacagacaattttgtatctaatgaataacagtatcaatgtcaagcaatgcctagacttttttccaaagattttatgtattttattacccagtactcaatgaatatatgaaatatttgaaaaggctagttcattgttcagttccttgggtgtttgctgtttgaattttatgtctcaaaggcttggcagatttggtgtattggtgccttggtgaatagaagttggtggtctcttcataaatggcgttttcaggaaggccaattcagtggcagtgttgagaatgaatctacaaacagaatcagagtctcaggttggttgaaaaagcttcaatgtttgtgaagcccaaccaatcacctaataattgaatcctatacaaatgcttcttcatgctttgttgcatatttaagtgtcttaattccttgtcctaaccactaactagacattcatactgccctcagcatggtcacacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccacctacgtgctgacctgagtataagcatgagggcgtgaggtttattttttactccacctaatttggtgaggtgcatgctttcactcacgctccaagttgcctcttcttttccatggaacctgcttattctcactacggttgatagtgggttagtataatagataactctagaaatcaaagatggcctttctcctttggggactagacatttagaagaatcacaataaattgggtagttttttttttaagctatagtttttgaactcttcctatatgcctggcactgtggtttatctcatttaattttcacaactaccatatgaagtgggtactcttactggtcccaattagtagttattaatatcatcttctcattttataaataaggaagctgaggcttagaaaggctaattgatttgcacaaggtcacacaggcaatgatgcatagtaaacaggggttcatacccaggtttgtcatattccacagcttgtgttttttcctcttcactaaaaagataaaaacaaaccaaaaaacccctattggttcaaagggcagtaattcttgcttccttattaaggatgaggctcttgcaaataaatttcttgggaacaagaattgtgttttactcatcattgtcaaccttctatcattgtctaccttctatcactgtataccttctatcattgtatactctcctacacttaattcatacgtatatgtgaaatggaatatgaataatctgaccttagggtaccctaaacatgagtagctaacaaaagcaaccgagacttattaagaacttactctgtaccaggtaccattttaaatgctttacatatattgatgtatatgaagatagtttcagttgttatctccattcggcagatgaggaaactacacacaaagataccaaataacaagttgtaagtggtggatccagaattctaacccagcagtctaattgaagtccacatggttaaactctatgctataaatactttgagcaactcccaaagtggggctccaactattgtgtagacctatacgtggatcctggagtaaggtcaagtgattccagtgtcttcatttaacatttctgccatgaggaggcatccgaggaatgaggatggatcagggaatggtaaaatttccaatttcttcttgccactggactcatctctcagaggcaggcagtgaggaagataacttctaccatttgggagaattttattgacaatcatctttgtactttgggtagctgtatgacctagaagaaatcacttaacctctctgtgccttagtttccacatctccaaaatgtgggtggtaatagtacagtcatggtggcttacgcctatattcccagcactgtgggaggccaaggagggaggattgcttgagcccaggagtttgagaccaatgggacatagtgagacttcgtctctactaaaaataaaaaaaaaatagctgggtgcaacagcatgcatctgtagtcccagttactcaggaggcggaggtgggaggatggcttgagcccaggaggtcaaggctgcagtgagctgttttcacaccactgcactccagcctgggtgacaaagtgagaccctttctcaaaaaatttaaaaaaggccaggcatggtggctcatgcctataatcccagcattttgggaggccgaggcgggtggatcacctgaggtcaggagttcgagaccagcctggccaaaatggtgaaaccccatctctactaaaaatgcaaaaattagcagagcgtgggggtgtgttcctatagtcccagctactcaggaggttgagacacgagaattgcttgaacccgggaggaggaggctgcagtgagctgaaatctcaccactgcactccagcctgggtgacagagtgagactgcttctcaaaaaaaaaaaaaaaaaaattgtgcttgcctcatacatgtaagcatttatcctgttagagcacctgtgtaggtgctcaataaatattagctgctagtgttattaccatatttttgtgcaaatacgtaaacatctggtggcaaccaggaatgtgtgcctctcagatctcctacactggggaggggagggtaattgactcctgaccccagctctgaatctaacaccttgttcacactgaggtcacactttccacagactgctcctagtcaatgactgggcaggacagacccacttccatgagatgttttactcctctagtgggtgactttggcttaaagactctcactgcacactgctaagtccctcattctcccttctccctcctaaaggagggataataattagggtccctcctaaaggagggataataaattagggtcacacctgcatttgatctcttagctctcccagactcctccggcttccttcccattttctatcatgggcgtttcccccagtacatctctcgcatgtctgatcctgttttggtgtctgtttctcacagtatctgagctaagacaacatctaacagttactgatatagtctcttccagccatgaggttaatacaacttctttaggacttggcaaaggttctgacataggaccccttctatgtggaagataagtgttactaatcttaattttttttgtatttgctgataccacagcatatgatagttacttgtctgacttccagacacattctattttttgattttgaatgaatcctgataaacttatttttatttgaatataactagtgagccttccaaacccaattctattctaggaaatattgctgtttacagtaagttagcagaaattctcttagggccttaaagtgtttggttgctgcagaaaggaaatgaaataaaataggtgttaaactgacttcctaaatctttggaaactaggtttataatacataaaactggtcactttgaaatgattatgggccaggtgcggtggctcatgcctgtaatcccagcattttggaaggctgaggcgggcagatcacttgaggtcaggagttcgagaccagcttggccaacatggtgaaaccctgtctctactaaaaatatgaaaaatagctgggcatggtggtgcgcacctggagtcccagctacttgggaggctgaggcatgagaatcgcttgaacccgggaggcagaggttgcagtccactgagatcacgccagtgcactccagcctgggcgacagagcaagactctgtctcaaaataataataataaataaataaaataattatgaacatgttcacaaagtcacctctttctttccttttcctccccctacccttctccttccttttcttcctccctgaataccttctctatataaagccaggcatgaatatatgaatataaagcatccctccccacaggaaacttacacagtagatgggagatgggacatattcataaatgaccataacataaaaagacagtataataagtaaagagtatgtgacctatatggttctagagccagcagctatcttggccttttctcagtttggtcagcagcttctcagtcatggaagggacagcagttcccttggtagcctagttctggaatgggccttttgggagttgttcctggaaggtcgatctagatttttttccttttccaaagattctgtaacctatttaatacatgtaataaataaatatctttttgttggggggaaaaaagagccagtaagttctaagccatgttgttcccaacccttgcctacctccatttctccaaagtaaattgcagagtgatgtcagtgttattctggggttttaagatagctttaaaatttttgactttgtttatcatttatatattcaagtaatgttaaaatctttattccaaatgctattcagaagttggggatcacttttatttgcacaaatgcaatatgtgctaaatgaataattctaggaggccgagtagataaattgaagttttaaaaataatagtagagcaggccgggagcagtggctcaacgcctgtaatcccagcactttgggaggccaaggcgggtggatcacgaggtcaggagatcgagaccatcctggctaacacggtgaaaccctgtctctactaaaaatacaaaaaattagccgggcgtggtggcaggcgcctgtagtcccagctactcgcgaggctgaggcaggagaatggtgtgaacccgggaggcggagcttgcagtgagccgagattgcaccacggcactccagcctgggcgacagagcgagactccatctcaaaaataagtaaataaataaaaataatagtagagcagaagagacatgatccattatcctatttctggttcatcatcctatttatgtccttcatagcacttatcagagttatcttgtgtacctacttgtatacttggttattgtctgtttcttattagaatgtgagccatgagggcaggccttttctctctaaaatctagcacaatgcttggcccaaatgaagtgctcagttgttgaatgaatggtctactttaagtaacagaataaattttaaaataaatgggagaaaggaatccagttcaacaaatagttactgaattcctaacatgtgagagaaactatgtttttccccccttccatgaatgaaaaaggatgattaaatctgctctggatcttttcggttttaactctgatttatacctaaagttaatttcttggttgataccatagtttctgtgtttgggttacataacattaaaatttaatccattttgtaaaaccaatattttaaaaaggaaggagattttctacaattttggagcatctcaatgagatcctgtcctttagttggacagagtgatatgctttgattaagactggaattacccttgtaaactaatctctgggtcctctttctgtgttgggatcacccttacactacttccctaggggccttaggaaatagctcattctatgattggaatttcaagtcaaaacacatttatctgagcagaattttaatgatttatcaaagagaggagggattttcccaaacacaactgaacttacaaattactgatcccactagctatgttttttcttaagcacctttctttaaacaaagcaattactgctgaaatcatcaaatgtatttttttcatggaaagcttttgactaagttttgtttgattagcaggaacctactaaaagtaaatattgtttgagacagcactttcagagcctgttctttttcttcattcaattagcttttaaagcactattctttggagaaagtaagagccttttttccagctgtcctattgtgtaactcaaggtctcgttaatactattatctagccccgagattacaggtaattgtgataaaacacaagcttcagtttctgtaatctcagacagaaatctgcttgtgccccaggacttcagatcaggtgttttttaaattcagacttctctcacctgggacagtcccattggcccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaaaaataatttagcccttgggcacctagacgaaacttaagtagtccaatttagagaaatgataacaataaacttcataaacagtgaacacatgagcttaaacagcaagcatgactccagtcctttttggaatgcgatgcattgaaagatggctatagagaaaactagaagctccacacgtcagttatgtgcagttaagccttgagtccatggtctagtgttaatctcaagagtacattctagttagtggataaaatacaggctaccatgtgagtaagtcattaagctccttgagccacagcatttcacctataaaagtgggaaaggtaatattgccacctacctcacaggaatgaaagatgattgagaagataaacttgtggagttccttatagggaaggtattttgtaaatagaaaacactgttattattctccttgatcaaatttccccaacaaatggagttgataaaagctacctcacagagggttgagaggctgaattaattaatatacgtctagtatcttaagagtaaactatttaatgaaacctaaaattgattgtctttcttgatagtctatgaactaccagacctgctgtttagaaacatgattgtcttctaaagtctcacatatgcagtctttgccttctcttcaagggttggcacgataaagaatagtgaatgtacaggcaaaagataggctaaatcttcagggagaacagccttgccttttttcttttcaagggtatatttacaaatagcctttggagtcttgctaatctttgttaccatgcctgaacatagggactgttttgacctttgttcttccaataaatatttatttttgatatcatatttctaaatgagaaacaaacttagaaggaaaagaagtggttgaatttgtctcacattataaattttttcttatctttcctaggatggtaagagaaaataacttttttttttttttttgagacagagtttcgctccatcacccaggctggagtgcaatggcacaatctcagctcactgcaacctctgcctcctgggttcatgcaatcaattctcatgcctcagcctcccgagtagctggaattataggtgcatgccaccatgcctggctaatttttgtatttttagtagagatgggggtttcgccatgttggccaggctggtctcaaactcctgatctcaagtgatcctcccgcctcggcctccccaaatgctgggattacaagcatgagccaccgtgcccggcctgaaaataactattattgaaggaccagacatcaggctctccaactggaaagttctcaaacttagccaagtgattaaaaacagctttggctgttcagaatttaatcttttgttttcaattacagttagtagtatttgggtaacttcatttcccagatttcatttgctgttaggtgacacaaaaaggggaaagactttttcttttctttttttttttttttgagatggagtctcgctctgtcgcccaggctggagtgcagtggcgtgatcttggctcactgcaagctccgcctcccaggttcacgccattctcctgcctcagcctcccgagtagctaggactacaggcgcccgccacctcgcccagctaattttttgtatttttagtagagacggagtttcaccgtgttagccaggatggtctcgatctcctgaccttgtgatccgcctgcctcggcctcccaaagtgctgggattacaggcatgagccaccgcgcccggcctaaagactttcttttaaattctaatcccttaggcagggatcatgtctcatatatatattttttaatacagagataatatttcaacttttaagtagtacagctgcctaaatactgtcttaagtagaaactgttttcttttttccttttttctttttttgaggtggagtctcactttgttgcccaggctggagtgcaatggcccgatctcggctcactgcaacctccacctcccgggttcaagcaattctcctgcctcagcctcccgagtagctgggattataggcgcctgctatcacgcctggctaatttttgtatttttagtagagacagggtttcaccatattggccaggctggtctgttggtcagggtggtcttgaactcctgacctcatgagccacccgcctcagcctcccaaaatgctgggattacagccatgagccaccaggcctggcctggaaactgttttcaaataggtgttcttcatatgccatctagagtaattctcatatgcaggaggactgaaggagacagcagtctcgttcagtcctcacagcaggtagacaccagctgatcccacttttctttgaggaaactgggatttaagttatataacttgtccaaggtcactgagctagtatgtctggagctgaagtttgaatgaagtttatctgactctaaagccagtagtattgttagccactttctttcaggttttgtaatttctaagagccttctttcccattcagttcaataaaaatttaagtgtcagaacttaaattcagtagaaaattctacagaatatatgatatattccttagactctttttttttttttttttttgagacaaggtctcactctgtcatccaggctgaagtgcagtggcatgatcatggctcagtgtagcctcgacctcctgagctcaggtgatcctcccacctcagcctcccaggtagctgggactataggagtgtgctaccatgcctagctaatttttaaattctttgtttgttatgttgcccaggctggtctcgaactcctgggctcaggtgatccacccgccttggcctcccacagtgctgagattacagacgtgagccaccataccctgccagattgttttaatatatagaagataatttaacattttcttggtgaggtagtgtcattattttagacctaatttattatattgtgctataaatgtgttataacagttacccatgaagatggatgttattttttttatgcatgagaagaaatggtggctcaaataacttaagtaaattttccatttatatagatagcagttagtgaagctgttatttgattctaattcttctaatttgaaattaagtggtttaggtgccactcagtgttaaattctaatttatagctattaattaataagaagacatctccctgctcccacaccagtacttaccattcccttctctccagactaatgtttcctactgagtcagtaagctgttgaggtctactgaggtttgtttggcgcttcaggtggtttggtgctcctaatctctcagggtattagggtgagggctgagctggtgttataaaaacaaaacaaaacaaaaaacctccaccacttaactccccctccctcccagtgcaatggctcatacaagaagcactttctttctttcttacttaatccaaatccaggatgtgaaaggcagggtctgctttaggaagtcatcattggatttcagctagcagagcagtcattctgtctgaaacacatggtttccaaagctgcctcaattgtagccattttcagccagtaaaaggggaaacagtgaatccagggcaaggaccttttaggcaagtgaagccgaagatgcaaacatcacttgtgctcacatttcataggtgagaacttaataaggtccctgctaactgccaacgaggcagggaattttagtctaatggacagtcgtgtgcaagaagaatggcagtgtatttttggtggtacacaaacaaaaatctgtcatacctagtatatgcggtggagacatctaccctactcaaggcaagttgtattgttggtagctgcttgcccttattcacaggtgaagcatagatgtgctggtcagtatttggtttttgtcctctacctcttgaagtacaaagttattttatccttggtccctgtctctgagttcagttgctccctttttacaatggttattattttctttcttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcataagtaagaattttctcaattaggaagaattcccaagtgagaaatcaggtcttaaggtgatcttaaaaccgcttcacatggcgtaattaaatttgaacaacagaggtgggaagtaagggtgatgaaggacatggttaaacttagaaatggagctagaaattggtgttctttacctgatgacctcttctttgtctgaagtaagaatcaagattatcttcttagagttagggaagcagaagtaaaaggcttgaggagagcaaagaaagtttgtattagctactgggggaaagaagaaagatagctcgactagggccaagtacaagtattctgagctacattaaagcatgtgaagtaaggctgcataaatcattttaaaaaaagaagtaactaagaatgctaacaggagcaaagttgactatgggaattggtaaaagaaaaaatacaaaagcattacaaaataataattagaagaaacagttgaaaaactcttttaggaaaacatgatgtcacaaataatgcataagaagagggaggattcggctggatgcagtagcttatgcctataatcctagcacgttgggaggctgaggctggtggatcacttgaggtcaggagttcgagaccagcctggccaatgtggtgaaaccccatttctactaaaaatacaaaatttggttgggtatggtggcaggtgcctataattccggctaccctggaggctgaggcaggagaatcgcttgaaccctggaggcagaggtggcagtgagccgagatcgtaccactgcacttcagcctgggcgacacagtgagactctgttttgaaaaaataaataaataaataaaaaataaaataaaaaagaagagggagaatccagagagcgcaaaattccacttcttccattgaagaaagttcaaagaattgctggatttaaagtttttgatgtttatgtttcttaactacagaattttaaaaatcaaatgggtctataagagttataacaaaaaaaagcagtaccctacaccataaccttctcaccccgaagtctcactcctcagaggaggccattttctttcttttttttttttttgagtaccagtaagtctttatttattcattgtattttcccagggaaaggagaagggaagggaagagtcagcatgtgttaaaaaatgatgagaaaatgggaaaggaagtacccagtacagcaaaatcaaccgtcaaataaacacaccccagtgatggggtcaccaaagcccaaaggggctcagtctcctgcagttcaggaatgagggaaaaggatcaggaaaaaaacagacaggtacaggctttcctaccctccctccccataaattcaagattttacacaaagctttggtttctagcagtaaacatggagttacattcattcatctcctattaaacaatcttgtggccactttgacataagtttctaccacctgcataaaagttcctgagtgacttggatatacattcatattccctttcttggcctcctgaccccactttctacatggaaggcccccaattgcatctctttactttaggattagaaattaaaagtaagtaggtttgatccatccaaaatacagtagtgtggttttttttttgttgtttttttgttttttttttttcgagacagggtcttgctctgtaaccaggctggagtgcagtggtgcgatctcagctcactgcaacctccgccttccaggttaaagcgattcccccgcctcagcctcctgaatagccgggaccacaggtatgcgccaccacacctggctaatttttttgtatttcagcagagacggggtttcaccgtgttggccaggatggttttgaactcctgaccttgtgattcgcccgcctcagccttccaaagtgctgggactacaggtgtgagccactgcgcccaggctacagcagtgtcttaagtgtttggcatgaatacatgaagaaatggtcggcctagcgtggtggctcatgcctgcaatcctagtaccctgggaagccaaggtgggcagatcacctgaggtcaggagttccagaccagcctggacaacacggtgaaaccccgtctctactaaaaataaaaaaattagctgggcgcggcgggtgcctgaaatcccagctactcaggaggctgaggcaggagaatcgcccgaacccaagaggcagaggctgcagtgagccgatcatgccactgcactccagcctgggcgacagagcgagactccatccacccccccccccccaccaaaaaaagaaagaaatggtaatggtcttgacttaggaggttgggaacaagggatggagggttttcctagcttcaggatttttgcatacatcatttaagagttgtggagacactccaagcattaaatgtgtatgtgtgtgggtgtgtaagttttcttttgggggtgaacagaaaagagggcagggtagaagacaagtttttaggacagaagatctggtctaataggtaataggggaaggggaatacaaaagaaaggatggttcaagatccccactttaagaagcgggccccccaaactaatgtttcagatctttttgcctggtgcagaaacttctgtcaaagatgctttggctatttttctctcaatacaaaaagaactttgtaaacaaaacccccaaagaacacggaggaagaccaatacattatatttacacaaactaggccacctagcaatcaacttagtgaagtcctacaaagcccagacaaatacagtaacttggggggcagcatttaggggagacaagaacccaggatcagacacacaccacccaatgcgttctattgtatttgtcccgtttcaacacagtgaggtaggtttgcggtgatctcacagcatgtaaacgaaaccccctttttcgaggaggccattttcaaatttttcagcattaaaaacaatttttttttgctgtgtactttaaaataacatgcttaaattgctcttcttgatttttcagttttagatattatttaatgactttatattatagaagatgaggatttaggtctcttatactactcaatttcccttcttcctagtcttccaacaaaattattataatttttggttaaatcaatattcagtgtttattatgactgtgaaaattatacatatgtatgcacgtatacatagtatatatgtatatatatatacacacagtatacaacatatatatgtaaaatatatataatatagtatactatgattacatttctcctttttgaacattttttttcattttcctgcaattaataattgcctttccttttgtgcatggttttcgatgaacttgtgccccagactttatagcctaaggtcagttcaaacacatcaggcatcctctcagtttcaatttcttttcttcaaggtaacttttctgaagtacttcttcatctaactggtccccctgcttcagtctggcctggttgctctctaaatccttcatctttatcatgggtattacttcattcttcatccttacatggatattacttgtcttgcttaagtaagttttagtgcatatttcctaaagcctatgtcttcctttttccttacatgttccttctttttattagattgcatcctctagtagctttctgagaaagggtgcatgcaaagtaatattttagggaatcttctgtttatgaaaatgactttatactacccttacccttgattgatagtttagatacatataaaattctgtgttggagataattttcccttagaatttttaaagcatttctcccctatcttttagctttctgtattgctattgagtgatctaatgccattctgatttgtgatatttcatgtagttttacattggtgtggatcttctttcattgtcttgagatcctttcagtgtagaaattcatgtatatcagttctgagaagttttcttgaattatgtgtttaatattgtctcatctctgttctatctctggaactgttgttacttagacattggacttatggatttatgctctaatttttcttgttttctcttttctgtcttttttgatttttgtatgttatatgaatatccttaacctttccaatccttttgttgaatatcaaaaatatctattgtattagccagagttccccagaaaaactgaactaataggatatgtaaagacctagatacatagctatatagatatacagctgacccttgaacaacatggatttgaattgtgtgatccacttatacacagattttctttgccacctctgagacagtaagatcaaccccctccatttctacctcctcagcctattcagtgtgaaaacaacgatgaagacctttataatgaatgatctacttccacttaatgaatagtaaatatattttctccttgtgattttcttttttttaaattttaaattattattattgtagagatgggatcttgctttgttgtccaggctggtcttgaactcctggcttcaagtgattctcctgccttggcctcccacagtgttgggattacaggcatgagccaccacgcctggccccataattttcttaacattttcttttccctagcttactttattgtaagaatacagtatataatacatatacaaaatatgtgctaattgactgtttatgttattggtaacgctgtcagtcaaatattggctattaatagttatgttttgggggagtccaaagttatatgtggatattttttcttttctttttatagagatagagtctcgctatattgtccaggctggtcttgaactcctgggttcaagcattcctccctccttgaagtcccaatgtgctggggttacaagtgtgagccactatacccaggccccactttgttaaagggtcagctgtatagatttattatgggaattggctgacatgactatggaggctgagaagtcccaccatttgtgcctgcaaggtagagaaccaggaaagccagtggtgtagttccgtctgagttcataggcttgagaaggtagggtgaggaggagcagtgtgctggtataagttccagagtctgaaagcctgagaaccagaagccttggtgtcccagggcaagatgagagggagaatttgcctttcccctctgccttttgttctgcgtgggccctcattgggttagatggtgcccacccacattggtgaaggtgaatcttctttattcaatctactcattcaaatgctagtctctgccagaaagtctatcacaaacacaaccagaaatgatgttttaccagctatctgggcatcccttagcccaatcaagttgacataaaaaaattcaattatggtagatttgatgatttaaatttctactccatttaaaaaagtttgttgaattcctaaatataagatttaatcttgcctttctgagaatattaattgtagagtttcttttttgttgttgttttattggtttttttttttgcatgtgaatgtcgtctacattttctttttctcctgagttctttttttctagtttttaaatgtgtttttcatatacagacttttctcaagtttttgaagctacttgtttaggaaagggtcttacagatcaatatatagagttttatgtaatattcctgtttttagtagggcacctctgtcttcaaactattcttggtgttcccaagttcaacatccttctgattcaacttctcaatagagaataaacctttaattttaaacctgggtggaggaggagtagtaactttactatgtaaggttgggaagaggatctagaaatataactgcttcttatgtagacttttaacccaattttccatttttacctttacttactcccacggctttagaggtgcctgatacctactgttcctaagcctttctgatgttgtataagagggtgtgcttgttttttgttctcttttctcagtatagccacttaagttttagctttttttctgttcatacaataagttgtgtgtctaatttccattttccaaaatttttaacatttcttatctgctgccatcttaacttcaactctatttttataaatctatgtcttcttttatttagatatgcttagcacaccaattcagtggggtttaaataatttttttttttttttttttgagatggagtctttctctgtaacccaggctggaatgcaatggtgcgatttcggctcactgcaacctccacctcccaggttcaagcaattcttctgccttagcttcccgagtagctgggattacaggcacatgccaccatacctggctaatttttgtatttttagtagagacagcgtttcaccatgctggccaggctggtctcgaacacccaacttcaggcaatctgcctaacttggctttccaaagtgctgggattataggcgtgagccactgcactgggcctaaataattttttgaaagacacagagtctcaatatattgcccaggctgatcttgaactcctgggctcaagtgattctcttgcctcagtttcctgtgtaggtgagattttttagtatactatgcatgacgccacaatgcctggcattttttagtgtactcacaaggttatgtaactaccaccatgatataattgcagaacatttttatcaacccataaagaaacttcataccaattagcagccactcccattttactttccccgcaacccctggcaaccactaatctaatttttgtctctatgaatttgcttattctagatattgcatacaaatgataattattatacaatatggggtttattgtgtctggcttctttcacttagcataatgtttttaagattcatcgatgtttgctgggcgcggtggctaacccagcactttgggaggccgaggtgggtaaatgacctgaggtcaggagttcgagaccagcctggccaacatggtgaaaccccgtctctactaaaaatacaaaaaattagccaggcatggtggcgggtgcctgtaatctcagcaactcaggagtctgaggcaggagaactgcttgaatccagtaggcagaggttgcagtgagccaagatcgtgccactgcactccagcctgggcaacaagagcgaaactctgtctcaaaaaaaagaaaaaaaaaaagattcatcaattgttgtagggtatttcagcacttcattcctgttgtggctaaataatgtttgattgtatgggtacatcacattttgtttattcattcatcacttgatggacctttggattattttcactacttggattttatgaaaatactgctgtgaacatctgtatacaagtttttgttcgaacaccttttttcatttcttttaagcatatacctaggcgtggaatttctaggtcatttggtaactctatgtttaactttttaaaggattgccaaactttttcaaagcagctgctccattttacccaccagcagtatatgagggttctaatttctccatatcctttccaacacttgttgttgttgccttttttattatagccatcctagtgcatgtgaagtagtatctcattgtgggtttgttttgcatttccctaatgattaatgatgttgagtgtcttttcatgtgtttttggccaagggtttgtcttcttggagaaatgtctactcaaatcttttgcctctttttaattgggttgaggttaagatggcagtttagatctggactgttgaattgtaacagtctttacatattctggatactagacccttatagatatatgatttgcaaatattttctcccatcttgtgggttgtctttttactttcttggtagtgtcctttggagtacagtttttaattttgatgaagtccaatttattttttctttggatatttatgctttaggtgttatatctaagaaatggttacctaaaccaagttcacaaaactttgtacctattttttattctaagagttttatagtattagcttttacatttaggtttttgatccattttaaaatggcttgaggtaggagtcaaaaatcatttttttacatatgagtatccagttgtcccagcaccatttaaaaaaaagactgttctttccccattgagtgtttttggcactgtattagtccattctcacactgctaataaagacatacccaagactggataatttataaaggaaaaaggtttaattgattcacagttcagcatggctggggaggcctcaggaagtttacaatcatggcagaagaggaagcaaacacgtccttcacatgataggagcaaggagaagtgctgagcaaaagggggaaaagtcccttataaaaccatcagatcttgtgagaagtctctcactatcacaagaacagcatggaggtaatcacccccatgattcagttaccccactgggtcccttccatgacacgtggggattatgggaactacagttcaagatgagatttgggtggggacacagccaagccatatcaggcacttacgtcaaaaatcaatttgctataaaatataagggtttatttatagactctcaattatatttcattggtttctatgtctgccttatgccagtaccacacagtcttggttactgtagctttgaataagttttgaaattgggaatgtgaatcctacaaatttgttcttctttttcgagattgttttggttattctgggtcttttgcatttccttatgaattttaggatcagcttgtcagtttctctccaaaaagccagctgggattttgatagggattgtattgatattgtaggtcagtttgtggagtgtgccatttaacaatattaagtctaacaacctacgaacatggagtgtctttcctattatttaggcctttaatttctttcaacaatgttctatagttttcattgtataagtcttatacttctttgttaaatgtgttcttaagtatttcatttttatattatcatagttagcactgttttctctatttcacctttgaattgttcattgctcatatatagaaatatagtgccagcctgggcaacatggcgaaaccccatctctactaaaaatacaaaaaattacctgggcttgatggtgctcacctgtagtcccagctattcaggaagctaaggtgggagaatcacctgaacctaggaagctgaggctgcagggagccgtgttcacattactgcactccagcctgggcaacgggagtgagaccctgtccaaaaaggaaaaatgatcttgtatctttcaacattgctgaactagtatattagctctaatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggagttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggagggaaaaaaagaaaacacatttaagctgatacatttaactgcaagatacaaagagattttaaaaaagatattaggggccgggcgcgagaaggcctggatgggcagaccatatgaggccaggagttcgagaccagcctggccaacatggtgaaacccgtctatactaaaaatacaaaaaaaattagctgggtgtggtgcacacacctgtaatcccagctactccggaggctgaggcatgagaatcgtttgaaccctggagataaaggttgcagtgagctgagatcacgccattgcactccatcctgggcaacagagtgagactctgtatcaaaaaaaaaaaaaaaagatattagaaactaatgtagtttgtttgaagttggtcatagctagaccaactagctatgaccaattactagaccatagctagaccatagtttaagaaatttggaaatttagaaaagataactgcttgatcatgctaaaacacctaattcattatttttaaatgtataattaaaataataaataacaacctattatccctcaaagaaaaaggaaaagtataggtttttattcgatgactcagcagttttctatctggtctcgttaccttcaattctttctctttatttctatcagagctatctttctaaaacctaaactggatctggttaaaatctttcactaactccccatgttagcatggcatacaaaccttgtgatatggcagcttttttccctccgtctagcacaattcttccatcaaactgttttctctagctatgctgaacaatgtacagttccagaattcacagtgtcttctctctctctctcttttttttttttttgaaatggagtctcgctctgtcacccaggctggagtgcagtgacgcgatttcggctcactggaagctccgcctcccgggttcacgccattctcctgccttagcctcccgagtagctgggactataggcgcccgcctccacgcctgactaatattttgtatttttagtagagacggggtttcactgtgttagccaggatggtcttgatctcctgacctcgtgatccgcccgcctcggccccccagagtgctgggattacaggcgtgagccaccgcgcctggcccacagtgctttctcttatctctgggccttaatacggactgttttgtttacttagaactgtaattctcaaactttttggtttcaggatctctttacacttttaaaaataattgaggatttcattgagctttaggtaggatatatctatcaaattgttactgaaactctaggggtttggtataggtcccattgcttgcccctcagaaagctgatcactgagactacgagtattgccagggaacaaggctttaatcgggtgctgaagctgaggacatgggagatcagtcccaaattcatctcccgggactgactaaaattgggggtttctatagcagggaagaaacgtaaccatgtgtgggaaaacaggaattagggagggctaaggaaaaggaattggttagtaggaagcagatggttggacaggtaatcatgacaggtgagtgcacaaattttaagactgggggggtcgatttctatgtttattcaaagaaaccataaacatcagttctatgggacaagtggactactttcaaaatactttcaaaatgttactatatttgaatttaaaacagaaaatttaaacattaattcatttaaaataacaataatcagcctatagcatattaacacaaacagcttttttttttttatttttttttggagacagagtctggctctgtcgctcgggctggaatgcagtggtgcaatctcgggtaactctacctcctcctcccgggttcaagcgattcttcttcctcagcctcctgagtagctgggattacaggcatgcaccaccacgcccagctaatttttgtatttttagtagagatggggttttgccatgttggtcaggctggtcttgaactcctgacctaaagtgatctgcccgcctgggcctcccaaagtgttaggattacaggcatgagccaccgtgcctggcctaaagagcatttttattaaaaatattttctaaaaaccaaaataattagtgacaatagtagcattgttttacacttttgcatatctttttaatctctagcttagtaatagaagacagatgaattctcatatttgcttttgcattcagactgttacaaaatgttgctttagttgaagaatatgaaggaagtctatccttacacagatacgtagttcaaaaaacaggaatattttaaattgccttttcaggtatttatttcaccaaaactagagaaatagtagtttcttacaggttagttgcattgtgaaatctaaaactacatcagtgaacttttcagagtcttttatattaaagttcacaggtctatgtgcactacgaaaggacattttaccctcgtatgatttatgcagaaaatggtgcttcacttaagtatagcaggtcttccaaatgtgtatttcatgatacagtatcaaaagatcacgttcattaatatcaccacagatcttatcagaaaagtcttttttttgtttgtttgtttgagatggaatcttgctgtgtcaccaggctggagttcagtggcgtgatcttggctcactgcaacctctacctcccgggttcaagtgattctcctgcctcagcctcccaagtagctgggactacagacgtgcgccaccatgcccagctaatttttgtatttttagtagagacggggtttcaccatgttggccaggatggtctcgatctcttgacctcgtgatctgcctgcctcggcctcccaaagtgttgggattacaggcgtgagccaccgcgcctggcccagaaaagtctttaagaatcgagaagctctcaggctcatggatgaagtatgttttcctcctttttttcccatactgcacagatgtagagttttccaaaattttaatttttcatgtgaaagcttgactttttatcactgataacaaatactatcacttgttttccttgaagtaacaggctcattttgttcatttttgagaaaatttctgccaaatacccaagtctgaacaaccaggatttgtgcattagttctttcaagtaaaaatggtgttttataaaaaaaaaacagctagttgagcttgcatgtcaaataatcttccagtgcttttctttaagacaactttcatgcttttgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcctggcaaaaaataatcttaaaataggaaactatattattatttataactatattattatatattattattaactatattattatcgagacaacatttcaacaaatttagttcaaatatcaaattaacttttattaatgattcatgaacagggcagtatctcctctaaaaatttagaaaaggggctccggtgagctgagtggaggagattggctttataggtagggaagggcggaagaaagcagaaacaagaaactgaagcagattggttgttttgaagttactttccttgtagggtcagaacagaggagacttcttttcatgctggctgaaactggcccatttggagatttggctgttatctctcttgacttctcagaaggtcagataactgacttagttttagtttggtgacctggagctttagcctgagtgactccattttggtttagtctactggggcctagcgcaggaactcagttgaaatcaaaggccttctataaattttatttaacactattttaagatacaagcaaaaatgtaaacatccctcaatacaattctagcaaatggcataaatatatatatatttaattaatatatataatatataattatatataatatttaatatatttaaataatatatttaatatattattaaaataaatatatatacatatatatgtttatcccagaaatagaccagtcttatctataatattatttataagaaaatgataactggaattacccataggagcacattagtagacattcaaagccttttgataaaattatctaattttttttagtatctaatcttgatcacccccccgaacaattaaaaatagagtgtttctgctgggcgcagtggctcacagctgtaatcccagcactttgggcggctgaggcaggtggatcacgaggtcaggagttcgagaccagcctgaccaacatggtgacaccccgtctctactaaaaatacaaaaattagccgggtgtgatggtgtgtgcctgtaatcccagctactcaggaggctgaggcaggagaatcgcttgaacccggggggcggaggttgcagtgagccgagatcgtgccactgcattccagcctgggcaacagagtgagattctgtctcaataataataataaaaaaaagagtgtttctaacttttgttaatgtcttcatttacaaccaagagaagcattagggttatatttcttgaaaaataagaaaaagaaacactgttcttaggcctctagaatcctctagaaccactgttcgtttttatactattggatattcttgtcttacagaaagaccagatctgaacattttttttaaaaagatgaatataggtccccatgactcccacggcaacactgagtggccttgttctacctggctcactttgctaatacagtggggttttttttctttctcttctgtccttatgtgtaaggcagaatacaagggcctgaagcccccgcccctcctgcatttgacaacagggttggacattgtgtattgagtttttttgtttacattgttctgattaaagtatgcaaaataaaaagatgcagttttatataacagaagatggatatagaaacattataaatggtaaaagcttttataattgtttgctgatgagaatatgaaatgatatattttggaaaattgtttggcagtatataaagctgaacctatgtataccctgtgacccagttattcacttctaggcacagaaacaagggaagtgtggacatatgtttaccaaaaaactcatactagaatgctcgtagtggcactattcataataggtccagattatgggaaactggaactaaagaaaacaaatgccgtcaacagtggaactgataaataaattgtggtatattcaacaatggactgttattctgtaatgagattgaacaatgggatattatgctgcaatgagaattaatgaacagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaaattttaaactatatataaaggagaaaggtaagttaactaaatattcacatttaccaataaataaaccactggaaataagatacttttgagttagttaaaacacagaactttatattgggacatctgcaaggaaattggtctcttccgtttcttggatgtaatataatctggtgtaatctttctggaaagtaatctgacaatacataacaggagccataaaaatgagcatatcttttgatcctagagccttacttctgggaatataccctaaggaagtaactcaaaagagaaaagaaatttgcttgtgcaaatatatttatagccacattattttaagcagaaaactgaaaataatccaaaaagaattctgtatttaagcaatattttaaaatgcagtaatacattgatcttctaattttttttttttaagtattgctgggtgcagtggctcacgccagtaatctcaaccctttgggaggccaaggcaggaggatcgcttgagcctaggagtttgagaccaccctgggcaacacagtgagaccctgtctctgcaaaaactttttaaaaattaggcaggtgtggtggtgtggcacttgtggtcctagctacttgggaggctgagataggagaatagtgagagcctgggaggttgaggctgcagtgagccgtgattgtgccactgcacttcagcaagcaacacagcgagaccttgtctcaaaaagaaaaaagctaggtgacctaataagattgccatcagcttcatccttttataatgtcaaaaaaatgaaattaaaagtaaagtttcttttatcttttccctatagtaccattcaaattcttctgctcagtttaacatttttcttcaacttggtccctctaacaagactttttactgggtcattttgttttggaaagacaaagtatgaatttagagaagtagaagagagtatagtaattttttctccttatctatttatagtaaacattatagaagcaaaatatttacttacacttaatcaggtttccaaattgtcctggagagtagaatatcctcctccatgatctagtgaggaggttaagttggaggttaaataccttgcataataccccaaagagataggacagggattagagaccaggtcttatataatgagacccccttgctagggttgttgagcattggtgcctgtctgtgggatggcagtgcagggctgggatcaattctctgtttaagagcaagtctgaaggtcagttctttcctttttgagctgggctatttgagcggtacagtgtacactttctgaagagatttctggaagcaattgcagaagtttcttatacagggtagaatctgacctaagctgtccaaagagaaatggcccttagagagaagttgtgcttcccctttgctacctcatattttatgtgctgcctctcatttgttccttttcctctctagttcaaaatgcaggatctgagaaggagacggagctgtcatcagttctaaacctgaacagaatgtttcctcagttagtaaatggaaaaattattttaaaaaatcttcatgtatgtttgtgaaataccaagacattgatttgtggtctagtttgcaatcatgataattatattaattagtaccaatcatgatcattttaaactttctgaatttctctatcctaattctgtgattcagtggaaaatatttatactcaagagattaaggttcaattttctgccctaccacttaacaactgtgtgaccttgggcagtttcttcactggtaatatggagataataatcccagccttatctgactcctaggtttgttgtaaggttcaatgagataatgtatgtgaaagtattcggtaaactttcaagagcaatacaaatgtttttgttgaagttatgaaagtcattaccctgtttaaaacacagtaagcactgaagatgtcagtacgtctcttaagattctaaaatagtgtcaagaaatgttctatcctatcctagcatgcgctaacctaggtctgtgaataggccaaggagccctctccttggttgattggttgcttgccagatatattagtttgatctcttcatttatactttctggaaaatatatggatgctttatgttaggtttgtctgcatacaacagagaaacctaaaataccgtggtttaaacaagatagaagattatttctctttcatggaaaacaagtctgaaaataggcagtccacagctggtagagtatactccagggtttcatcaggactcaagcatatatttttctgtgccaacatcctcaccatagaatccattctttacctcatgacccatgaggactgaaggaactcctttttatccattgggataaataaaggatatctcaactgaatcagtcccatttaagtactttctagaaaatccacacagtattttgcttacattttataactgagtcacatgactaaagactagctacaagagaagctgagaaatataatctttatgccagtgaccatgaacccaggtatgtatactggagggtgtatgtgtgtgtgtgtgtgtgtctgtgtgtgtctgtgtgtctgtgtgtgttgaagagggtaatttataaccaaaaacattcatatttttatataatgctgtggcagagacttcaagttgcaaacttcaatggcttcttcttccttagaaacgtacttgcagttttggccagtcatggtggctcacacctgtaatcccagtgctttgggaaactgaggtgggaagattgcttgaggctggaagtttgagactaccctgggcaacatagcaagaccctgtctctaccaaaaaacaaaaacaaaaaattaaactgggtttggtggtgcacacctgtagtcccagctactccagggggctgaggcaggaggattccttgagcccagctgtggaggttgcgatgagctatgattgcaccacactgcactccactgtgggcaacagagcaagaccttgtctcaaaaatgaaacaggcctggcgcagtggctcacgcctgtaatcccagcactttggaaggccgaggcgggcagatcgcttgaggtcaagagttcgagaccagcctgtccaagatggtgcaaccccgtctctactaaaaatacaaaaattatccaggcgtggtgccaggcgcctgtaatcccagctacttgggaggctgaggcaggagaatcacttgaatctgggagcagaggttgcagtgagcagagaccttgccattgcactccagcctgggcaaaagagcgagactctgtctcaaaaaaaaaaaaaaaagaaagaaaaagaaacaggccaggcatggtgactaacacctgtaatcccagcactttgggaggccgaggtgggtggttcacttgagatcaggagtttgagaccagcctggccaacatggtgaaaccccatctataccaaaaaacaaaacaaaacaaaacaaaaattagctgggtgtggtggtgtgcacctgtagtcccagctacttgggaggctgaggtgggaggctcgcttgaacctgggaggtagaggttgcagtgagctgagatcatgccactgcattccagtctgggtgacagagtgagactctatctcaaaacacacacacacacacacacacacacacacacacacacacacacacaatactccaatttttacctggagattcgagaaattagggaagaaaccaaagaaaatatatttccttataaaataaatattaaaataaagaaaaaaaagtctgggtgcagtggctcacacctgtaatcccagcactttggggaggctgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaggaaagaaaaatgagaggaaaaatgctagaaatacagggggtacattggtttaatttgaaccctcttatgtatatgtatctttagctccttttactttagcttttctcgtctctttggaaatgaaaatattcagttgttgccatgattttgcttgctttgtacaaatgaaatgttggctttatggttatagacagaaatatggaaaactttagagctactttgagcaagcccaagaactttgaatcattgaatcaagaggagaaaaaatgaagaaaatatttcaagttctttatctgtaaaatgatggagataaacaatatgatctgaaagtctttcaacttcttaagtttttataattcaggagcagtggtaagaatagtaatgaagtttctaactactacttccaagttaagtacaatccagagaggccagtgggacagaatctgtgggacgatgtgggaggacttaagtgattttaagtcctggtgaagaggaatagtgtgttcaatggaaattgaggaagacaaggacttttcaggtcagggggcttaatgggtcatcattgtgtttgttacagagttttaggagagtggtggagaaaaagatggagaaaaagaaaatggactatgtgctcctaggaagagagatgtgattgttttctaacatgtaggcaatgaaccctcagaggaactatagatgagcattagggtgttcttgaatgctctaaaattatatgcaacatattatattcgtttttctgtgagaaagcatttgtagctttaatcagattcttattgtaagctaacaaagccacttgctcttaaaaatgaataataaagactttaaatgattaaaaacagaaaaagtgacacttcagtggtcctgcagtgggtgaatatagtcattgtgatattttcagagtaagctaggtttcagtcacacacacacacacacacacacacacacagtacacacacacacacaatgagagaaatgtatagaatcgtggggaatttgctgtacagttttgggttttggcttgctattattagctgcaccttgggcatgttacagaacctccctaagcttcaatttcctctgctataaaataaggataaaagtaccttaaatggtggttgtgaaaattagagacaatgtaagttgagtacatagtacagtgcttggcacagaataggtatttggtaaccctttccccacatgagttttttaagtttctgtatttactttaaggcccttattgtatgcagtcatccatgagtatatgcagggggttagttccagggctctctgagtataccaaaatctgtgcatactcaagtcctgcagttggccctgtggaacccgaatctacgagaagttgaccctccctatacgtgtgttttgcttcctgagaatactgaagtttcgacctacatttggttggaaaaaaccctcacttttaagtggacccaagctattgaaatccgtattgttcaagggtcaatcgtatttcactttgaaggactggtcctcagcaagttcatcttctgaactactcagtgatgctcacactcaagaagaccatatcttattaagtggttagtttagaagctctttcccatgcagatttgcaagcggagtgtgtaaaaatcacacattgcacttgttgcctggcagcacgtgtccctgagtggtagtacatggcttgcattgtaatgttatcagtgctggggccagctggctagacatgtactgctacatgggctagggactccattcctcaacaaaacagcagccagcactagggttaacagaaaatgacaaaccaggaatggatgagggaggcgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactggccctgccatgcaagagcacaacagaacctttgttaggctttcagcaaagctgtttatgaacggtggcttactgaggactgcttcctgtgctgtgtgcttccattttgtctaaaaagaaaaaaagaaaatagttattaggagtaaaaagaatttggactttcttttattcaagtcctggatgttgaaatgacaagtagcccccaaatttgtgaggaactggtaattgcatcgaatgcattttttcgctttaccttgaacataatgaggctcttagtaacaatagaaggaacaagtgccttctcattggaatagagagaaggaacagtagtaaaaaggcaacagaaagagtagttgagaacaggacaaaagtggcttccagtaagaacactaacattgtaatagaatgtgttttgatatttagcgtttcccacctgggaggcacagtcctaaagtggttgagttgaataaagaacagcatcacagtttataaatagtggatacagtttgtatgttcattaagtaaatatttgaatgtctaccatgtgaaagacactgaatggtcctgagtgttaaaggaaataaaagataaatgagtcatggtgcctatctttaaggatcaggacatccaacaaagaagataacatacgcataacagaaataactgtgtatcaaggtagaaagtgccactggaaatatttaaaatagatgtttagggagtttgggaaaagggaagatcacttctggctgggacagaatcagggaaaggttcacaaagaaggtggcatttgagttgggcctggcagaaaaggtaggactgaacattgcaacattcctaaaagtgatgagtcaaaaattatgttgttctagtaaaacagatccaaagtatgtttttatagggtactttggtggtgtttttataccattaatttagatgatatgttaagtgttatgagttttctgtgtagactaaactggggcctctctgtctagtctatgttgttccaaccatttgccccatacggtttttgtgcactttggcctaggcctttttgtatctataaatatctacaatagcatcctttactttcataacaaaaatagaaactcaaagggattattgagcactattacagctatatcccataaacagtatgtggagatagttcttagtggggatttcacatgtgagactcttatttgaaaaagaatccccaccttcgtgcagagccacatcaaccacaagagagaggacagggaattctaagcccgtgagttttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgataattgataaatacatggtttgcccccaaaggctatactttttcttttttttaaagagacaggagtcctactatgttggtcttgaactcctgggctcaagggatcatcctgcctcagcctcctgagtaactgggaccataggcatgcatcaccatgcccggctgcaagactacaactcgtgctatagcacaattaattttcaccttgtaattttattacttccctgtttgaaaacatgagtggcatatgatttactacatgtttagcaatttacaggattttttttttacccatgatactttctggaaaatagttatgtgaatgtttatggcgttgacttgataactatactgctttattagtaactatttttgcaaagttattgccatgacaaatattacttgggttcttcatatgtcccttagattgtaactgtgggaaacttaagtgctactttagatttctctggtgttcaggaagtacattttgttatggtcagctagctgagtgctttaagtttgaactatgaaaatctccttaaaaaaaaaaaggacgcggtggcttatgcctgtaatcgcagcactttgggaggccaaggcaggcggatcacctgaggtcaagagtttgagaccagcctggccaacatggtgaaaccctgtctctactaaaagtacaaaaattagctgagcatggtggcgggcgcctgtaatcccacctactcaggaggctgaggcaggagaatcgcttgaaccctggaggtggaggttgcagtgagccgcgatcacgccactacactccagcctgggtgacaacagcgagactctgacttaaaataaaaaagattctgtagtttctggcacttgaaattgcaggactccaacctacaaatgctgtattattatgagatttaggctggaaatactgaggcagtaggatttaagcacttacccttaattgacatcccaaaactatatataaaacaaacaaacaaacaaaaaaacaaaaaaacccaccagttttaggaaagagaagggaagaggggaggattaatggttgaccagagactgttttgagtgtcaaggcactcagcttttcacagctattaaccagtacaataccccttttggttgagggaaatagactttagtttttcatcctctacttaacataaagatctttagacacctcttgttttctggttgtcacaggtgatgttagcatatgtgtaatgctttgtttgcctctggcgtgtcttttagtatttgagtttgactagccgtatagcaggactttagtggtttggatgcatagatgcaatgtattgcttttgtctgttttataattaacaattataaaataaaaggtcattccttaatttgcaaatttgttctcagaaagttctgtttgatacatgtcatactgcatggctctttaaaggtggcagtatcatgcagtacagactggaatataggataataggcttatacacttggagtagagaaggcctttttgaataggacacaaagcacaccaaaaaaaagccacagatacattattttgactgtatcaacacttaaaacttctgtaaaatgaaagataccacagacaagttaaaagaagaccatgaagtagatgtatgtatttgtgacatgtatagaattatctacaagtcaagaagaagaaaaaaagacaaccagagaagaaaattggcaaaggataagaaatacaaataaacatgaaaatgtgcttaactttatttgtaatcaagaaaagtaaaattaaaacaacagagaaaagctattttctaactattaaatcggcaaaattaaaaagcattaggccaaggatagtgaaaatagatactcatacagctggtggtgtgtaaattggaataactaatttgtaaaagcaattgtctatctctggtaaacatgaagatatcctgtgcatcctatgaaatgccaattccatcttgaggaatctaccttagaaaaactcttgcacatatatacaaggaaacacgtacaagaatgttcaacacagcccagtttattatagtgaaaacatggaaacaacctaaatgtttatcagtagggaaatatttaccattgggaactatcaaaaaggtaagtaggttccatattgttttataaaagatctccagacattgttgattaaaaaaaaaaaagatgcagaaaggatatatcagacacttaaaaacaacttaaaacatgaaaacagaacaagctcacaaactatatttctgtatttttgaaaatatgtaccccaaactgataatagttgttatctatgggaactggaattagtctttagctttatctgtattgtttgaacctttaaaaattattgtgtgtttaactagaaataaacatttttaaaaatttaaagatcataccagtactttgatttaccaatttaagcttcttaatactataaagtattaacagggaagagccagcaatttctagataatacaacgtaagatggggcactttgtaggtttttggatttttcttgttttgctttcatttttggttttgagaggtagtggggtgaatggaagaatacgggctttggagtcaaatctaagtttgaatccaagctctgccatttatttagactttgggcaggtttcttaacctctctagtttttaaaaaaattgctattacctacttcgttgggttgtataagaattacatgtgctagatttcctcatttccccattccctttggttaagggaaattggtctagtgtggtctaagatcaaagatggtctcgtatggatgacaaaatgtttcacaagaacacactatatccttggaccaggatataccagtaaagatggaggatgtaaataataaattttagaggtctattaactgtttaaaccattaagctatctatttgtacctcacaagatcaaatactagattatgttagtgatttataaatgatattgaacttgaaacttctaagcagtttacatgacaggttgttgattaacaggtttacttttttttttaaatctcagagaacattttaatttagttcagcaaacatttatttgtgccatccagcatctcaatctcaagaggcctcatagaccaaaatatgtctcaaaaggaagaaaggaaaactctatgtatttatcaatttatttatcaaactctggcaaggggggaaaaagtcaggtttaaagttgagtatatgtatatactctgcttttcacttgtactgctattgcctatgtgtgcatctgttaatatcatatatagcaattcatatgaagattttttccagtgagacttagttattctattattgggactctgtattaaataataatttttaaaaaagagtgctctaactaatgttaaggtggaaattctagacccctcaaacaaaaatttccaaataggaccccttatcatttaattgtgaaataaacaactaatgcttttatggtatttatgcttgggaagagaataaaataaatagttttggattttccccatataaattagggcctgctgagtaattagcagttaataagtgaatgcttcctacaagtttaaaggtcatacctgaaatgggtatatgatgatgtatatttttatagttatagattttatatagcccaagaatccttgaagatagtctaaacatcttggtttgatgagcagaactttcaataagggggtaaggggctaatattgtttgagcacttactatgtgccaagcactattctaagatgattacatagattattttatttaatcttcaccacagtcttctgtggtaggtactagtattgcccaattttatagaaaagggcagagagataaggtaacttatatgaagttacacagtcagtaaatgacagagctagaaatcatatccaggttcagttggctcaagaacccatattcttaaccattgcagtaaaaattgttatgctgttttaatctgtagagtcagcatgtagcaataataatataatcattaacatgttacattttgcatatattgaatgctttctaaagaagtagtttattatcagacatattcttagaatcatacccattttatagcaggattgacagtgttataaagagattacgtgatcaacatggggtgagtcaacagaaccaagaagtttctgatccacaattgccttcacttgctaggttcaagtaaggatcatatagtgtttacttacatttgccttagatttttcagtatagcatgatgaaattctaaatgcttatctcagacagtgatgctatctgagcaagacatggacaattgggcattagtgtgaattttaggacactagagcgtaggtacaggttagaaaacttaatcctcatcttgtggaagtcatggcaaagccaaagaggaaaagcctgtcttaaatgcttttccttttccaaggggcagctaaggtgcccagatatctttgccctccagggatgcaggtgtgctgttttttattctttaatcattcacataaattaaagcctattcctttgcattaaaaaaaatgtaaaatgacactctccgtgttttattgccaggcaagagctttgaacttctgtctcattgaagtttgataaactaaggattttcccgtgttgggtggtacccttaaccacagagggagcattagactgataagagctgcaggtgaaggaaaccaccagggcacggcaattagggagagcttcgcacttggctgttggctggtgtaaaactctctgcagggaggaacttttcttcttagcttcttcccttcacccacacgtaaaaagaacaccagggctttctatttctactttgcgaactaggaatggatgggatggttcttttcaagaaactttcaaatttagggacaagttctaacttcacacaaatgctgattggtatgaaggtggggggacaggacagacagacatacacacacataaattcacgtggacccaaatggaccatatctctcaggtgattttactatcaacatacattcctgcctttgtgcactgtgtaaaataaagataatttttacttccataactgattataaagtgttaatggtgaggcaacgtgttaagagaatgggttcttgtatcaggtaaaccttggttcaaatcttggcttctcttcccactagctgtgtaaattaattttgtaagtctcagttctcccacttgtaaaaatagaagtctaagaataactattataggattgtatttggaagaaatagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttctagaaggacaaaagtactttgatttttactgctctgaaaatatttatcccgtaaaaagctttcacattaactttgagtccctggagctagggaggagaagcagcaggatttgctactaagtagagctctttcatttctaccatcaaaaagaaaaaaaaaaaaaatcctgtgctagccttaggtagagctaagtcataaaaggccatatagcctaaggaaggactctttttataagatcaggataaaccgatagaagaaaggaaggagaacacagaggtgaaaatgcagctgattttaatgtttccctggccattttccctcccaatttaatatacacctaattataattattatattttgaaaacaataccagaaattggcaggtattatctcacagcttcactcttagttttggccgtttcttaaagaaacagttttctagttggatgaactgttgagttgaggcactgattttgttttcacctctttttgggtggggttgggggtgggcagtcagggtttgcagtggtttatagttgttagttttgggaagcactcatttagatagaatgagtcacagaatgtaaacaggtcatccatctggactttaggctgctgggaacgtggtgaaaccttaggtcaccgcgatcattatggtcaaatgaagacttttgggctcaggttggcaggtaaacttacttgttttatgagcttcactagactaccaggacttcagaaatagttttttgaaataccaatatttataaattttaggtaattccatcatattttcctgaggaatgaaactgtgaaagaagtaaatgtctactttggcagcaacttcatagaattgctttttggaaggatattcatcactttggggttttttgttctcactgctccagatgaaagtatttttctgaattttttatggtaaatgtggacactgaattggaagcttctatgtaaagtttgtcaggaaacctctgtcatacctaaggataaaattcagagaaagggaagaagtatttgagtacctgacatctaagaagttctggcctatgttgtttactgagtaaactcccaataatgctttgagacaggcttttaaggaaacatgttatcaatcacgtactatgtaccaaacacatagtggtgttttacctgtattatcttatttatttctcataaccctataatgtaagtaccattattatccccattttaccatgaagaataggcttgaagaataatttgtttatggtcacataactaggaagtggcagagctgagaatggagctctcaactctctgtaatccaaagcccaggttcttaaccagtgattcttaaacttaagagtacataagaagcatcaggagtacttgttaaaaattactgggctgtagtaaaaaatgtaaggtcactaaatctgggacagtgccagactataaatctgcgttttaaacggcatcccaggggattcagatcaagaaattgattgaccatattttgagaaacatagttaaattatattgcttttcacacttgataaagaagaaaacaggtgtagactaagtaactatccaagattaagctaccaagacagagccatgattcaaactcaggtctgtctcactctaatactcatactttttattatacgcccatgattaactcacacatttccaagtcacaacaaatgcagaaaacatgacatctaataaaccaagccagatagatttcatggtcttgttatttaccaaagttaataacttatatatacaccagtacgaaaattttcatggtccttaaacctttccagtgactttttttttttttttctaatttaaattaactgagttttcttttttttctgttctgaaatgaagtctggctctgtcgcccaggctggagtgcaatggcatgatcttggctcactgcaacctccacctcccaggttcaagcaattcccctgccgcagcttcctgagtagctgggattactagctactcaggaagtagccactgcatctggctaatttttgtattattggtagagacaggttttcaccatgttgccaagctggtctcgaactcctgacctcaagtgatccacccgcctcagcctcccaaaatgctgggattacaggcctgagccactgtgcctggccagagttttctttacaatcataccatccatgcttcaagcatggaattactaactccctgggataagtttctgatgcagaaatggaaaagaatagaaggaggtagaaagaaaagaacttccaggtgtatctgctgaatggtgctaaatctcctcttcaacccacccttgtgattgagatgaagaatgaagggttgatgctaatactaacagccagtcaaatggcaattggtcatgttcacatcatctcccaatctatcctttgagactatagctcagttagggtcagcaagtttgctttgcctattccagtccactgatgaagtgtcatcagacagagccaacacctggattgccttacacatgacctcctactaggattgggatcattctttttaaaatctttctctcattttctctttctctcttgctatttgattgcagctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagttttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagttttctttctacaggatgctgtgccaatcacttaatgatttaagtgtatttctaatcagcaaagtgaagagacaacccacagaatgggagaaagtatttgcaaactacccatctgacaagggattaataaccagaatatataaggagctcaaatatctctataggaaaacatccaataatcccatcaaaaaatggacaaaagatgtgcatagacacttctcaaaacaagacatacaaatggcaaacaggcataagcaaaggtgctcaacatcattgatcatcagagaaatgcaaatcaaaactacaatgagataacatctcaccccagttacaatggcttgtatcctaaagacaggcaataacaaatgctggcgaggatgtggagaaagggaacccttctacactgttgatggggatgtaaattagtataaccactgtggagaacagtttggaggttcctcaaaaaactaggaatagggctgccatatgatccagcaattcaactgctgggtatatacccaaaagaaaggaaattagtgtatcgaataaatatcagtactcctatgtttgttacagcactgtttagagtactaagatttggaagcaatctaagtgtccatcaacagatgaatgggtaaagaaaatgtggtacatatacacaatggagtattatttggccctaagaaagaatgagatcctgtcatttgcaacaacatgaatggaactgaagatcattatgttaagtgaaataagccaggcacagaaagacaaacattggatgttctcacttgtttgtgggatgtaaaaatcaaaacaattaaactcatggacaaagagaatagaaggatggttaccagagattgggaagggtagcagggggctgggggaagaggtggggatggttgatggttacaaaaaagaaaaaaaagaatgaaaaagacctgctatttgatagcacaacagggtgactctagtcaatgataacttaattgttcattttaaaataactcaaagggtacatttagattgtttgtaacacaaaggaaaaatgcttgatggggtggataccctattctccatgatatgattagttaacattgcatgtctgtatcaaaacatattatgtgccctaaaaatatatacacctactatgtacccatgaaaattagaacttaaaaaaattttttaaaggaatatttctagagggaggatatctttcatagattatatatttgaaaggtcatacctaggccaggcatggtggctcaaacccgtaatcccagcactttgggaggctgaggtgggcagatcatgaggtcaggagttggagaccagcctgaccaacatgttgaaaccccatctctactaaaaatacaaaaatcagccaggcatggtggcacgcacctgtaatcccagctactagggaggctgaggcaggagaatcgcttgaacccagtaggcagaggtggcagtgagccaagatggtgccactgcactccagcctggccaacagagagagactccgtctcaaaaaaaaaaacaggtcatacttctttataaagtatacttagaatgtgtaaaagtcaaaatgattactaccttttttatttttctgagatagaattttactctgttgttaaggctggagtacagtggcatcatcatggctcattgtagccttgaactcctgggttcaaggaatcctcctgcctcagcctccccagtagctgggactacaggtatgtactatcatgctcagctaaatttaaaatttatcttttgtagagacagggtttcagtatgttgaccaggctggttttgaactgcaggcctcaagtaatcctctcaccttggcctctcaaagtgttgggattgtaggcatgagccaccatgcccaactgattaccactttttgaatatcacagaactgtttttaggctgaatgagataaacactttaaaaacacattaatattctttttcttccaacttttattttagatacagggaatacatgtgcaggtttgttacatgggtacattgcacccaggtagtgagcatagtacccaataggtagtttttgacccattacccctctcccttctcccctctagcagtccacagtgtctgttgctcccatgttcatgtccatgaatgctcaatgtttagctcccacttataagtgagaacatgtggtatttggttttctgtacctacattaattcacttaggattatggcctctagctccatccatgttgctacaaaggacatgatttcattcttttttatggctgcatagtactccatggtatatatgtaccatattttctttatccagttcaccttgatgggcacctaggttgactccatgtctttgctattgtgaatagtgcagcaatgaatgtacgagtgcatggggagaatgatgtattttcctttggcatacccactaatgaatgggactgctgagtcaaattgtagctctgttttaagttctttgagaaatctccaaactcatttccacagtagctgaattaatttacattcccaccaacagtgtataagcatcctcttttctcagcagccttgccagcatctgtgttttttcttttttgactttttaataatagtcattctgactggcatgagatggtatctcactgtggttttgatttgcatttctctgatgatgagtgataatgagcattttttcatatgtttcttggccacttatatatcttcttttgagaaaatgtctgttcatgtcctttgaccatttttaaatggggttatttcgtttttgcttcttaagttccttatagattctggatattagacctttgttggatgcatagtttgtgaatattttttcccattctgtaggttgtctattgatagtttcttttgctgtgcagaagctttttagtttaattaggtcccacttgtcagtttttgtttttgttgcaattgcttttggggacttggccaagaattatttgccaaggctgatgttgagaaggatatttcctaggttttcttctaggatttttatagtttgagatcttacatttaaatctttaatctatcttgaattaatttttgtatatagtgaaaggtaagggtccagtttcattcttctgcatatggctagccagttatcccagcaccatttattaaacagggagtcctttccccagtgcttgtttttgtcagccttgtcaaagataagattgttttaagtgtgtgctttatttttgagttttctgtactttccattggtctatgtttctgtttttgtaccggtaccatgcaaaacgcaatcttcatgaaaggatgtgctagagaaatacatatgccatcacatatttatataatcgtttggattctctttccttttcttctggtttttgggaacattctaagaaaggaagagtaatccttataggcttccatttaagtgaatcttgaactcaagttcatctttcttgaacatagtttttttttttttttttcctttctgttctccagaggctccttggagatcagacagctattcaaatggcctcaccttgggtttctgttaggggaatacttgagattccctagctcttttgctgaactctaaagttcttttcaatgaaatctagattttttatggattggcatttaggttcgttggaaaaagaagctttctgggagtaaagttgttcctttcacccagtcttctaaaggaggatgaagtagagaaaggaattttatttgttctcatgatgtgggctggagcaaatgaggtgggcagggaataaagactgagattgaatagccttgcttgcttttacagaacagacaagtgaactgacaagcctacgggtcaagtttctataccatttaatctgtaccagcactcttgaggctccttgccaagtgaaatatgactcttctgggggtaatgcttcttcctggcttttttcattttactcccctccccatctctgttacaagtcttttccctattacactggttgcttgaaggtaggcatcatttaaatttttttttgaggcagagtctccctctgttgcccaggccggagtgcagtggtgcaatcttggctcactgcaacctccgtctcccgggttcaagagattctcccgcctcagcctcccgagtagctgggattacaggcacccgccaccatacctggctaatttttgtatttttactagagacggggtttcaccgtgttagccaggcttgtcttgaactcctggcctcaagtgatctgcccgccttggcatcccaaagtgttgggattataggtgtgagccatttgtgcccggcctcatttattcttcatctttgcattcctggtacttggcatgatgctttgcatataatagatgttagctaaatatttattgaatcaacagcagtatctatattttaagttattgaatactatctactcttctagattttgttataataaggactactttcttgttttttcctccctttctttttttattttttttatttattattattttttattatactttaagttctagggtatatgtgcacaacatggaggtttgttacatatgtatacatgtgccatgttggtgtgctgcacccattaacttgtcatttacattgggtatatctactaatgctatcccttccccctccccccaccccaagacaggccccagtgtgtgatgtttcccatcctgtgtccaagtgttttcattgttcaatgcccacctatgagtgagaacatgcggtgtttggttttctctccttgtgacagtttgctcagagtgatggtttccagcttcatccatgtccctacaaaggacatgatctcatccttttttatggctgcatagtattccatggtgtatatgtgcccattttcttaacccagtctatcattgatggacatttgggttggttccaagtctttgctatcgtgaatagtgccacaataaacatacatgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaaatgttcctatttctccacatcctctccagcacctgttgtttcctgactttttaatgatcaccattctaactggtgtgaaatggtatctcattgtggttttgatttgcgttctctgatggccagtgatgatgagcattttttcatgtgtctgttggctgcataaatgtcttcttttgagaagtatctgttcgtatcctttgcccactttttgatggggttgtttgattttttcttgtaaatttgttgaagttctttgtagattctggatagtagccctttgtcagatgggtagattgcagaaattttctcccattctgtaggttgcctgttcactctgatggtagtttcttttgcagtgcagaagctctttagtttaattataccccatttctcagttttggcttttgttgccattgcttttggtgttttagacgtgaagaagtccttgcccatgcctgtcctgaatggtattgcctaggttttcttttcttttcttttctttttttttttgcctaggttttcttctagggtttttatggttttaggtctgacatttaagtctttaattcatcttgaattaatttttgtataaggtgtaaggaagggatccagtttcagctttctacatatggctagccagttttcccagaaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgtctccagctttgttcttttggcttaggattgtcttggaaatgagggctcttttttggttccatatgtactttaaagtagttttttccagttctgtgaagaaagtcattggtagcttgatggggatggcattgaatctataaattaccttgggcagtatggccattttcacgatattgattcttcccatccatgagcatggaatgttcttccttttgtttgtgtcctcttttatttcgttgagcagtggtttgtaattctccttgaagaggtccttcacatcccttgtaagttggattcctgggtattttattctctttgaagtaattgtgaatgggcgttcactcatgattttgctctcagtttgtctgttattggtgtataggaatgcttgtgatttttgcacattgattttgtatcctgagactttgctgaagttgcttatcagcttaaggagattttgggctgagatgatggggttttctaaatatataatcatgtcatctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagcttttgcccattcagtatgatattggctgtgggattgtcataaatagctcattattttgagatacaccccgtcaatacctgatttattgagagtttttagcaggaagggctgttgaattttgtcaaaggccttttctgcatctgttgagataatcatgtggtttttgtctttggttctgtttatatgatggattacatttattgatttgtgtatgttgaaccagtcttgcatcccagggatgaagcccacttgatcatggtggataagctttttgatgtactgctggattcggtttgccagtattttattgaggatttttgcatcgatgttcatcagggatattggtctaaaattctctttttttgttatgtctctgccaggctttggtatcaggatgatgctggcctcataaaatgagttagggaggattccctctttttctattgattggaatagtttcagaaggaatagtaccagctcctctttgtacctctggtagaattcagctgtgaatccatctggtcctggactttttttggttggtaggctattaattattgccttaatttcagagcctgttattggtctactcagggattcaacttcttcctggtttagtcttgggagagtgtatgtgtccaggaatttatccatttcttctagattttctagtttatttgcgtagaggtgtttatagcattctctgatggtagtttgtatttctgtgggatcagtggtaatatcccctttatcattttttattgcgtctatttgattcttctctcttttcttctttattagtcttgctagtggtctatcaattttgttgatcttttcaaaaaaccagctcctggattcattgattttttgaaagtttttttgtgtctctatctccttcagttctgctctgatcttagttatttcttgccttctgctagcttttgaatttgtttgctcttgcttctttagttcttttaattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtagtcattcaggagcaagttgttcagtttccatgtagttgattggttttgagagagtttcttcatgctgagttctagtttgattgcactgtggtctgagagacagtttgttataatttctggtgttttacatttgctgaggagtgctttactaccaactatgtggtcaattttggaataagtgcgatgtggtgctgagtagaatgtatattctgttgatatggggtggagagttctgtagatgtctactaggtctgcttggtgcagagctgagttcaattcctggatatccttgttaactttctgtctcgttgatctgtcatatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttctttgtctcttttgatctttgttggtttaaagtctgtttaatcaaagactaggattgcaacccctgcttttttttgttttccatttgcatggtagatcttcctccatccctttattttgagcctatgtgtgtctctgcatgtgagatgggtctcctgaatatagcacactgatgggtcttgactctttatccaatttgccagtctgtgtcttttaactggagcatttagcccatttacatttaaggttaatattgttttttattttattttatttttttttttgagacggagtttcgctctgtcgcccaggctggagtgcagtggtgcaatctcgactcactgcaagctccgcctcccgggttcacgccattctcctgcctcagcctcccgtctagctgggactacaggcacgcgccaccatgcccggctaatttttgtatttttagtagagacggggtttcaccatgttagccaggatggtctcgatctcctgacctcgtgatccgcccgtctcggtctcccaaagttaaggttaatattgttaatgtgtgaatttgatcctgtcattatgatgttagctgattattttgctctttagttgatgcagtttcttcctagcattgatggtctttacaatttggcatgtttttgcagtggctggtactggtttttcctttccacgtttagtgcttccttcaggggctcgcctggtggtgataaaatctctcagcatttgcttgtctgtaaaggattttatttctccttcacttatgaagcttagtttgactgggtatgaaattctgggttgaaaattcttttctttaagaatgttgaatattggcccccactctcttctggcttgtagagtttctgccaagagatctgctgttagtctgatgggcttccctttgcgggtaacccgacctttccctctggctgtccttaacattttttccttcatttcagctttgatgaatctgacaattttgtgtcttggagttgctcttctcgaggagtatctttgtggtgttctctgtatttcctgaatttgaatgttggctttcctcgctaggttggggaagttctcctggataatatcctgaagagtgttttccaacttggttctgttctccgcattactttcaggtacaccaatcagatgtagatttggtcttttcacatagtcccatatttcttggaggctttgttcgtttctttttactcttttttctctaaacttctcttcttgcttcatttcattcatttgatcttcaatcactcttacccttttttccagttgatcaaatcggctactgaagcttgtgtgtgtgtcacatagttcttgtgccatggttttcagctccatcaggtcatttaaggtcttttctacactggttattctagttagccattcgtctaatcatttttcaaggtttttagcttctttgcgatggattcggacatcctcctttagctcggagaagtttgttattacctatcgtctgaagccttcttctctcaactcgtcaaagtcgttctccgtccagctttcctctgttgctggcgaggatctgcgtttctttggagaaaaggcactctgatttttagaattttcagcttttctgctctggtttctccccatctttgtggttttatctacctttggtctttgatgatggtgacgtacagatggggttttggtgtggatgccctttctgtttgttagttttccttctaacagacaggaccctcagctgcaggtctgttggagtttgttggaggtccactccagaccctgtttgcctgggtatcaccagcggaggctgcagaaccgcaaatattgcagaggagcaaatgtagttgcctgatcgttcctctggaagctttgtctcagaggggcacccagccgtatgaagtgtcagtcggcccctactgggaggtgcttaccagttaggctactcgggggtcagggacccacttgaggaggcagtctttccattctcagatctcaaactccgtgctgggagatccattaccctcttcaaagctccgttggaaatgcggaaatcacccgtcttctgcgtcgctcacgctgggagctgtagactggagctgttcctattcggccatcttggaacctccccttttcctccctttcttgattctttgtggtaaagctctatattgtgccattttagaagctgtatactgtgcgccttgcactccaaaagtgaattccacttgttctgtgtagccaatgctgagctgtagtgaaccaacagtaaggctgactgtaggcagcttttatctaccaacacactgttgaaaaaaaatcgtaagattttctacagtgctgatagaaatgtacttgccaagcaggctgtttcttgtccccagaaagctgaaatttacataatatacgagtgacacatacctgacacttccataagtctatgacaccagattggcttgaggtaaattattctaagaagtgaaaagtaaaccagctccagaaacttttgggttttctttttttttgaagacctgaaaggtgtggatgtatgacagaatgggaaatagtgtaagtataatttggtagacaaggagacctggatgatggaagctcctgagtttactttgtgaatttgatttagttagtgaaaatccttcactttcaggcttcagtttttttgttttgtttttttttgttttttgagatggagtcttgctctgtcgcccaggctggggtgcagtggcgcgatctcggctcaccgcaagctccgcctctcaggttcacgacattctcccgcctcagcctcccgagtatctgggactacaggtgcccgccacatgcccggctaatttttgttttttgtatttttagtagagagggggcttcaccgtgttagccaggatggtctcgatttcctgaccttgtgatccgcctgcctcggccttccaaagtgctgggattacaggtgtgagccaccgcgcctggcctcaggcttcagttttgtattgattaataagagaaacatagtgaagtggaaagagcactaccctagaaggaaaaagagctgcttattcttctaagtcctcactctataaccctgggcaaatttctgaaatatgggcttcagttgcctcatctatgaagtgggtttaataaagccttacatgataataataataatataataattatatattataatatgcagtttttactaaactaataccatgtctcagctactacaattctttgagatgggtactattattattgttatctctgttttatagaggaggaagtggatgctcagaaagattaaaatagcttcttcaagttcacaagctgttaagtgacagactcaggaatcaagcctcatctgcagtattatagagtccactgttctctactgcctccaagccactttactgcttaatgttgctagagggctaaccagatcatatttggaggtttcttctagctataatttctactatttttgaattctcccttatgaactatactttgcaagcttatcacacagccttagctggtgacctcagtttactgccatttaaatgtttaatatggccttttgggggatgcaactagagctgactataaagagcaggaagcatgattttcaaaaatatgttaacggtatccttccatcttacagtttcgagttcacatcttgagactttcatatatttagccgtgggtgatttacctttaaacagtgataaaagtactccttgaaattgtatttggaaggcttctcttctgattttcttctctgggtctgcttgccctctcacctatgctgtctgtcactccttggttgttggtgttttcaaacaagtccatgactgttccagcaaatctggataaactgtaaaacacaagtggctgaacagtactttgtgtatgtctgcaagaccatgagctctgtagatcatattcctctggacactcttgaaagacggatactaaatcccagaggattttcttttatgttgtatgtaacctctacctctgaatgttgtccttcaaccagtggaaggtaaaagaaattaatatttagaggtgctactctaagaataggccaaatgtcagcactgggtcaggacctctgaagaaatacatccaagaaaatgggcgagagtagctctaacttagaaaccacagcagagtgtgaccagattcttgtggtaaagataaaatgagaaatgtggctttttgagacattggaaaataatgatgagagaaaaacaggatgaaatctgagaatttgtatcagaattgggaaccattcttcacaggctaaattgatagttccaacactatggcatcagggagcttgacttccacatactaatatagaaaagaataatattctgtggtcttggttggtgggcccaggagagctcgcttttatgatcaagtgtcttgttttcgttttttaaaggatgattttagttttttggtgaagtttttatgatgactgttttggttgcaagggaaagaagtacacagactacctttggtttattttaaggatacgtgagaatatgcagcattcatttgtgaattattcattcacaaattacttttgggcacctactctgtgcctgtgtgtactatgcaatgggaatagagcagtgagcaagacaaataaggtacctatctttatgaacctagtgttttaatgagggtaataatcaataaacaagcaaactgatggggatgagaatagctaatagttaataagcactgtgtgctaggcactgttctaagcatataatatccattattttatttaatcttcacagttctatataaacagggtattagtattatcctcattttactcataaggaaattcaggctataaaagtaacattctcatggttacatagctggtaactgtaacaagacaaataacaagaaaacagccagagtaaggtaatatatagtatggacagggaagtcctcttggaagagatgacgattgagagctcatcccatcagagagccaataacttagctcagagggtgatgcaccttttctttgtccaccttgattatctaagtaagcttcctgtgtccaaaaatgatcatttgattgattttatttgttgctactgagaatggagtacccttactaggcagtgttcttaggaccccctcatgggtaactggcctccctcatgctctgctcctatttaaccagtgaaagtaaataaaataattcatcatcaaaagtatttgtgttctacactacatagtataaatatggagatggaaatctttgtcagtttttagaaaaggagcattaataatttcattttgatacatgttaatcatcagaattaattttgattcaaataaatccataaaatatgaacttcattaattcatccttggagaaaaaaagagattccaatagtgcatacccgttttttttttcttttttcttttcttttactttaagttctgggatacatgtgtagaacgtgcaggtttgttacataggtaatagtgcatattcctaaataacttaaaacgtaactctaatgaaaacaatccatgattataaaatatgtatcatttcttgttattttttttttcagacaggtgctttaagccctatgaaaagatgacccacttctttcctacataatctataacaatcagggcataaacattcattctaaaggtgacagattttttaaggatcattcaccatctagagtttaaataatgttgtttggggttcttcttgtgtccatggtaacagaggagcaggtgtgaggcaacaagaagcacatcagaacaaaccaagacttcgctgatttccagcttgtagctctgaatgagagatggacttgagacttctttgggccatttctgctcatgttttctctacttatttacgttaaattgagccaaaatgtggtgtggtaaagtaatggtgactaatcctattatagacttcttcaaaaggggtaatgcttccccctttacccaccccctcccctgacttttttccatagttcagttcttagctgttaaacattgtaacagaaaattacccgtttctcattgtcagcatctggtttcccacagactcagataattgtcaggaagagatttgccttcagttaaagcaaccctatccccactgttactaggccaggcacctctgttagaccatcatagaaccaaatctatagaggattctttctggctcttttctgtattactagaggtatgctatagcaaaaagactacagggagccatggtggtgagttaagagtcaaaatctgttttgaaacttaaaaatccagggtcattgaggatgcaagaagttgcctgtttttgtagaatccatctcacttcttcagtccctttgtattatggttacaggaaactatccagcagcacttgacctggtaatggaggaagctatttcacagcccactggtcccttgactcgtttagaagtcagagtcaaaggttacagaagtaataattgggcccagattctccctgtcaggaaagaccttgttccccccaccccaccccctgccttctacaagttaagagaaacttatctgttataaaaccattcaataagaggaaatgaagaaacaccatccttggctgaagtgttctcaagccccaatgatactatttctgttttcatgggagctgcttttgcagctagctagtataaaatttaggtctgattttttacattaaaatatctccccttagataaataacttgatttatttcaatctataaataatatgaaggatctttatttggtccaagccctgatattccttcacaccaccactctgataattccctgaatacttgtctggcaatcaagtacactcacacgagtcttaattaacaagtgttatgccattagcaatgtaaagtcagtcatcaaaagttaagaaactaggccagattataggctcacacctataatcccagcactttgggaagccaaggtgggaaaatcacttgaggccaggagtttgaggccatcctgggcaacacaatgagacccctgtctctacaagaagaataagaagtttaaaaagctttacttcaccagcaacagaacaatttaaaattttcagtgcttttaatttcttccataatttgctcagaactctagcagatcaatctgtggtgccattggcacaggcttggcactggagtaggaaagaatgacacaatttggcacctttaaccagaagatctttaatgagctggcgtgggggtggaggggacagagaggaaggaaggacagttaggattttggcagtaacacaaaggttcttcttccctgagaaaagtgaaatgaaagtcaaatgaagcttcactctgcttttagaatttgctaagatgtttgtctgtctctcagctcccggcccccttgcaggtgcatcattatagtcagtgacttctccaaaaaacaaattgtctctcaggatccttcaggaggggtcatatctaaccaatttcttgtctgaggacataattgtgattcccttcttcaactatcagatgcaatgctaccagcactgcagaaactgtcttatcagaaagtggcacaaatgtgtacatttcttctaggtcacagttctagtattgctgagttctggggctgcaacaatagataatactacaatgagagatgtttgggaaaagcattgtttcctgggtggccgtagaagcagacttgaaatcatccctttgtcattaaataatatcaacaacaaatgtctttgttgatgtcattgtattgtaattttctaggtctagattattgctagggatgataatacctatcttctagggttgttatgcaaatcacatgaaattacacatgcaagatgtctggctatatataattcatcttcattgtgtgttgttctccttaagctccacttttctgggatttttgtatctctgtggatctggatagtcttccttttctctctctttaaatggcatcagagttgaagatcttgaggactttttagtctctcttttgttttttgttgttgttgttgttactggtttgtttttgtttttgtttttttgtttttgttttttttttttgagatagtgtctcactctgtcacccaggctggagttgtagcacaaacatggctcattgcagccttaacctgggctcaagcaatcctcctgcctcagcttcccatgtagccatgaccacaggtgcgtgccaccatacccagctaacttttttttttcttttttatagagacgggtctcattttattgctcaaactggtcttgaactcctgggctcatgttatgctcctgcctcagcctcccaaaatgctagaattacaggtgtgcgccactgtacctggcctctcttactttctataacacttctttcttgccctgtattttgtgtacgtttttggagactaaaacattcaatgattgcctgcatgactcttaaccacttcactcatcatttagttcattcacagaatagcctaagaaagcttttctatctttgttttctttgcatatgccattttctcacttcctgtctttaccccctttcctctagatacagaattttaaaactcaaggtgtagtgggagacttgagtcagtcaactctatccaacttgtgttgttcccactcttagctctagcagtacagtgatgggctcagggtaatgaaaagcagactttctctgctgaggtcattgctcctcatgctggcagcctgctccaggaagctgtttatctatgcttgcagagccaagctccagcctctgaacagttggaatgtattgagaaaccacagagcccaaagagagaacattacacaggcagttccaggcagggagagtatatttacaccagacaaactgcagcttacatgtgtggggataattgttcatctgcacactctcatactttaccttctatgcaatctatataccctctcaagaaggtttaaccaggagaacttgtactgctatgtccaaattaccctgaacatcccctaaaatgtcataaggaaaaagagatactacagaaaattgatgtaaaaactttttaagatagtggtttttttgtttttctgagtcaaattttatgtttagaatcttagaccatgtaagcctgatcactaaagcattcaaaaacactgtttcttgcatggaaatgtttttcttcatccctttacaaaaatattaagtattgttatagagcttcaaatgtgctctatattaataggaatataagatatggtcacttccctgtaagatgtaatctggttaaagaggtaaaactcattgaataacgaacaattacagagcaatacaagaccttatataatggcattaagttatatggcccagtacactgagaattgagagtaaggaaaaataatggctattagttaagtaaaattagttgagtcttatagaggagtttgtcttaattttggaaaggaaggtagagtttggataaacaaaacagaaaggagacatattttgcaacatgaaagcaccataacatagtggttaagaacatggactttggaatcagataggtctatgttagagggcctgccactttctggtatgagatcttgggcagattgcttacctcatctataaaatagggagactcatatataaaatataaaattccatgttacataattgttggaatgattaaatgagttaatgaaagtaaagtgcttggcatttcacttaagatacaataagtgttgaattaattagtagctactgctactactgttgttcactcattcattcaatatatatttattgagtgcctacgtcttagcgttctagatactagggatatagcagtgaaaaaaacagaccagaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatctttttttaaatctctggatggtttttggatatttctacttggtctttggtttttgatagttttagtgtaatgtgtctagttttgcttttctttatatttaaactattcggtgttcttagtgcttcttgaacctatagcttgatatcatttatcagtcctggaaaactctcaataattagctcttcaaatttacttctgttctactctctctctgtctctgtctcttttttttttttgaggcaggatctctgtctgtcacccaggttggagtgcagtggtgcagtcatggctcactgcagcctctacctcctgggctcaggcaatcctcttgcctcactcagcctcccaagtggctgggaccacagttgcacgccaccacactcagctaatttttttttttttttttttagagatagggtcttgccatcttgcccagactggtctcaaactcctgggctcaagtgatcctcctgcctcgccctcccaaagtgctgggattacagacatgagccaacacgactggcctctaccctctctttactcctattgggattctaattacacaaacattagaccttttcatagtattctctgtctcttatgctcttttttgcattttctatcattttgtgtggttttttttttttttttttttttgagacagagtctcactctgtcacccaggctggagtgcagtagcactatcttggctcactgcaacccaggtttgcctcccaggttcaacccactctgccttcctggttcaagtgattcttctgcctcagcctcctgagtagctgggattacaggcgcccaccaccgtggctggctaatttgtgtttttagtagagatggggtttcaccatgttgggcaggctggtctcaaactcctgacctcaaatgatctgcctgcctcggcctcccaaagtgctggaattacagtcatgagccaccatgcccagcccatcattttgtagtttatgctttattctggatattttcttctgatctattttccaggtcattaattctctcttcatttctgtgtaatttactattaaacccatctactgagttcttaattctaattattgtatttttttagttcaagtatttttattcagtttttgtttgtttccttgctaaatcttgtctttcatttgcttgaacatagtaaataaagcatggttattacaaagtccataatttattgtctggataccctgtgggtctgtttctgttttctgtcctatccattttttttttactccattatcttatcttgtgttatacttttttttttctctagttgagttatgtaaattgtgtatgagttatgtaaattgaaaaactatacagataatgtgaggcccagaatgatgttatctttcttcggaggggatttatatttgcttttggcagatggcctgggcactagcaatcctggattacctcaatcccatgagggtttgaaaggatttgaatatagatttacatctcagggagggctgattttcagtatagctctgaggagtgccaaaagagctttagggtttaccagagtcccagcccccaacgtgggtgggtcctgaactctattttttttttcttttctttttgagactgagtctcactctgtcgcccaggctggagtgcagtggaatgatcttggctcactgcaacctctgcctcccgggttcaagtgattctcctgcctcagcctcccaagtagctgggattacaggcctgcgccaccatgccaggctaattttttgtttttagtagagacggggtttcaccgtgctggccaggctggtctcgaactcctgacctggtgatctgcccgccttggcctctcaaagtgctgggattacaggtgtgagccaccgcgcccagccaactctgattttttatctgcaagccctaacagtcatttgaaaactcaggaacttaacattaattcaaaattattaactgcttagtgtatcagttgaatcttccagaactggcagaggcccctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtagcagtaaatgttcttggccgaagcaacggaatctgtctctggctatcttaagcaaagagactggagtggaaagatgtgtcagttgcagtagctgcttatggatcagactgttgtggtgagacctttgcctagtttcctgatgctcagcctccaaagctcctttgattcctgtctgtttttcaagtctgatggttcagccacctgtggattttgtgagccactaataatacccttccagcagagcccttttttgcttaagatagtgagacttggtttctgttgcttgcaaccaagaaccctattactgttattaatttttttggtacattcttgagtcatttaggaatgtattagttaccagatgaaactgaattctcataaatgttatttggtagtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgtttaaaaaaaaaaaaaaaattagccaggcttagtggcacacacctatagtcccagctactcagggggctgaggcaagaggattgcttcagcccagtgaactgtgatcatcccactgcactccaacctgggcaacagagtgagactgtgtctccaaaaaaaggaaataaaggagggctttgggatactgaatgactgggagatggaaatctactttcaatagtgtagtcagagaaggcctcactgaggctttctattgccattgctattttagatacttgcttaaagaaagagaggtggtcttttaaaaagtatattcttgattaagataatggagagagaagaggaagaaaaaagggatattacaacctgtagctgtataggggaaaggaagagaaaaaagataggggataggggatagcaaagcaaactttatttgctttgtagatagctgtataggggaaaggaagagaaaaaagaaaaagagaagcttgaactttattatttgctttgtaaataatttgtgaccattgacttccatttcaaggatataataatgataggaattggctggcaggtacgactggattcacgatgggagccctttctttaaattatgccactaggtcttctctgaggtgccttctatataaatcaggattcataatctccctgattttacaggagccaggaactgagtcttcttttctttctatctctcataggaataaaagggggaaatgaacatttttttatactaccgaggtcaggtatccttgggtctaatgttaaacttaaaacagaaatttctgagagagcccttttatcctttgttatttagaaaatacttgaccctcctgtgcccttgctgtattggtgcgagacagaatggttatatatatattttattatataaataataactatatataataatatgttattatataaataataacatatatattttattatataaataacatataatcatatattattatataaataacatatataatcatatagcatatataaccatatgtagttatatataaatggttattatatataacatatataaccatatgtagttatatataaatggttatatatatatatttatttatttattgttgttgttttgttttgttttaagttccagggtacatgtacaggatatgcaggtttgttacatagataaacatgtgtgccatggtgatttgctgcatctctcaacccatcacctaggtattaagcccagcatgcaatagctatttttcctaatattctccctcctgcacccctcctaacagaccccagtgtatgttgttcccatccccatgtccatgttttctcactgttcatctcccacttgtaagtgagaacatgcagtgtttggttttctgtttctgtgttagtttgctgaggataatggcttccagctccatccatgtccctgcaaaggacatgacctcattcctttttatggctgcatagtattctatggtgtatatgtaccacattttctttatgcagtctatcattgatgggcatttgggttgattctatgtctttgctattgtgaatgaacatatgcatgcatgtatctttacaatagaataatttatattcctttgggtgtatacccggtaatgggattgctgagtcaaatggtatttctggttctaggtctttgaggaatcatcacactatcttccacaatggttgaactaatttacattcccaccaacagtgtaaaagtgttcatatttcttcacagccttgccagcatctgttgttttttgactttgtaataatagccaggtgcagtagctcacacccataatcctaacactttgggaggccaaggtgggtggattgtttgagcccaggagtttgagaccagcctgggcaacatgacaaaaccccatctctacaaaaaaatacaacaaaattagccatgcatggcagtgcacacctgtagtcccagctacttggtatggcttgagcccagaaggtcaaggctgcaattagccatgagtatgccattgtactccagcctgagtgacacagtgagacccccatgaaaagaaagagagaaagagaaaaagaaaggaaaaagaaagaaggaaggaaggaagaaaggaaggaaggagagaaagaaagagaaaagaaaggaaggagggaggaagaaagagagaagagaaagaaagagtaaaagagagaaagaaacagaaaagaaagagaaaggaaggaagaaagaaaaaaagaaagaaaaagaaaaaaaaaagagagaaaggaaagaaagaaagcctggcgcggtggctcatgcttgtaatcccagcactttgggagactgaggtgggtggatcaccgatcacctaagttgggaatttgagatcagcctgaccaacgcggaaaaaccccatctctactaaaaatacaaaattagccaggcgtggtggtgcatgactataatcccagctattcgggaggctgaggcaggagaatcacacttggacccgggaggcagaggttgtggtgagcagagatcacaccattgcactccagcctgggcaacgagcgaaactctgtctcaaagaaagagaaagagagagaaagaaagagagagagaaggaaaggaaggaagggagggagggaaggaaggaaggagggagggagggagggaaagagaaagaaattagaaaaagaagagcaatttaaaagttaggggggaaggggatggaaagagtaaagattagagtagaaatcaatgaaatagataccagaaaaacagtagagaaaattagtgaagccaagcaggttctttgagaagataaataaaatcggaaaatcatgagccagactgatcacaacaaaagagagaaaagacacaaattaccaatatcaggaacgagagagatacatcattacagattctataggtattaagagataataaggaaatattatcaattttataccaataaattcaatgacttagaccaaacggacaaagacacaaaggacattcaagaataaatagataacttgaagaaacagaatttgtagttaaaaataatctcacaggctgggcacggtggctcacgcctataatcccagcaatccaaggcagggggatcgcgaggtcaggagactgagaccatcctggccaacatggtgaaaccccgtctctactaaaaaaaaaaaatacaaaaattagccaggcatggtggtgcgcgcctgtaatcccagctactcaggaggctgaggcaggagaatcacttgaactcgggaggaggaggctgcagtgagccaaggtcatgccactgcactccagcctggcaacagagcaagactccgtctcaaaaacaaacaaacaaacaaacaaaaaatatatatatgtatatatgtatatatatcagaaactccaggcccaggtggcttcactggtgaattctaccaagcatattaggaagaaagaacaccagttctacacaaatgcttccagaaaattgaaaagaagtacttctgaactcaatctaggagactagcattattctaatacccaaacaaaacaaagacatttccagaaaagaaaactgcaaaccaatattccttgtcacaaaaattcttaaaattttagtaaattgaatccaacaatatataaaaaccatgtgggatttattccaggaatgcatgtggtggtttcacatttaaaaatcaatgtaaacttaaaaattctggaaaaagaaatgcgtaacccaccatataaaaagaaaaaaaaagatcatttcaataaatagagaaaaagcattttataaaatcgagcattcattcctgattcaaaaaaacaaaaatcaagactgttcatgctgtctctcacctgtaatcccagcactttgggaggctgaagcaggaggattgcttgagccccagaggtggaggttgcagtgagctgagatcatgccactgtactccagcctgggcaatagagccagaccttgcctcaaacaacaacaaagaccacctagcaaagcaggaatagaagggaattttttcaccaagtgaagggcatctacgaaaaacctatcaaacttaatggtgaaagacagaagactttcctgctaaaatcaggaacagggcaacgatttccattctcaccatttttgttcaacattgtcctggaggttctagccagtggataaggcaagaaaacttgaaaaaaaacaagtttgttcacataggacatgattgtctatatagaaaagcctatggaatctacaaaaaacaaaaaacaaaaaacaaaaaaaaaacgctactagaactaataagtgaatttatcaaggctgtatatcaatatataaaaattgtatttttgtattccagcaaagaacaattggaaatttaaattttaaaagcagtgtcatttacaatagcatcaaaaaatacaaaatacttagaaataattctgacaaaaggtttacactgaaaattacaaaacattgctgagaggaattaaagactatagtgactgattaatatatggtaacaaagtatatcagttgtggacaggaggtcacaggcagacaggagggaggaattccaaatagggtcaaaggaaactttgggaggtaatggatatgttcattatcttgattgtggtgatggtttcttgggtatacacatatataaaaacttaccaaattatatgtgtactttttcatttagtactttttttttttttttttttttgagatggagtctcgctctgtcgcccaggctggagtgcagtggcccaatctcggctcactgcaggctccgcctcccaggttcacgccattctcctgcctcagcctcccgagtagctggaactacaggcgcccaccaccacgcctggctaatttttttttttttttgtatttttagtagagatgagttttcaccgtgttagccaggatggtctcgatctcctgatctcatgatctgcccgcctcagcctcttaaagtgctgggattacaggtgtgagccaccatgcccagccactttttcatttaattctatgaatttttttttttttttttttgagatggagtctcactctgttccccaggctggagtgcagtggcgcaatcttggctcactgcaacctccacttcccaggttcaagcggttctcccacctcaatcacccgagtagctgggactacaggtgcatgccaccacgcccagctaatttttgtatttttagtagagatggggtttcaccatattggtcaggctgatcttgaactgctgacctcgtgatcttcccgccttggcctcccaaagtgctgggattacaggcgtgagccacagtgcccgaccagttctatgaatttttaacacatgtatatatacagaacaatttcatcaccacaaaaaactccatactatccctttataatcacaccctcttctgtctcccaacgcaaacccctgacaaccactgatttgttctccatcactatagttttgtcttttcaacaatgtcatatccatggacttatacaatatataaacttttttttttttttttttgagacagagtctcactctgttgcccaggctggggtgcagtggcacgatcttggctcactgaaacctccccttcttgggttcaggcaattctcatgcctcagcctcccaagtagctgggattataagcagacatcaccatgcctggctaatttttgtgttattagtagagatgggatttcaccatgctggccaggctggtctcgaactcctggcctcaagtgatctgcccaccttggcctcccaaagtgttggtattacaggcgtgagccactgtgcccagctttatacagtatataacgttttgagattagcttttttcactctgcataatgctttgagagctttgagattcctccaggttgtggcatgtgtcagtactttgcttctttttattgctgagtagtattgtattgtatatatgtaccacaatttgtttatccattcacccttggaaggatatttgggtttcccccaattggcaattatgaatagagttgctataaatactcatgtactcatttctgtgtgaacatacattttcttttctctgaattgtgtacccaagaataagattgctcactcaatcacatggtatgtttagctttttttttttttttttttttttttgagatggagtcttactctgtcacccaggctggaatgcagtggtgcaatgttggctcactgcaacctctgctgcctgggttcaagtgattctcctgcatcagcctcctgagtacctgggattacaggcacctgccactgcgcctggctaatttttgtagttttagtagttacggggtttcaccatcttggccaggctggtcttgaactcctgacctcgtgatccacctgcctctgcctcccaaagtgctgggattacaggcatgagccactacgcccagccatgtttagctttttaagaaaatgccacagtgttgtccagagtggctgtaccagttagtatttctaccagcaatatatgaatgattgggttgttctatatccttgtcagcacttggcactgtcagtatttttaattttaactattctaataggtatctcattgtggtcttgatttgcatttctcaagtggctaatgatgttgaaaaacttcttatttgccattcacatatcctctttggtgaagtgtctgttcaaacttttgcccatttttaaattgggttgtttgttttcctactattgagttttgagagttgtttatatattctggatacaagtcctttgtaatctgcaaatattttctactagcatttagcttgtattttcattctcttctcagtgttatatacagagcaaaagtttattttttttttttgagacggagttttgctcttgttgcccaagctggaatgcaatggtgcaatctcagctcactacaacctctgcctcccaggttcaagcaattcttgttcctcagcctccctagtagctgggattacaggcgtgagccatcatgcctgcctaatttttttgtatttttagtagagacggggtttcaccatgttggccaggctggtttcaaactcctggcctcatgtaatctgctcgcctcggccttaccaaagtgctaggattatagacatgagccaccgcacctggcctggaatgtcctttaaatttctttcaagaactttttctttgcattcacaacttggctaactgttttgtgtaagaggcctagctttcggcctatcttggcttttgacatgctctcttcactaagcttaataatttctagcttttaatttaaagtaagagactcttcctttcacttgaacacttagaggccattgtagggttattagttgacctaatttcaataccattgtagctcagggaatagagagcaccaaggaaagagagggagaaagaggaatggctggtcggtggaggagtcagaacataacgacatttattgattaagttcaccctcctatatggatgtggtttgtggcaccccaaaataattacaataataacatcaaagatcagtgatcacagaccatgataacagatatacaaataatgaaaaagtttgaaatattgtgagaattaccaaaatgtgaagcagagatatgaagtgagcacatgctgttggcacccatagacttgcttgacacagaattaccaaaatccttcaattttcaaaaaatgcaatatctacaaagtacaataaaatgaagcataataaaacaaggtatgcctgtaaatggtgcactacacatgctattctgtataatgaatttttttctgaatacataggctatatatattttaagattattaaataatatgacatttaaacatagccaatcatataagcaaagttgttcagctgtttctcacacctgaaagtgccccccacaccaaataaaacatttttagattatgtgtcccaatttggacttctgaaagtatggtcaccatatgccaaggcatgaaggcattaactggggaatgagtatggagtttgatgcctttcatctcctttgctcatctgtccctatccacatgatggctgcatttgaaatgaaataaagtctacatactggagaatagtttataaatcaatattttatgaaaacagttatatctaataattttttataaaataatgtatttatttgagtcttaagcttagtgatgtaattaaaagcctatttggttttttcttaggaatccaaatcctctctttaatatttaaaccctttaatttgctaaagataagttttgtgccctgttgaccacctaatggaacaagcaagtgttgaagatctcttgtggttttttttttagttgcaaattctaccaagctaacccatttattgcagtggataggagctggagagctgttcattcggcaataataggcaaagggtggtggagggaagaaaactatctttccaatatttttgcttaggaatttggggattcagaatttagtcataaacaactagattaatgtgtttaaatactttgaatcagttctaaatcattccttgttttgtaacatacaagatcttagagataactaaaacagtggttgaaaaattctgttgtggattgaagatcctccagaagcataattcactaataggcacagtgtttggggtgatgggtaaacaaacatctgtgtcctgtggttgcctctctgcataggaggagatatatagttttcaggcaagagatttctttggagagtccactgtctctgttttgcaagttatttatttatttttaatcccagagataacgaaaccatgtagtggcagtagatggtattattcatcaggagtttaggatgttaccatgttaggccatttaaaataagacagaaaggattactttttgccagctgcatcatttctggcaagagcttactactttgcttattgcggtcattgttgtggttgttgttaacccatcagagaaactaaccactacattggttttagccaaatccttgtcatcattggccttacattcttttggggaccaaagagcacctggtcattctgaaagcttccatccccagtgattgatgctcatctctgcaggctcctgcaggctctctcaagcttgcctcccatttttcctgaagcacctttaagcatttctgcatggctactcactctcttctattatacctcctcctcctgccttactgaatgctgaatttcccagctcacaactctaagaaggagctttatttcagagtagaaaggggcccccatatgtggcctattatatccatatcaacttgcttacccttttcaaacagctattgtcttttaatagggtcctgcctggcagggggagtccttaattcctgccatataagaatgggcagcttgagttacagctagctgcagtttggtgctctgatcaaaaggcctctgttgttttttagggtttttccccctccttctctctctctttctatatcctgtgctaataattcagcacagcaaggtcattacaggctttgaattgggagctgagagtgttaaattactgacctagaataaaagagatctggggggctctcaagaaagataaagtgattccggctagtaaaatgcaagcccagcaacctcacttcttaacaatattattattttttaatcccctctgtctctaaaagtcttttctgggacaaggagagatcccctgccagagaattaggttagaaacccaatgacatcttctgagagttgtggcccaggtgctggcagcttatgggcgcctgtgcagttgtcctttttgtctccctaccttgtcaatatttcactctgttctaccttggtctctcagccacatatatggtttttttttttttttatcacgtaagtcatatatgtttatgacatttcagctgaaaggtaatatcccatgaagggatttcagacatgtggaaagcataccacttagcccccaaaatatcttaaacatgacatcatcttattaaaagccactttcattccatttatgttttgtaaataatattagtctggtcctcccatactttaacaaaaaaaaagtcccattgtaaatgaatttgatgtctccactctattctacattgtatcttctgaagaaagtcatttccatttcttcatactattttctttcatatctttcatatgtccttttttttttttttttttttttttttttggagacagagtcttgccctgtcacccagactggagtacagtggtgtgatctcggttcactgcaacctctgcctcctgggttcaggagattctcctgcctcagcctcccaagtagctgggactacaggcgtgcgccaccacacctggctaatttttggatttttagtagaggcagggtttcaccatgttggccaggctggtctcaaactcctgacctcaggtgatccgcctgccttggcctcccaaagtgctgggattatagatgtgagccactgcacccagccactacagttatctcttaaagccatacactatccatatcctctggaaaatattgattttctaagactaatatttttagaaaagttcctaaaatcaactttcacagattttctgcacagcagagtaataataataagatagtccccgaatgtgccaagcattttacagaatgcattattaacacatttaacctttggcaaccttatgtaataagcattcctgtaatcactagtttacagagaaaaataattgcaatacaaagtcatacagccaggaagatttgtcccagactagtgcttcttgaactttttcatgtttgtgtgaatcacctagggatcttgttaaaatgcagaatcagattttgtaggtctgggttggggcctcagattctgatttttaacaggcttctaagtgatgctagtgctgctgtccttggttcacattttcagtagcaaagccatagtcattttttcttgagaactactcaaaaagtttttggttataacttccagtttttcattccatcaggcaattctatgaatatacatagtggatatttcacacctatatcttactttttaaaaaatatgataaaacatagcacttaacccacaaaatatcttaaatgttagaaaatatttaagatattttgcctcctattggccctgcagaagctggacctcctgaactgtgtgacctacttcagtggtacctcaggttctacatggtgagtatcctggggactggaagagtggagatgatcagggcccataggggacctggttaaaattgactattttaactatttttaagtgtacagttctgtggcattaaatacattcacattgttctgcaaccatcactgtcatccacctccataacttttctatcttcctaaactaaaactctgtactcactaaatactgacttgccaacttcccattccttctgaccccctagctcctggcaatcaccatgctactttctgtatctaggaatttgactactctaggtacctcaagtaagtgaactcatacaatatttgtcttttttgattggtttatttcatttagagtaaggtcttcaaagttcattcatgttgtaccatgtatcagatttccttccttcttaagactgaataatagtccgttgtatgtatgtatcacattttgcttatctgtcattagacactagggtggcttccaccttttgactgttgtgagtaatattgctgtgaacatgggtgtatatatcatatatttgtccaagtccctgctttcatttcttttgactatatacccagaagtggaattactgaattatatggtaattccaccaatatcttactttctaagaaaccagtttatgtttaagttattgtgttccttttttttttttctaagtgagacagggtctcactttgttacccaggctggagtgctggaatgcagtggcatgaacatagctcactggccttgacctcttgggctcaagagatcctcttgcctcagtctcccaagtagctgagaccacaggtgtgtgccatcacacctggcaaatgtttaaagatatttttcatagagacgggacctcaccatgttacccaggctggtctcaaactcctgggctcaagcaatcctcttgccttatagcctcccaaagtgctgggattacaagtgtgagccacttcacccaatcttctctctctctttttttttttttaaacattccttacataaagtaaatctttaaaggtttggcaggaagagtgagttttcagtacagattttcattaaagtctattgtctgtagctactttgtaattttcaatcaatcacaaaagaatattgagaaatgtcctttgatccttagaaggttggtaattggttaaatggcaccaagtagagaattagagagagagtgctcatgttctgaaataaaccaatactaagaaggtttatatcacagagaaagttttatataaatgaatttaagacctcacctgacaaacaggtagtcaaggaacaggtgaaccccttgttaaatttatgctctcctttaaagattttctggaacaactatcccaggatcttcaaaaattttgtggtacctctttctctgtggtctttaataatacattaaattctcgtttgtttataagagtttggtgcaagattctgcctgctacctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctgtggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaacccccttcaattttattattttgaattataatcaagtccaaggagacttggcctattattaacaactttgtatgaagtatttttttcaaccaaattcatatcatcttgaataagaacaaaggattatggtttgagaattattatacttgctggactttgaaccaacagagttgatatatttaatacttccacttcttagatgaggtggtactgaggaaggggtttgtaacatctaagggggcccataaaaatagtgtttagttttcagtgaaatctacaggtgatgctaaaatgggaacatttttaaagggatcctagtgagaacaaaaagacaacaaaaaagaacctaaaggctatagctgcaggcagaaaatagaataaaatttaccttaaaatgttgtctagtgcaatgccaagcatagatatacagtggatgagcaaaatcttgtaagaaattagaattgagtttaaaaagttataaaagaaaacagacaagaaattagatgaaactatggtatgtgatctggcagtaaaacagacaaaagctgttttaaggtctggagatagagaggaggggaaggaatggcaggatctgcagatgactgagggaggcctcacctgtgactaaactcagcttcagtagcagaagaaaatagtacagacagggtgaaccagttgacaaaagagatacagaggttggaacatagagctgaagagaaagaaataacagatgacaggtttagaaaccacataaagaatgtgagatgtaatatgtagcagaaggtgagatgtaacagaaatactgtaaagagaaacagtctgtccagaaactcttcctaggggataaggctaggggatatttccccagagaaaccatgaaaacacaattattctggatttcaagtgaaattaggcaagctcctggaagctctgttataaagagctctgcttagaggccttgttgaaagaactgaaggatcttgtaggaacaagacaaattagagatttacggtaattgttgttatttttttttaattgacataacattacacaatatttggaagacaggaagaaatcaataataagccaaaaccctaatccagtgaataaatacaattcatatcttttaaatttttaatcactttccttattcagacctactttaaagtagctaaaattggctgggcacggtggctcatgcctgtaatcccagctctttgggaggccgaggtgggtggatcacttgaggccaggagttcaagaccagcctggccaacctggcgaaaccccatctctactaaaaatacaaaaattagctggccatagtagcatatgcctgtagtcccagctactcgggtggctgaggcatgagaatcacttgaactcaggaggcagaggttgcaataagttgagatcgcagcaccacactccagcctggatgacagaggaagaccctgtctcaaaaaaacaaaacataaataaatgaagtagctaaaattatcatgtacacacaattttgtttccttttttgtttgtttgtttcttcttttattctcagtaccttcctcaggatcctccttaaatataacatatgaatcatgtttttataatttaaatttctaacatgctataaagagtatgtatgtgtgcagtaaccttttcccagtgctcggcgcattgattttccatcctgtatttccctgtttctactggcctggagtaaccagccttataaaaaaagatattccttcatacttaaagctgcaaggggtaagcagatgtgaattaatcatcttatatcagccggtaagaagctgatgtgttagggatggcacctgcgagtttaccatagcatgccaggccttcaggaatgagttttgaagtttgagggcttcaaaggggagtttgaaacattttaaaaccctgacagggttttacctgaattatatgcaaagatccaatggggggaagagtttacttcagagaagcagcaactgaaaaccaggtcctttgcgtagccttcctggaaagaaccgtctttcttccttagcagcagcccccagggtaggaccagtgctctatttcacggctattttaagaaagttctttatggatttgggtaacagaaaagcacttggtgaagtgatcaaggaaagaaactaactctgctactgaggattacttaggcagaaaaaaaatcttgttatgaaacaccaatgtttaagtccttagagtgaactgataagctgatttggggcttttttgctgttgcagaaattataaatcctatccactacaatggcagctcagttctcacagatgggttcacctatccttagacagtaacttaagattgatagtccctgttggatttcttcctaaattgttttttaaagaagccaaagatcttggattctaattctaatggagccactgctgacaagaagaagatgaagaagattgttagtgctcacttgcagtgtggcacatctctattttcttttttttttcttttttttttttttgagacggagtcttgctctgttgcccaggctggagtgcagtggcacgatctcggctcactgcaagctccacctcctgggttcacgccattctcctgcctcagcctcccaagtagctgggactacaggcgcccgccaccatgcctggctaattttttgtatttttagtagagacggggtttcaccatgttagccatgatggtctcgatctcccgaccttgtgatccgcccgcctcggcctcccaaagtgctgggattacaggcgtgagccatcacgcccggccacatctctattttctatagcatttacaattatttctttgtagccaacagaaaagttgcactcaatgaacctatcaattcatgatgcatatccgtggggagaagctcattccgaatacatcatatgttaaatttatccttggattcaggatcatattgttcacttactttttcctgtagtcagcatgttgtaattttgaacaatagaataatagataacaacagcctactagagaattagaaatactgtagttctaagaactgtagtaattagaaatactgtagttctaagaactgtagttcttagaaatactgcattcaacttttgtaaagaaacttttttgtatcactatataagaaagaagctggtgtgtaaggcaacttctgtgcaaatatgttgtctaaactgctttggggttctgtaacatagactagctgacttgcctcactgatttctcttatcaagttagcattgccaaattctatagctgataggcaatgggaagaaaacatttcagggctttaggcttcctctgaatttcacaaggaaacaaagaacaaatccagggattgttaggtcaggagacaaaatcatgccataggaatatatatctttttttttcttctttttttttgagacaaggtctggctgtgtcatccaggctggagtgcagtgatgtaatcttggctcactgtaacctctccctcccgggctcaagccgtcttcccatctcagcctcccaagtagctgggactacaggcgcaggccaccatgcccagctaattttcatattttttttttttggtagagacgggatttcactatgttgcccaagctgatctcaaactcctaggcacaagcaattcatctgcctcgggctcccaaaatgctgggattacaagtgtgagccactgcacccagccacagaaatatatctttagagcctggtgactttgtgcaaaacaaaactgcagttagccaacctgttagtggaaaatatgccccaaaagtcttctcctcccagcttgcccctttccaactcagaatatattttttccttctgtttatagaagcaacacaaggttactttaaatcataattttggccaggcatggtggctcactcctgtaatcccagcactttgggaggctgaggtgggcagatcacctgaggtcaggagtttgagaccagtctagccaacatggtgaaaccccgtctctactaaaaatacaaaaaaattagccgggcatggtggtgggcacctgtagtcccagctacttaagaagctgaggcagcagaatctcttgaacctgagaggtggaagttgcagtgagccaagatacaagattgtgccactgcgctccagcctgggcgacagagtgagactctatctcaaaaaaaaaaaaaaatcataatttcataatttttcccaagatgttttggatctttggtcttatatattctgtggaggccaattcatatgctgtgtttgaatcaccttagtgtggccagtttgtgctgcatagttggatgtgatctgctctcctgttttacttcttggcagatatatttaggattccttgaaaaaaaaaaaggctgggcacagtggctcacacctataatcctagcactttgggaggccaaaacaggaggatcgcttgagcccaggagttcaagaccagcctgggcaacatagtgaggcctcgtctctactggaaaaaaaaaaaaaaagaaagaaaggaagaaagaaagaaaattagccgggcatggtggtgcacacctgtagtcccagctacacaggcggctgaggcaggaggattgcttgaaactaggaatttgaagctgcagtgagctatgatcgtactactgtactccagccttggtaacagaataagaccctgcctcaaaacaaaacaaaacaaaacaaaaaaaacctatcagaagacaagttcaattccaattctaacagaagataatccactctaatgagctggcctggttttagaaagaaaaaaaggagacaggagaatggcctaggaagactcaactgccatcatccagttaaacagtgcaggtcaagattcactggccgttttcagtttgagtgagaacaaggagcacctggaggacatagagtgctgttggagttttgaagttttgcctctttgcacattaagaatgagctggaatattttaatttggtcctcttgcccatgtctttattacttctatatgtggaatgtgaatagctatttatatatagatccagtatggttacagttatttatttatttacttatttatttttaacttttaagttcaggggtacttgtgcaggtttgttacataggtaaacttgtgttgtgggggtttgtggtacagattatttcatcactcaggtattaagcctagtacccattagttgttttccctgatcttttccctcttcccatcctccaccctccaataggccccagtgtgtgttgttcccctctatgcatccgtgtgttctcatcatttagctcccacttataagtgagaacatgcagaatttggctttctcttcctgcattagtttgctaaggataatggcctccagctacatgaatgttcctgcagaggacatgatctcattcttttctatggctgcagactattccatagtgtgtatgtaccacattttcttcatcccgtctatcactgatgggacagtgtgaggaatcctcaaagatctaaagtcagaaataccattcgacccagcaatcccattactgagtatatacccaaaggaatataaatcattctattataaagatgtgtggttacatttatatttaattctttcttggtagtccctgagctattgcccacttcaccagaataatttaaatcaattcttgctttttgctagttaatagccaaaattaagatgtttatgtggaattgacatcatacataaattcttagaatttgtatctagtttttcaggagaaaatagataccacttaatagaattctgtatgactttttctgtgcaaacagcgtttgttactagaagagaacatgaaattgtatcaagaactcccattagcttaacatgtttacaaatgtctgattataaaattattaatttttaacacagctcctgctgtgttttcttaatatattactggagaaaactgccctagagctgggcatggtggctcacgtctgtaatcccaatgctttgagatgctgaggtgggaggattgctttagctcaggagtttgagaccagcctgggcaacataacgagactctgtctttacaaaaaataaaataaacaaaattagccaggcatggtagcgcatgtctgagtcccagctacttgggaggctgaggcagggggatcgcttcagcccaggagtttgaggctacagtgagctatgatcgtgccactgcactccagcctgagcaacagagaaaaaccccatctctttttttttttttttttttaaaagagatctcttaaaaaaaaattgccctgaagttaaatattgtattagggttctctagagggatggaactaatggaatagatttatatatataaaggggagtttactaagtattaactcacacaatcacaaggtcccacaataggccatctgcaagctgaggagcaaggatagccagtaaactgaagaacttggagtccaatgttttagggcaggaagcatccagcatgggagaaagatgtagcctggaagggtaggccagtctctcttttcacatttttctgcctgcattttattctagctggctagactggcagctaattagattgtgctcactcagattaagggtaggtctgcctttcccagcccaccgactcaaagttaatctcctttggcaacaccctcaccgacacacccaggatcaatactttgtatccttcaatcagtttgacactcaatattaacatgacaaatattaagctaataaaataggaaaactatggaatttattttattgtcaaaactaaattaagagagatttgtactcagcccatttcattttttttactttagaattttttaatttccagtgaaaccaaattttactactgttgtgaacacagccttcacatttgatgcaaatgggagggcttaattataatcacttagtgacagtattgtagacaaagccaatagtgtatggcacatagatgattatatcttctggagagagttgactttacaattaatacaaacatatttgactaaagaaaatggaagcatcttcagaccatttcatcttaattatatcttgtaaggttaaaaatatataactcacaaataaattttaatttaaaaaatttttttaactttcatgtcacagccaagtccaaaaaattttaattttgatgtttctggttctcttgtggctagataatccatagagatttcctgaacttcttattcatgatagcttaaaaagaaacattcagatccctgtgaattggacaaaaggatatctattttatgctactttttgtagcataaggaagaagaggaaataaaaacacaatgggcccttgaacaacatgagggttacaggtgccgacctctcctcttcacttagtctaaaatccacatataattttggactcaccaagaacttaactactgatagtctactattgaccttaccaatagcattaaaacagttgattaacacataccttgtatatgtattttatactgtattcctacaacaaagtaagctagagaaaagaaaatgttattaagaaaatcaaaaggaaaatatatttactattcattaagttaaagtggatcatgataaagacctccatctttttcttcttgatgttaagtggctgaggaagagaaagaggaggaggagttggtcttgctgtcttaagcgtggcagggaagaagaggtggagattgtagaaggggaggcaggcacactcggtgtagctttatgaaaacacatggtgatttctgattttttttgccttttcatgtctttaaaaatgtttctatatggtaccaatttttcttccatttgctttagtttcagtgcctgtatcactgaagagttcatgtcataaaagaagtcaaaagcagtcttgaatagttggaactcttctgccagatggtctaatgtcagtttgttttctggccctgcttctgtgtcttcttccccttctattccttcttttctggcactggttcagaagcactcaccttcatcaagttgtcttctgttaattcctctggtgtgatgtctgttagctcttgaatttctccaagatccatatcttgggacccttcccccaccttctttgccatatccacaatctctttcatgatctccttgattggctctgtcgtaaatcctgtgaagtcatgcacaacatctggatgcagttttctccagcaggaatctattgtttggggctcaatggctttttccataacaacagtggcatcttcaatggtgtaatcctcccagactttcttgatgttctatcaggattctcttccatagcgttgacagtcctttccaacagagtactatgtgtaatgggccttaaaggtccttataaccccctgacttaggggctgaattagaaacattgtgtttgggggcaagtattacagaccattttgatacctttggtgttgaactcatgggttctgggtggccagggacattgtccaattcaaaagaactttaaaaggcagtccatgttggtgtgctgcacccattaattcatcatttacgttaggtatatctcctaacatggcacatgtatagatatgtaacaaacctgcacgttgtgcgcatgtaccctagaacttaaagtataataaaaatatatatatataaaaataaaaaaataaaaataaaaggcagtccattaccagcaaggtacatcctgacttcaggaagaatgttgatgaaacccagtccagaaaaaatggttctcattatccagggcttcttgtacaacacccaaaactggcaactggtatttatcttttcccttcaaagctcaggggttaccagctttatagataagggcagtcctaatcataaacctgactgtgtttgcacaaaatagtagagttagcccatcccttcctgccctaaatcctggtgcttgcatctcttccttactaataagtgtcctttgtggcatttttccccttagcatctgcattaaaaaactgctcaggaagatatcctttttcctcaatgatttttaaaagcttctttttttttttttttagagcagggtctcactgtgttgcccaggctggagtccagtggcatgattataattcacaccacctcgaattcctgtgctcgagtgagtttcatgcttcagcctctttagtagctgggactacaggcttgtgccaccacagtcggctaatttttatttttggtagagatggggtttttccatgttgcccaagctggtttcaaactcctgggctcaagcaatcctcccacctcagccttccaaagtgctgggattacaggcatgagccactgcacctggttgcctcaataattttcttaatggcatctggaaacttgtttgctgcctcttggttggcagatgctacttcccctgatatcctgatattttttaagccaaaactttttctaaaattatcaaaccatcctttactggcattaaattctccagctttagacccttcacctttcttctgctttaagttgtcatataatgacttcactttttctcagatcatattagggtcatatgcctttcttatagaaatcctgcactcctataaaagctgtgttttcaagacaagttaaaaaagtatttcaccaaaagtgcaatgtttttatgcctgctgatgtagctgcagcaactgcttcatgaatttcctttgtttataattgtccttaccttagattcatttatcttgaaatgaaggccaaaccacagctgcagatctcaatctatgatgtatgtcaagcaattcaactttatcttgtaacgtcatgaattttctctgtttcttgggagcacttccggcatcactagtgacacttcgtatgggtccgatagtgttatttgaggtttatggttttgtactgaacacgatgaaaaatacatgagaaccatgagagatcactttttactgtgatacacaatttactggagaaatgaactgcccatgcagagatgattagcatcacatggtgttttaagcagatacttgcaacacttgtgctcactgcaatagcaacaggagttggctatgaatgaaattattatagtagtacagtatgagctacagttaattttatacagttatgatttaatactgtatgtttgcttacatttctctccactatgaatggcaccatgtatggtctgtgtgtgtgtcagttttgctaaatgttaactttttataacagatttgtgtatattttaatgtagtaaatgataaaatggactagtgtctacatattttatgcattcaggacatacttttaaaaatttttccaatatgtgtaggatgcacagttggtctgtgagttttttttaaattgctgaaatccctccaaaatttctaatatatttattgaaaaaaaatccatgtataagtagacccacacagttcaaatccatgctgttcaaaggtcaactgtatatacatgtatctgctcatctgagaaaaaaatatgcacacaggaagaataaaccagagatgaatgagattcattatctctaagatgttagtgaaatggagtgaaaagatatatatatatatatatatattatatatatataatatataaattatatatattatattatatattatatattatatataatgtatattataatatacaatataatatataatatattatatataatgcatattataatatataaatatatatttatattatatattatatattatattaatatataatatatataatatattatatttatatattatatattatataatatatatattatatattatatttatatattcaacaagattgggggagactctaaaattgaaaacaaacaagtgaagcaaattgtatttcaaatgaataatataccgtactgcagggggttggagaaactaatctaaggaacataatatttggactatataccctcaggctaaaacaactctaaacaagtattaaactctaattagtaggcttctttttcacagaggaatgggttagctagctcagtacattttaggattaagcaaataagtaaatatgttatagataataggagcctttttctcactttagaaaaaggacatttcagatatggaaagggaagatgatagaatgtaacctgtagtgttgaactggaattgaatcagtgtgagctcatagatttgttttgttttgttttgttttgttttgtttgagacgcagtctcttctctgtcacccaggctggagtgcagtggcacaaccttggctcactgcaacctctgcctcccgggttcaatcaattctcctccctcagcctcccgagtagctgggattacaggcgagtgccaccacgcccagctaattttttttatttttcttagaggggtggagttttgccatgttggccaggctggtctcgaactcctgacctctggtgatccgcccacctcggcctcccaaagtgctgggattacaggagtgagccaccacgcccagcctattctttactaaaaacaactgggcttcttggataaatggctggctccagggtgaagtagggaaagaacaagatgatcctggaacatcttattctatcaaaaaaggaaggaagtgatcagagaattatgtagatgtgtcaaaaggacatagaagtcagcttgaagggcttccatggcaaaatatgggatcatttgaacataaaaatatataatgatagtaaaggattataacctattgaataaagaatccatgagtccacaatgatataaataaataagaagggaaagctcttccttattgtagaaggtcgacttaaaaacgtagatgaaacgacgtagttggaaaaagatcaccatttggcaaaaccttcatattcattgttggttctggcaacaattattattattattattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtgcagaacaaaatgaaaagtctcccacgtctacctctttctacacagacacggcaaccatccgatttctcaatcttttccccacccttcccccctttctattccacaaaaccgccattgtcatcatggccccttctcaatgagctgttgggtacacctcccagatggggtggtggccgggcagaggggctcctcacttcccagtaggggcggccgggcagagggctgaccccccccacctccctcctggacggggcggctggccgggcagaggggctcctcacttcccagtaggggcggccgggcagaggcgcccctcacctcccggatggggcggctggccgggcggggggctgacccccccacctccctcccggatggggcggctggcccgggcggggggcggacccccccacctccctcccagacggggcggctggccgggcagagggactcctcacttcccagtaggggcggccggccagaggcgcccctcacttcccggatggggcggctggccgggcggggggctgacccccccacctccctcccggacggggcggctggccgggcggggggctgaccccccacctccctcctggacggagtggctggccggacagaggggctcctcacttcccagtaggggcggccgggcagaggcgcccctcacctcccggatggggcggctggccgggcggggggctgacccccccacctccctcccggacggggcggccggccaggcagaggggctcctcacttcccagtaggggcggccgggcagaggcgcccctcacctcccggacggggcggctggccgggcggggggctgatccccccacctccctcccggactgggaggctggccgggcgggggtctgacccccccacctctctcccggacggggtggctggccgggcggggggctgacccccccacctccctgccggacgaggtggctcccgggcagagacgctcctcacttcccagacggggtggctgctgggcggaggggctcctcacttctcagatggggcggttgccgggcggaggggctcctcacttctcagacggggcggttgccaggcagagggtctcctcacttctcagacggggcggctgggcagagacgctcctcacatcccggacggggcggcagggcagaggtgctccccacatctcagaggatgggccgccgggcagagacgctcctcacttcccagatgggatggcggccgggaagaggcgctcctcacttcctagatgggatggcggccgggcagagacgctcctcactttccagactgggcagccaggcagagacgctcctcacttcccagacggggtggcggccgggcagaggctgcaatctcggcactttgggaggccaaggcaggctgctgggaggtgaaggttgtagcgagccgaggtcacgccactgcactccagcctgggcaccattgagcacggagtgaatgagactccgtctgcaatcccggcacctcaggatgccgaggctggcggatcactcgcggttaggagctggagaccagcccagccaacacagcgaaaccccgtctccaccaaaaaaatacgaaaaccagtcaggcgtggcggcgcgcgcccaggcagttggcaggctgaggcaggagaatcaggcagcagtaccgtccagcttcagctccgcatcagagggagaccgtggagagagggagagggagaccgtggggagagggagagggagagggagctctggtactttcttatagccacacgaacagataaagactgtacctatctgttggctgggcgcagtggctcacgtctgtaatcccagcacttcgggaggcttagacaagcggatcacgaggtcaggagatcgagaccatcctggctaacatgatgaaaccccgtctctactaaaaatacaaaaaatttagctgggcgcggtggcgggcgcctgtagtcccagctactcaggaggctgaggcacgagaatggcatgaacccgggaggcggagcttgcagtgagccgagatcgtgccactgcagtccgtcctgggcgaaagagcgagactccgtctcaaaaaaacaaacaaacaagaggtccagagtgtgacaacatggccttgcaaccttgtgctcagggaccctggaggcagtccttcataggtctgctggaactcgccaacaattattaatagatactaaaatttgtgaatgaaagtttgaagagtaactatatatttccacagactcaaaatgtcttcccacaggatacttatccattacaaaggctaactttatagtggcaaaacctggcagatgctgctctaactaaagaatcaaagttaacatccccagtaattagactaatcagcaagtgcccccagatgtgatgcactgagaggaactcagcatcacctttgtgataatcctgccaaaggggcataacctgaattgaattatgagggggcatcagacacacccaaattcaagaacattctacaaagtaacctgtacaacaggttttcaaataactttgtttcatttaacatcattttcattgtaactattttgtggtttaagatcattttatgaagagcaagaggcagggagagatggcagggaggacaactagagcacttctacacccaccaggagaatagactccctccctgcttcctgttgtgctggacccctattgacttcagtagggatggcaccatgtttgcgaggctgaaaaagagacatggagccagcaaatgaaacataaggttttttgaggggatttacatacagggcagtccaggggcagcatgctgaacaggagaactgctaccacttataaaaaagcatgcagtttatacagcattttcacttagcccctcgaccccggcaatctccacctggcaaccttcatccaacccaaaacaaagggcctcgaacccctgtatggcctgtgatccatgggatggatcagatggttcagatgttcctcatagataaagaatgaatctctgggttggccattcccaaattccttcactcagaactctgaacacacattcatcttagaccacagggtcattctcagggtatgcttcaattatttatgacaggtgcatctaccatacacctgctccccaagtggctcccttgtactatggcagcggtggtggggagggatttgtgtaaactctgccctggagggtggggaaggtgaaggttggatgtaaaatggcagcagctggggctggcagtggtgctgctgggtgctacagggcttgtagggttccataaagagggctgagaaggtgttgactttgtctgccccctgcacctcatggggaaacagtggcagtttcacagtgcaaaagtctttataagtgttctccgtctggttcagatacttggcctggatcttgtgtcaggcctcacatatctttcaggattttcagggttggggaagagaagctgggtgatgatgatgttgtatgtgtcaatcttgtacttggccagctcctggatcagtcactctgtctcatacagggatagaactcagggatatattcgcagatgatacaggtaatctactcagggcccttgaactgtttgctgacaaagtagatgatggacagtgtctacttcagcatggaggacagcacgtctgtgttcatgtccccaagacctagaacgttgcatgtctgtaagataaaggggctgatctggttcttgatctgctgagtgtcatgtcaaccaccaccactgagaagttcatgcccttcaccagcctcatgacctcagcatagctcatggcctcattgatgccgggaaaggcgctcatggcttcctgcatcaacttcttgctcatgctcagcatgttttccttctcaaagaactcactgggcagctatgctgcaccctggctggggtcaatttccacagtgaagaggttgtcagagcctttgaccttggtaggcacctttgagaacttctggtcaaaaccatctgagatgttgtgggctaggtctgtggagatgatcagaatactttcatgcccttttgatagctggatggccaggctgcaactgcaagtggtctttcccatgccacctttgcgccagcaaggatccacttaacttaaggctgcatttctcaatgatgttgctaaacctaggctccagtggctcttggaggctgactttgggagactgaggtggaaggatcacttgaagccaggagtttgagatcggcctggaagtgagaccccatctctacaaaaaaaaatttttttaaatagacaagcatgattgtgtgtgcttgtagtcccagctactcaggaggctgaggtgggaggatcacttgagctcaggagttcaaggctacagtgagctatgattgcatcactgcattccagcctgggcaacagagcaagtccctgtccaaaaaaataaaaaataaaataaagaaagagaggaaggaaggaaggatggatggatggaagaaagatttcattatttttagggaatatttttaggaattccttatttcctaatttttatttatcttgctcagcactttgacttctgttttttttttttttttgaaatactgtaggagtaaacaagcgtcacgtctataacttactcttaaatagttccaaaaaatgataatatgtatatacatatgtacttatatgtctgtgtgtgtgtgtgagagagagagagagaaaagagagtgagtgagagtaaatgtagcaaaatattcacatttgagtaatccaggtaaaggatattcaggaattctttgtgctattataactttttggtaaatttgaaattacaatatgtcaaaatttttaaaaattaaaatcttcaaggaaaaacttcaacaacttaaagaataaaaaaaattgctcaatgaaatttgaatactcgttttggcaaaatctgtttatggcagacatatggtgtacttctgtatggcctttaagatatttttaggaacttttttgttttactttagaggaaagattaatgtctattaaagaactttgtagtttagtcaaatacaatgaaaaattagtgcaaatatgcatttttaagcttggtaggtcaaatgtttgttttggatttctggtcatgatggcttgcagtgttcatgacttgggcctcttattcatttcatacacatggtaatgatacataaaattttctaagatttttaaggacatagccatgtataaaattaatataaattcatctgactaggaactcactaaaccacaatgcagtaagtgggactgtaaccacatgcctcctgtgctctggattcagaaggcgtaggtaactgaaagctcatttcttgaatggtggagactcaaaatgttatacacacagtgcaggagactggagctagccccttttgcctccaccactttaagaaagactcaaaaaaagttatgactgctacctgagaaatggcttacataaaacctggaggtttagccaggtgcggtggtgcacacctgtagccccagctgtttggaaagctgaggcaggagaatcccttgagccaggagtttgagaccagcctgggcaacatagtgagaccccgtctattaaaaaaacaaaaaccttgaggtgtgggaggaagcagacagccttacagccaggtcttagtggtccaacctccttaggggtacagtgacaatctgtatgatatccctaatatcaggaatggagccataagccatccaatacaagacctggttctggactagggtctgtccacaagagagagtagaaacctcccacttcacatgaacttatacgctgaaattctaaaatacatgaggaacactgatgttgagaaagatagtcaataaacccaataaacataaatttactccagagaaaacaaaaatagttgaacatttaaaactgactttgaggccaggttgaggtggctcacacctgtaatcctggcattttcagaggccaaagtgggtggatcacttgagcccaggagtttgagaccagcctgggcaacatggcgaaaccctgtctctacaatcctgtctctagatataaaaaggcatggtggcatgcgcctgtagattcagctacttgggaggcacttattatctttaaattattcattctctattctgtctggtcagcctgaataatgcaggttctacaatgtatctaccatgtaggtttatttttatttatttatttatttttgagatggagtctcgctctgtcacccaggctggagtgtagtggcgtgatctcggctcactgcaacctctgcctcccaggttcaaccaattctcctgcctcagcctcccaagtagctgggattacaggcatgcaccatcacgcctggctaatttttttgtgtttttagtagagacagggtttcaccatattggccaggctggtcacaaattcctgaccttgtgacccacccgcctcgacctcccaaaatgctgggattacaggtgtgagccaccgctcctggacagtttatttttatttatcttactcagcactttgacttctgttttgttttttgttgttgttgttagttctggaaaattctcagccaatatatatacatgtgtatttcttgagataggatctcacattattgcccaggctggagcgcagtcacgtgaatcttgcagaattgtagaatctgcattacttaggctgaacagacagaatagagaatgaataatttaaaagataataacataaagagataaaaaactatgaagacaggtaagaggcattaaaaagctacaatgtatatctaataggaaacagaagaaaatgatatagggaatggcaaagaagcaatattttaaaaagaattggggggtgcagtgactcacatctataattctagtactttgggaggctgaggcaggaggattgcttgaggaccagcctgagcaacatagcgagctcccatctctacaaaaaaattaagtttagccaggcatggttgtgtgcacctgtagtcccagctactcaggaagctgaggtgggaggatcacttgaacccaggagttcaagcttctagtgagctatggtcatgctactgcactccagcctgggcaacaaagtgagatcctgtctcaaaaaatgtatatgtgggctgagaattttcctgaactgacaaaaaacagaagtcagtttaaagtactgagcaagataaataaaaataaacctacatggtagatacattgtagaatctgcattaatgataaagaaaattgtttatatgaattataagaatgattaactccaaaggaatggcaggagtttgacagcagtttgcttgatatcagtgataggtgcgaggtgacaactgggtggtatctttaaagtgctgagagaagataagtaacaaccagaattctccactgaattaaatttcactccagaaggtaaaataaagatattttgaggtagatgaaaactgagagcatttaccactcacaggcttttgctgaaagaactacaggtttatgtatattaataaatttcacaattcaaaaaaagctttgaaaacctgaagttgtcctttggtaagttttcagcaacctcatttgtggggcaaacttgacctaaactagttcatgggctaattttggtctttgtttatcccacttagtgtgaatacttatatgtttcactgtggagactttaatatgtttgaatccatggggtgctatcccaaccctgctgaaggtgttatatcacatctggtttgtgcaacctttataaaatctcaaaatttgtcacttccaaaccagaaaggtcccaggatttcagataagtgattatggatcttattaaaggattatggatcttatttctttagcaagaaataattgaaccaagagtgaaggagcagaatgtgggaaacagtagtgagcatgaaaattgatttgataaatgtaggtaaacttaattaattattgatttttttaaagtagtcatttttttcttttttctcttttttttctttttgagatggagtctcactctgatgcccaggctggagtgcagtggtgccatctaggctcactgcaacctccgtcccccgggtttaagcaattctcctgcctcagcctcccgagtagctgggattacaggcacctgccaccacacctgggtaatttttgtatttttagtagagacggggtttcaccatgttggccaggctggtcttgtactcctgacttcatgatgcacccgcctcagcctcccaaagtgctgggattacaggcgtgagccaccactcccagcctaaagtggtaatttttacatttaaaaaggtatattgtcctgtaggtatgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccaccaaaagaaaaaaaaaaaaaaaaaacttctagagcttataaatgaattcagcaaagttgcaggggacaagagcaacacataaaaatcagttgtttctatataccatcaatgaacaatctaaaaaggaaattaagaaaagcaattctgtttaaaagagcatccaaaagatttagtctattaggaataagtctaactgaggaggtgaaagacttgcacactgaaaactataaaacattgctgaatgaaattaaagaagagctaaataaatagaaagacaccctgagtacatggataggatgatgtaacactgttaacatgtcagttctacccaaagcaatctactgattcaacacaattttcttttcttttcttttatcttcttttcttttttttttttttttttttttttgagacagagtctcactctgccacccaggctggagtgcagtggcgtgatctcggctcactgcaacctccacctcccaggttcaagtgattctcctgctcagaatcctgagtagctgggattacaggcatccaccaccatgcccgactaatttttgtatttttagtagagatggggtttcaccatgttggtcaggctggttgattgaacacaatttcttttcttttttttttttttgagatggagtctcactctgtctcccaggctggagtgcagtggctcaatctcagctcactacaacctccacctcccgggttcaagcggttcttctgcctcagcctccagaaaagctgggattacaggtgcccgccaccacacctggctaatttttgtatttttagtagatacagggtttcaccatgttggccaggctggtcttgaactcctgacctcaggtgatctgcccgcgtcaacctcccaaagtgctaggattacagacgtgagccaccgcacctggcgattcaacaaaatttctatcaaaataaataggctttttcactgagagaagaagctaatcctcaaaatcatatggaatagccaggacaatcttgaaaaaagaatataaaattggaaagttcaaacttcccaactataaaactagctatgaagccacagtaattcaagtattatggtcctggcataaggacaaacatatagaccactggaatagattaggaagcccagaaataaatctttacatatatggtcatttgatttcctgcaaaggtgcaattcaatagggaaaggacagtcttttcaaccaatggtgctgggaaaactggatatccacgtgtgaaagaatgaaattggactacaacactcttagaagaaaacaggggacagttttcataacattaaatttagcaattatttcatggatataacaccaaaagcataaggaacaaaaaatatagataaattggacttcatcaaaattaagaacttttgtgcatcaaaggatactatcatgaaagtgaaaggacaacctacacaatagaagaaaatatttgcaaatcatatatccaataaggaattaatatccagaatatgtaaagaactcctgcaactcaacaacaacaaaacaacccaatttaaaaatgggcaaaggacttgaagagacatttctccaaagaagatatccaaatggccaacacatgaaaagatgctcaacatcattagtcattggtaaaatgcaaatcaaaacaacaataagatgccacttcacatcttctaggttggctgttttttaaaaaggaaaatagcatgtgttgctgaggaggtggacaaattggagcccttgtgcattgctagtgagaatgtaaaatagtacagctgctctggaaaacagttcggttgtttctcaaaaggttaaacctataactaccatatgacccagcaattgcacttgtaggtatacatctaaaagaattaaagaaggaactgaaacagatacttgtatacaaatcatagcagcattattcacaatagccaaaaggtggaagtaacccaagggtccatcaacagatcaatggataaacaatagatggtacatacatacaaaggaatattattctgctttaaaaagaaaataaatttatggccctgcagtggcttacacctgtaatcccaacactttgggaaggtacggttgaaggatcatttaaggccaggagttcaaggcttgagaccagcctgggcaacatagggagaccctgtctctattatttaaaaattatgaaggaaggaaagaaggaaggagggaaagaaagaaagaaattttgatacatgctacatgtacggcccttgaagacattattcttagtgaaataggccagaacgacagatattacatgattccacttatatgaggtacttagaataggcaaatatatagagatagaaagtagaatagaggttatgagggtctggggggtgggcagaagggggtgttgttgtttaattgatgtagagtttttgttggggatgatgaaaaagttttgggtattgatagtgttcatggttgcacagcattgtgaatatatttaatgacactgaattgtacagttgcaaatggttaaatgataaatattatgtatagtttaccacattaaaaaagttttccaatttaaaaagagatagattctagtcacattctaaaaaataatatcagaagatgagaagactgcacataagttatagaaagtgtgctttgggctttgtcttgttttatttttatttttgttttgtttgtttatttattttgagacagggtcttgctctgtcacccaggctggagtgcagtggtgcgatcacagctcactgcagccttgacctcctaggctccagcagtcctcccacctcagcctctcaagtagctgggaccaaaggcatgcaccaccatgcccagctaatttttgtaatgtttcataaaatcaaggtttcactatgttgcccaggctggtctcaaactgctgagctcaagcagcccacccacctcagccttccaaagtgctgggattataggcataagccaccatgcctggcccattgtcttgttttggagagttataaagataatgagtattttcagacattttcaaaaatatgtagataggccaggcgcggtggctcatgccagtaatcccaacactttgggaggctgagatgggtggatcacttgaactcaggagtttgagaccagtcagggcaacatggtaagaccccatctctactaaaaatccaaaaaaatagctgagtgtgatgatgcctgcctttggtcccagctaattgggaggctgaggtgggaggatcagtgcttgagcctggagggcagaggttgcagtgagccaagatggggccactgcactccagactgggtgacagtgggagacaatgtctggggaaaaacaatgtagataaatattatgttaatgttttaagatggggtctcaccatattgcccaggctggactcaaactgctgggctcaagcgatcctccatcctcagcctctgagtagaactacaggcatgcaccaccatgcctggctgattatgttaaattttaatactgaaagattatagattttgtctatagcttccaaactaacagggagggtagaaaagaattaaaacaaaactttactaacacaatagaaggtgggaaaagaaggtggggaaagggaaagaagaatggataatgggaaagacaaaataagatatcaggtcagaaattaatcagatacactgaaaagctactcgttaacatatagtgactgtaaggttgggtagagaagcagaatctagccatatgctatttacaagagatatacataaacaaaatgacctagaagggttattaaaggcacagaaacagatacaccaggaaaataccaatcaaaataaagctggtattgcaatattataataaaaatatcagactcaaagcctggaatttagaaaaattagtaagatatagactttcaatatttcctgtgtggctagcttcaaagatacattctacctggcatcacttacctgtctttcttatctttctaaatcaatttccacaaatatttatgagtaactatcagttaggtaatgagtcaggtaatatagtagaggcaaagatgagtacagcctaagtgcttactccatagaactgacagtctaataggagaaagtccagtaactttaaaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaaaccaccccaaactggaacagccactccagttatgtccccatagccatgtcatccttatggcagctggtataggccagggagagtacagaaataatatcttttttcttttttttttttttttttgagactgagtctcactctgttgatcaggctggagtgcagtggcatgatctcggctcactgcaacctccacctcccaggttcaagtgattctcctgcctcagcctcccgagtagctggaatgactggtgcacgccaccatgcccagctaatttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtagagaaggttctccttagaactgactgtttgatctaagctgggaaggaagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgaaaccagcctgtccaacatggtgaaaccccgtctctactaaaaatacaaaaattagccaggtgtggtggcgcactcctataatcccagctattcaggaggctgaggaacgaaaatcgtttgaaccctgggggacagaggttgccgtgagccgagatcgtgccactgctctccagcctggacgacagagcaagactctgcctcaaaaaaaaaaaaaaagaaaaaagaaaagaaaagaaattggggctggatgtggtggctcacacctgtaatcccagcattttgggagcccaaggtgggaggatcacttgagcccaggagtttgagaccaacctggacaacatactgagacttcgtctctacaaaaaaataaacaaaattagccaggtgtggtggcacatacctgtactcacagctacttgggaggctgaggtgggaggatcacttgagctgagggaggttgaggctacagtgagtcatgattatgccactgactctagcctaggtgacagcgagatcctgcttcaaaaaaacaaacaaacaaacaaaaaagttaaattttattctctgggtattatttgaaggcttttttttttttaaagaccctgttgcagccgggcacggtgactcatgcctgtaatctcagcactttgggaggccgaggcgggcagatcacaaggtcaggagatcgagaccatcctggctaacatggtgaaaccccatctctactaaaaaatacaaaaaaattagccgggtgtggtggcgggtgcctgtagtcccagctacccgggaggctgaggcaggagaatggtgtgaacccaggaggtggagcttgcagtgatccaagatcgcgctactgcactccagcctgggtgacagagcaatactccgtctcaaaaaaaaaaaaaaaaaaaaaaagaccctgttgcccaggctggagtgcagtggcatgatcatatgatcatagttcactataaccttgagcttccaggctcaagtgatcttcctaactcagcctcccaactagctaggactacaggtacatgcctaccatacctagctaattttaaatttttttgtagagacggggttttgctgtgtggcccaggctggtctcaaactcctgggctcaaggcctcagcctcccaaagcactgggattacagatgtgagccaccatgccccatcttatttgaaggcttttagataggagagtggtgtggtgatatctgagctctagaaagatcattcaaaaggcagtgtagaagatggcctagactagagacaaggaacatagaagtctggtagtagttgagtgagagattagacccaacactaaggcagtatggagacagaaggggcactttcagagatagaatccataggatttggtgattggatttggcattaagatgagagagaagaccgtggtaatttccaagtttttggcttgggccactgggtaagaatattttttaaaagccttcaagtaatagccacagaataaatttcaatttttttttttttttttttttttttttttggagacagggttttactctgtcacccaggcaggaatacaatgacacaatctcagctcactgcagcctcgaccttccaagctcaggtgatcctcccacctcaagtagctgggaatatatttgtgcactaccatgtgtggctaatttttctattttttatagagttggggtttcgctatgttatccaggctggtctcaaactcctgggctcaagccactcgtccacctcagcctcccaaagtgctggggttataggcgtgggctaccatgcctggtctcctactttcatattatgtgttttcataaatacctttaagacaatttcttgcttgcttgcttttctttttctttcttctttcttgccttccttccttcgttccttccttccttcccctccctccctcccctcccttccttccttcccctcccctccccactgaggttatagtcagtgaataggtagtctccctgcttttgaatttatgagattccccaccatgctctaatcaatgctactgctacgaaactgtaacttttctaaatagctactaaatatatagctattaaacttttatatgtagttactaaatcttttctaaaacttttccacccaatatcttattagttccactgccctaagaaataggtaaagtgggtattattgtgcccattttgtaaataatgaaattgtgtaacttgcagaaagatttcatggtgaattagtagcaaagctagaaattgaacccagatttactaatatgctgatgtgctatttctactatttttacttcaatcattgcctctttgacatataactctggagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgcatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctcatgaagactgtaacaaacctcttggtatctaagcaactttagactcttggaagcaaaagttatattagaattttaaaagcctttaaaattacacttctcactttgctaattttttctgtataggaatattaatctgaattttctaagtctggcaaagattgatattctcttaatgtaaatctttacttctgtttagggatatcggctcaaaagtgccttctccaagtttattttcaattagaatttaattttcaatatatacatatatacacatacatacatatatatatttcatttgataaaataatgataggtacttcctcttctatctgtgaagaagtatctactaagggaattgccctcttgccactaacaatgagaaaatcagcatatctgaaacaacagttttcagacattgggcaataggcagtgggggctgtggattctgagagccagtttccaagcaacagtatagggagagagattgtcaaagagcttagcagtgttattgagttgaggaggcagagactggggtttagggaggctggagcagccagtatttacaggtcagaatccaagagaggaagaagttgttcagtgagctccagaatctttggctacaaattctgcatatgtgtgggctggaaaaagaaccaccagaaaacagtgggccaaacaatttctggagtatacaaggggctaaggataattcaaacttctaccagccatagggaagagacctcaaaacacaccgggcactgggtagagttctcaacagtttaaaagcaaaaaggattaaatcgatccgcaagtaatttaatgctatataagaacaaaattcaataatctttaaaggaatttaacaaaatccagcattcagcaatgcaaaattcacaaagtctgacatccaattcaaaattaccagacaggccaggcatggtggctcatgcctacaatcccaggactttgggaggccaaggcaagtggatcacttgagcccaggagttcatgaccagcttgggcaacagagcaaaaccctgtctctacaaaaaatttaaaaaattagccaggtgtgacacctgtggtcccagctactctaatggctgaggcgggaggattgcttgagcctggaaagttgaggctgcagtgagctgtgatcgcaccactgcactcaagcctgggcaatagagtaagaccctgtctcaaaaacaaaacaaaacaaaataaaattaccagacattaaaagaagcaggaaaatacagcccataaccaggagaaaaattaatcaatagaaacacagatccagaaatgacagagatgatggaattaactaacaaggaccttaaaatagttattttaaatcatataaatatgcttaagtatgtaaagaaaacatgaatatgattaggagattagtggaagatattaaaaagatccaaatggaatttctagacatgaaaaatacaatatagtgaaaatgataataatagcaattaacatttattaagtgcttctatgtagattatctcatttttcttcacaacaaccctatgtgttaggtagatgctattatttcctttgcatagaaaatgaaacagatttagaatgttaaataacttgctgtaggtcacacacccagtcaatgaaaaagccaatgccaggagaagccatgaagtctgactccaggctgtattattgcttcagcgtgttatgcatcaacactgcatgacaggctggaaatacaaatgagtaagtgacaatacttgccctcaaggagctcttattctaggagaagaaacagtagcataggaaccaacccaaatgcccatcaatgatagactggataaagaaaatatggaacatatacaccacagaatactatgcagccataaaaaggaacgagatcgtgtcctttgcagggacatggatgaagctggaagccatcatcctcagcaaactaacacaggaacagaaaaccaaacactgcatgttctcactcataagtgggagttgaacaatgagaacacgatggacacagggaggagaacatcacacaccaggtcctgttggggggctggggggtgaaggaagggaagttagagggcaggtcaatagttgcagcaaaccaccatggtacacgtatacctatgtaacaagcctgcacattctgtacatctatcccgttttttttagaagaaataaaataaactagattcttaattcaaccccaccccctctctgccaaaaaaaacctgagtggtgtagaaatagtctccatagagtacaggtgatttttagagccacacataagattccataatagcacaagggagaaaatagtcaattctatagaagcgggtgaaggctataaaggtgcaaagacagttgggatggatcttggagcagtagaaagctgttaagcaaataaggaatacgttctaaaaacagggaacacgatttctgaaagtatgataacatgaaacaacatggttcctttggaaagtggtaagaagtcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtgagggataaaggactacaaattgggttcattgttactgcttgggtaatgggtgcaacaaaatctcacaaatcgccactaaagaacctactcatgtaaaccagataccactggttcccccaaaaccctatgaaaataaaaaatttctcctgaagttagtagaatcttctccatttgtgtggtattttcacatgtaacacagacaaaagcatggaaaatgtaaggcaggtaaaagtgaaagcatagacccgttaggagactactacaatataacagaaatgaccatgaaaatgaagagctatttaagaagttggtttgacaggatttgctgattcattgtgtgagggatgtggcagagaaagagtcaagaatgaatgccagaatgtaaagtatggccagttttatccctctcttgcttttttcctttccttttttttctttcatcttttatgtttcactctgaattcacagtggttttgtgttcatatttattcattcgacaaacatttatgtatcagttcttggtgataaagcagtgactgggacagacagaaatttttattcttgtcaactttgctgtatgatcagaaaattgacaaaaatccctgcttttatagagcttacattctaggaatcagggaattgcagtgggtctatctgagtatgtgataaaaatctgttagtttttctaaaatatctattgtttatggtggacaaagtgatgtcaagggaaaatgcagacactttaggctgaaatgaagatgttggtctgacttctttttgtaattgccttgaacttcacttgattttgcttgtcactaatccttatcttcaccagtaaaaatcattcagtgaggattaatagcgctttactacaggagtgggtggctgtctttgaattattaaagagcaattgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaattttattgtttggagaaaaataaatgtatattataacatcatatataagttgttcaatggtattattttttgaaaagatcagatgactcaaaggctagtatgactgaactgtgtctgccccccccaaattcccatgttgaagccatacctccaatgtgactatatttgaagaaattcctcctgtaaggaggaaattaaggttaagagaggtgataagggtagggcttcatcagataggaaggattagtatccttgcaagaagagacaccggaactggtgtccctgtaagaggagataccagagagctgcccatgcccctccacgtgaggacacagtgagaaggcagctgtctgcaaaccaaggagagagcctttaccagacaccaactctgctggcaccttgatctcagacttccagtccccagaactgtgagaaaattaatttctgctgtttaagtcactcagtctatggtatttgttacggcagcccggacagactaacacagaggtcttctttttaactcacagtttcagcacagaaagattcattttattttgcatgttgactccaaaacctgttttgatttatcattaacattttatctgaagttgtgagtatggccgtgttgtgaccctgcgttatcaaattgagccatctaatttatttccacattgataaacttatattcaatggattttagtttaaggtagaaataatggtaattactttttttttttaactgtagtcctcatacctgccttatgtcaatcaggaaactttagtataaaagaataaattttgatacaactgcttatatccctgcaaataactcagaaagatctgcagcttaaagactttgtcctaataaaactgacagcctgtatcaatctgtatgttatccaatgtaatattttttaaaatgtaaatgttaattttgaaaactgcatgtgtaattttggccaggcacagtggcttatgcctgtaatcccagtactttgagaggctgaggtgggcagatcatttgaggccaggagttcaagaccaacctggccaacatggtgaaaccctgtctctattaaaaacacaaaaattagtgaagcacggtggcgcgcgcctgtaattgcagctactcaggaggctgaggtgggagaattgtttgaacctaggaggcagaggttgcagtgagccaagatcatgccactgcactccaatatgggtgacagagcaagactccatctcaaaaaaaagaaaagaaaacttcttgtataattttaactgctagtgcttatctacacaatatttttggctgccttctcttttatgtgatcctctactccttgaatttttttctgccattgcctttccagtcaccgtacaaatatgactaccttatactactttgttagtatcttaacacttaaagacttccattttataattatcaagcattttataaaataataaatttactttgcatttgcttctataccagatcatataagtaaaaggagagcttgacaacatctgtcttctcatccagtataaagattttatgtaatctcagctttcatgccaatatagtcctggattaaaaagaaaataaaaagaccagagcagataataatttcctaatcagtggcacatttacagttgcaaatatatatatatatttgtggagtaggagaaattccacaaatgagttaacctatgagcacaggttgatagtgtgtgtatattaaaatttactgtgtaacatatttagtgtacattttgtttttcttatagactttaaataaaagtatgtttttaataagaattgaaattaaacttttatagaaacttctaagtgcctctgcaaatttctaagcttctgtggaacatggtttgaaaactactgatctacttcaacccttccccattgtgtaaatataaaaatcaaagccaaggtctcctagtcacttggtaggacctgtaaaaccaagactaaattcaggtcttctggttgtcagtcaaatgttctagccattatcatgctctgctgctaaatgaacatatacattttgtgtcatttagtctctgagatgaatgtatgattttgtagcccaaaacgtaattgtagtagttaaggcataagaatgcattgcccatgtgattttatttcttctttcattgttttacagatgaaggtaaagtagctacaagttctttaattttaagttccattttacctatcttcaagagaaaaaatagttactccacctggtttaaaatttaaaaataataattcttattagagagggacgtataatacttgtttattggatatttcatgctttgaaggacataataagcagattttggaagttctttgaaaatacaagagttttattgttgttgttgttgctgtttattttattattattattttttttttgagacagagtctcactctgtagcccaggttggagtgcagtggcacgatctcactcactgctacctcctcctcctgggtcctggttccagcaattctcctgcctcagcctcccaaatagctgggattaccggcatgtgccaccatgcccagctaatttttgtgtttttagtagagacgggggtttcaccatgttggccaggctggtcttgaactcctgacctcatgatccacccgccttggcctcccaaagtgctgggattacaggcatgagccaccgcacccggccgttgttgctttttaattttaaagttaggctgaagtgagactgtaacacacaacgttattaaacgcattctctaaagtagatctaccaagccaggcacagtgcacatgccggtaatctcacttgagcccaggagcccaggagttggagaacataagtgcactatgaatgtgcctgtaaatacccactgatctgcagcctgggcaacagagtgagacaccatctcaaacagggtgggtggatggatggagagagggggagagagagagagagagagagctggaagtatgtaaaagcaaatataaataatgttgaaaatttaatattttccagttttattttgcttggcataacctgctcttgattcccactgataccgcctgaccctaatttagaaacctaattagacaccttggggaggttgtcaaaaagacagattccttgatcccacctcaaacgtactcgaccacagccagcaggcaaggggcctgggaattaattttaacaagcatttcaggtgattcttaggatcactcaagtttgggaaacattaagcggtttcaaccctgcttgcatattaggatcagctagggtgcttttaaaaaatactgttgcctaggtccctccccagaccactttaatcagaatctttttggttgggacccaggcattttaaatgctctgcaggtggttctcatacacactgaagcttgagaactcctgcaagacagttggaaatgtaattctctgaagcacagccctggtcttgtcactgctgctgagaacctcaatggttctgtattgcctactaatgaaatatgaatttatgactatcataaggctactcatgacccaacaccagctttccaaccactactctcctacttatagactatactctggccacacagaaacactttccccaaacactccttgtgctttccccctttcacacctctgtttttgctttcccaccatgtagaactttcccccatgtctgtctgtcacagtcctgcccatcctcaaatagacccagctcaagtagattcccatttcctcctgtccttgccctcccctgcctccattcaaaagcgacctcttagggcatttgtcctatcataccttatatttagttattggcagatacatagtctctttcataaaatgccatgtggaattaagaataagtggatttttatctttcctttttccccatctagattgtaaatttgtaatatcaactatctgtttacttctgtgtgaggcactaaagagaaagactttagagtcaaatggccctaggttcaggtgccttttttattggatatggctgtgtgaccatggtcaggttaatttttccaagccttagttttctcatctataaaatggagaatatactacttcagtgttgtgaaaactagatttgataaccgactggagccttcagtaatcccggtatgtaataactgctctgtcaaagtctgttgcttttatcattgtgataatgatcattgttagctcccttgagggcaaagactgcatattttatctttggatccccattctgaaccttgcttattgtaggtgcttgataaatactgggtgaataaaataatgaatgcctgctgggtcgtgcttacttatatagtccactaccaatcagttcagcctgtcttggaaggagcacttcaaatttcaatttaaccatcagataaagatagaaaataggatttccactacaaactttaaaaactgtattaaaaaggccaaaaccccagttaaactgtaagacagctgctctctttctgctgccaggaaatagagaaaaccctccaaggactatttgctgtttgtttgtgcatcatataataaacatgctgtgacttggggagagcacacacttcccctgcaggcaagcttgggtttgggaagttgcatgtagcagcagtgaggaagaaatcccccactctgtgggagaggttccttcacggactccactaagcccatttgcagttttgctgagttatttactaagatgaagggactgggtgtggctggtctgagattcctcctgggaagtcacttcaagaatctccttaatttcctcacccttcatctttgttctctggctttggtgcaagggtgcagtcagtcgcacccagttggctgctgttcccagcacactgaattatttgaagctggctgtggcagccaaggattccctgttctgttcttttccccttgccctgatttgaaaaacggtctggaaattctcatctggcatgaccagaaggaacttagtaggttgcaagctgtttttctagatgcacaggaccaaacagaacctttaaagctgtaaattaccatttctcaaaaactcaatttgatggattttacatggacaaattatataacgtaggctttaccatcaccactatcgtttaaacaagaggccatccaattgagatgaaaccgatataggaaagtaattatcatcagctttgtcacttgaagaaggaatgtgaggatatattagctaattgaaacctcaggaaagatgtataacaaaacatataaggattaatgagtagtccacaaaagtgtttaccagatgaccaatatcttttaaaatatatagatgtattccagctcttttaattagaaaatatatatatatacacacacacatatatggataaaaaatgaacttataattacaatagatgtgatgacaaaataattcatagtctgaaaaatatataatttcagtgatcagagccttatgtattatgctaattgtccaataatttcttgaaagtatgtttctacttttaaagtaaaattaaattcagaaagcaatgatgagcaaatatgtgataatattctaggcagacactgaacatttatatttattgtgagaacagcatgatggtagagtactatttatataaaattatgtatctttatgtctttatatgtttacatgcatacaaaaatatttggaaggaggtttactgaaatgttgtgaatgattttctcttagtgttgagactacttttttcttcacacatttttatattgtctgagtttttataatgagcatataacatttttataatcatagtaaaaataaagctatttttatagctttcatataggaaaattttgcttgagcatctgctatgtgtccaaagtggtactagaaattatgagatataggaaagaaggctgtggcctggctaccaagatgcttacaatctagctgggaagacaactagggagtgggatcctatagaatgtaatccggtgtcgggatgtatggttcaaaaaggtgctacggagcatcaggaagaggagaggaagctctcaatggaaggaagctttcatcgaaaatgaagattaggctgggtgcagtgactcatgcctgtaatccgagcactttggggggccagggtaggagggttgcttgagcccaggagttcaaaaccaacttgagcaacatagtgagaccctgtatttttttgagaaatattttaaaacttagaaagaaagaaaaggaagcttagattggaccttgaaagatggacaaaaattgaataggagggagagaagaaggcattttaggcagcatgagcgctaaagtgataataataatgctttttgaaaagaaaggaggaaaccagcttgtctagaataaaaagtaaatatgatttgtgatggagaagtttgctttattgctaagtttatttcataagatatctttgatatattacaaactatatttttgtatacttgagcaggtcctagaaaaatattttgtaattattctgaatattgactctaaagtgatgtaaaaactatgactactatgaaaaattcattattttagtgtattgagggtagaagatttcagtacatatgctgtgtaacactgtcatctctgtgcacaagcttgttctcaagtcaaacagtggcttttcatatagtcttttaatttgtggttaatatgttcctacacctttcttcttctattaaaaaaatcaaattagccgaacgtggtggtgcacacctgtaatcccagctacttgggaggctcaggcgggagaatctcttgaactcgggaggcagtggttgcagtgagctgagattgcgccactgcactccagcctgggcaacagtctcaacaacaacaacaacaaatcaaaaagcaccagttgccatggctcatgcctatagtcctagcactttgggaggcaaacatgggaggattgcttgagcccaagaatttgagaccagcctgggcaacacaatgagaccaacatctctacaaaaataagaaaaactcaccaggcatagtggctcacgcctctggcccagctacttgggaggctgaggtgggaagattccttgagctcaggaggttgaggctgcagtgagctgtgatcatgccactgcatttcagcctgggcaacagagcaagatcctgtctcagaaaaaaaaaaaaaaaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaagaaaactgatgtataactacttgcaaaaggaaaaaggtatgtttgtgccatagaggcctaaaagggttcaagaattggaggtgggttcaagaattggaggtgtcggccaggcgtggtggcctcacgcctgtaattccagcactttgggaggcagaggcagacagatcacctgaggtcaggagcttgcgaccagcctggccagggtggttaagccccgtctctacaaaaatacaaaaattagctcagcatgatggcaggtgcctgtaatcccagctactcaggaggctgaggcaggtgaatctcttgaacctgagaggtggaggttgctgggttgctgtgagctgatattgcgccactgtactccaggcctgggtgacagagcgagattcattctcaaaaaaaaaaaaaaaaaaaaaaaaaagaattggaggtgtcaagtactctgaaactgggagtgagaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttattttccagctcccttcccttgcttagctgtcagaatgctggcttccaaatgaatataccccaggtgggattctggaatattttctggagaaactgaaatagcctcagaggaagtccctacaaatctgacatttaggagttgcacaatgaaatgaccaggtttccgcccattcattctacagtgaagctcaatataaacaagctccaattcattcagataaccagttttttagtacctcgcaccaaataggaatgaacatattcaggtattcaaggatcaccagaaatttgggggaagtctctaatatgatagccagaagccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaaaaaaaagaaaactgaaggcccagtccaggagtataagacctaaaaatttgaagttctagaaagagaaattggaagaactagaatgccatcaggcttctcaacagcaacatgagaagcttaaaaaaaaaaaaagtgcaatgcttttagaattctaagagaaaattattttcaacctagaattctgtaccaaaccgaactatcaatcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatgacaggttagaagaattactacagtagtttggttggggtgaaatgagttataacttccaagagaaccattttagttgagtgacggaagcaacgttgaaggagttactgagtgaatgaatgggtagtaagaaagaggaggtaatgagcatagcatactcctctgagaaatctggctttgaaaacaaagggaggagaaagcggtgttagtgagttgagtctatgaaagattttttagattaagacaccacttagacatgtgtgcatagacagcaaggagttaatggagaaggtaaggtcaacgatgcaagcgtaaaggggatagttggtggagcaaggtcccagaaactgagataacatggactcaagagcatagatggaaagattaattgtaggaagagaagggaaagatttctttctctgaaagaaggaaggaagaggtgcagataagtgaaaatgcagagaaatattaaggtataaaggaaggaaattgagggacttaaaaaggtggcttcagtcttctcaagaaaataagaggttctctgctgagagtttggatttggggcataggattagcttggaaatttgagaatggaaaatatctgaaggcatgtgatgccaagttaaaaggagatgactaaaatgattatccagtagccacgagtgtccagttgaggttagatagcagaaatttgtaataaagccaatcaatatggtttctggacttccctcaagaacgttctatctccaaaagttgtattaatcatcatcttggctaggatggcgtttccttggagtgtcttaagagacattccagggttcaaaaactttagaaaatgcttgctcaaggagagtcagtgctcaagaataccagagagaaggttttcttgtgggacacttcaatctaggtcattcggaggtcttgtgggggatcatgagcaacgaaaaagaaatatacttgagagacttaaatgacacaaaacagtttgatatcaaaaagatctgtagctgcatggacatctggacacaaatctgagggtgagagcgtgttggagaacacctggattcagataaaagaagagcagaagagaagtgacatcattgtgggattagaatatagactacctagccagatggaagaaatagataaagcatttctgatgcagatcgcaaaactggcctgagtcaagagagcttggtgatagggatttcaagcatcagcacataagctcaaagtcaagttcagccaaaagctgcatacttgattaattctttttttcctgtttgtttatgtttttctgatcaaagaaaaacttgctcattgtagaaatgtagtagtacaggaaagtgtaatgaagtagaaaaataatcactcataaatccactcaccattaaaatacttgctaattatttctagtatttttatgcattgttgtctttgcatagtagagattatgctgaatatacatttgtctaaactgttttttaacataaaagacttttctcatatatatttcttatatatctcatatattttcatatatatctgaaattctttttatatgttcatctttcagaaggaagaaatacggccgggcgcggtggctcacgcctgtaatcccagcactttgggaggcggaggcgagtggatcacttgaggtcaggagttcgagaccagcctgaccaacacggtgataccccgtctctattaaaaatacaaaaaaatttagccgggcatggttgcacacacctgtaatcccagctacttgggagggtgaggcaggagaatcacgtgaacccggaggcaaaggttgcagtgagccaaggtcatgccattgtactgcagcctgggaaacatgagtaaaactccatctcaaaaacaaacaaacaaaaaaaaggaagaaatatgagataggagtccaagatatatataattataaaaataatttcagggccgggcgcggtggctcacgcctgtaatcccaacacttggggaggccgaggcaggcggatcatgaggtcaggagatcgagaccatcctggctaacatggtgaaaccctgtctctactaaaaatacaaaaaattagccaggggtggtggcacgcgcctatagtcccagctgctcaggaggctgaggtaggagaattgcttgaacccgggagatggaggttgcagtgagccaagatcgtgccactgcactccagcctgggtgacagagtgaaactccgtctcaaaaaataataatttcactatttactctttgctaacattatttccatttttctgaaaataaccagtcaatgctactgtattaggcaggaaaaagaaataagaggcataaaaattttaaaagagaaggaaaaattacatgattgcaggtgatatgattacttagctggaaagcccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaattaatctacattggggagagcatttaaattaatgagcacaactggtagccatgttaagaatatgatattggattctttcctcacatcttatatgcaaacaaattctagatggatcaaaaatttcaatataggccagctacagtggctcatacctgtaatcccagcactttgggaggccgaggtgggaggattgcttgaacccaggagttcaagactagcctgggcaatgtaaagaaatctgtctctacaaaaaaaccttttttttttttttttttacagcagggtgtggtggcgcacgcttatattaggttggtgcaaaggtaattgcggcttttgccattcgtagcaatagtctcagctactcgaaaggctgaggtgaggggatcacttgagcccaggagttggaggcttcagtgagccatgatcacaccactgcactcccgcctgggagacggagtgagaccctgtctcaaaaaaaaaaaaaaaaaatacaaaaaacaaaaacacaaacatgaagaaaccacagaaagatgttcttacaatctcacagaagggaagatgtttctaagagagctgataaaaaaaaacctggaagccataaaagaaaagattgatatattttgttgcagaaagaggaaaaatatttgcttgccaacaaatactgtaaacaataacaaaagattaacaacaaacagaaagtatttgcaacttatatcacagatgaagggctaatttccttatatacagagttcctaaaaatcaataataaaaataccaaaaactcagtagaagattgaaggatgaaaatgaacagagtttatagtaaaggattgtataagtggttctttaaaaattatttttaataactagattgagatataatttatataccatacaattcacctatttaaagtgtacaattcagtcgtttttagaatattcagttgtaaaaccatcaccaaaatcagttttagaatattttcatcaagccccctctgccaagaaaaataccccgtacacattagcagtaactcccctttttccccacccacaaactcccagtcctaggcaaccactaacctactttctgtctctgtggatatgcctattctggacatttcatatagattatatatagatagaatcatacaatatatgggcttctgtatttggtttctttcactcaatgttttcttttctttgtttttatttaagttcttggggtacatgtgcaggatgtgcaggtttgttacataggtaaatgtgtgccatagtggtttgctgcacagatcaacccatcacttaggtattaagcccagtatgcattagctattttttctaatgttctccctcccccgacctcaccccccaacaggccccagtatgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccatgttgtaacatgtatcagtactttattcctttttgtggccaaataatattccattgtatgattataccacattttgtctatccattcatccattgatagacattggattgtttccactttttggctatcatgaataatgctgctgtggatgtttgtatacacacttttttgtgaacatgttttcagttctcttggatatatacctaggagtggaatattgggtcatatggtaattctgtgtttgaaagaacagccaaactgttttccaaaatgcctgcactctgttacattcccagtaacagtttatgagggttacaatttctccacattcttgccagcatttgatgttacgtgtcttttttattatcgccagcctagaggtgtgaaatggtatctcactatccttttgatttgtattttcctgatgactaatgatgtcgaacatctttttacatgcatattagccatttgtgtatcttttctggagaaatgttcatccacattgtggaatgtatcagcacttcattcctttttactgctatgtagtattccgttgtatgaatatagcacactttgctttttgtttgcttgttaatgtacacttgggttatgtacagtttttgcccattatgaataaatcttctaggaacatttgtctccaggtctttttatggatgtatgttttcatttatcttgggtaaatacctaagggttgaattactgactgctttctaaaacagttgtaccatcttacattcccaccagcaatgtatgagaattccagtttttacaattgcttgttaacatttggtattgtcagtcttttgcattttagccattctagtggttgtgaaatgaaatctcattgtggttttagtttgcatttccctgatgactaatgatgttgaatactttttactgcttgttggtcatttgtatatcttcctttgtgaagtgtctcttcaaatattttgcccaatttttagtgggttgtttgtctttttattatccagtggtaggagttctttacacattctggttacaagttagatatgttcattacaaatattttctccctctgtggcctctttatttatttccttagtgatgtcttttattgagcagaagttttaattttttagcattttttttcttttatggttaatgccttctgggtccagtctaaaaaatctttgcctaccctaaggctgtgacagtgttaccctatatttccttctaaaagcaatagaggtttaacttttatgtttaggcctataattcatcctgaattattttttgttggtagtttaagattgagggtcaaggtttttccccgctcccctcatggatagccagttgagacagtatgatttattgaaaagactttccttctcctacttgttgtggttcctttgttaaaaataaataaataaattgaccatgtattaatatgtgcatatctatctctggattctctattctgttccattgatctaaggtagtgtatgcccttcaactttttctttttcaagattgttttattcattcaaggccctttgcatttccatataaaatttagaataaactggttcatttctacaaaaaaagcctgatgagaattggattgaaattattaagaatcgccgggtgcgatggattacgcctgtaatcccagcactttgggaggccaaggtgggcagatcacctgaggtcaggagtttgagaccagcctgaccaacatgcccctgaccaacatggagaaaccccatctctactaaaaatacaaaaaaaaattagctgggcgtggtggtggacacctgtaatcccagctagtcgggaggctgaggcagaagaattgcttgaacccgagaggcagaggttgcagtgagccaagatcacgccactgcactccagcctggcaacagagcgagactccatctcaaacaaacaaacaaacagtaagacccgaaatattatttttgaaccccaagctcacttttgtatagatatacctactctagaaacaatgacaaaactaggaattgtgacacaatactaaagacaatattaaaaggcttttttaaaaagttacattgggagcaaaaagaacaaggaggcctaggtgggtggtatcatattaatgaatgaaagaaagaaaatagagcattcacctctattttggtttagtcttctctgtcaaagaggatactctttggactggaaaagataaaataaacactggttccagggaatgcagtcaaacgtagttgagattgaaataggtcatgcaactgctttaaatgatttcaagttccttaatcttatatttcaagatactgaggactaggctgggcgcagtggctcatgcatgaaatctcagcactttgggaggctgaggtgggtggatcacctgaggtcaggagttcgagaccagcctggctaacatgacgaaaccccgtctctactaaaaatacaaaaattagctgggtgtggtggcaggcacctgtaatcccaggtactagggaggctaaggctggaaaatcacttgaacccaggaagcagagccaaggtcgcaccattgcactctagtctgggtgacgagtgaaactctgtctcaaaaaaaaaaaagatactgaggactagtggatgagctggctgaagcattgctggcagtctctgagaaagtgtgcatggggagggggaattaggggatgggggtcggggatggatagaaatttcagaagattagagtcaaggaactaatattcaggaggtcacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatccaaaaaaaaaaaaaaaaaaaaaaatagctggctgtggtagtacatacctgtaatcccagctacttgagaggctgaggcaggagaatcccttgaacccgggaggcagcggttacagagagccaagattgcgccactgcactccagcctgtgtgatggagtgagactctgtggaaaaaaaattttttaaaaagaataaattaagaaaaggaagttgggatcaccataagcttaccagaatttattgaagatggagacagaaaaggggaggaagtagggggtaaagggggaaaggaagaagggaagagaagataataaaggggaagggaagggacaggaggcgaaggaaaaggaataggaaaagattccaggcttagtgggtaaagaagacttgatttcaaccctggctcttttacttcttagtaaaatgatgttaggcaagttattaattgctataagctagatttccttattggtaaaattgaaataagagaaactacttcatagagtagtcctgatgattaaattaaataatgtgtataaagtgcttatttatcaaaagcagtgataactgtgaagggggtgaatgatggtaatgacaataatactgacggagaaggaacgggagtagacaatgtaaacttactccctttttgaagagattattacattggtaagttgacagaaatctgtacagtatagctatatttagtatagctatatttagtatatttgtttagctaaattggatttctacaagactttgacaacatctccatgacatccttgcgaacaaggagaaggaatataggctggatgatataggctggttgaatagtcatacttaaagtgtgctgattaatgggttcctgtcatgctgaaattctccaggagtgtaaatctggactatgtacttagccaagcttttttaaaaaatcattatttgcataagagcattgatagcaggctaattaaatttgggaacaatagctaataagctgactgaaaaaaacagaacctaaaaagaaatggtataatacagagcaaagaatatggccttaatgtcatggatctatcactactagctgtgtggctttgagtaaattgcttaaccacctgagccttttgttcctcatttgcatggagataatactacatattccatgtggttgtgagaacataaaagataatatatgtgtattatcacacctgtaatcccagcactttgggaggcccagggtgggcagatcacaaggtcaggagatcgaggccatcctgaccaatatggtgaaaccccatctctactaaaaatacaaaaattagctgggcatggtggtgcgggcctgtaatcccagctactcaggaggctgaggcaggagaatcacttgaaccagggagtcggaggttgcagtgagccgagatcgcaccactgcactccagcctggcaacatggcgagactcaaatatatatgtgtatgtcaaatgtatgtgtgtgtgtgtgtgtgtgaattagttatctatttctgtgttataaatctcccccaaaaaacctgggggcctaaaacaatacacatttattatttcacacaggttctaaaggctgggaatccaagagcagcttactggggtggttctggctcagagtctcttctaaggttgaaatcaagattttgattgggactgcagtcatctaaaggcttgaatggatctggagggcctgcttctaagctcagtcatgtgggaggcctcagatctttagcacatgatcctcgtgatatgaggaactggcttccccagagcaagtggtcttagaagaagagagcaagcaggaagccacagtgcctttatcacttggcctctgacatcacattctgtcgcttttgttttattttctccattagaagcgtgttgctaagtttagctcatattcaaggggaaaagaattaggatccacctcttgaagtgggggagtatcatagaattttgtgggcatatcttaaaactgcaacaatctaaaaagtactcagtacagtgcctagcacataagtgctccataaatggcagttgttattctactattaatagtctacacttaatatacatatacaattaatatacatggtccctactatgaaaccggtgtgggtaggacaagataaactcatgatttcttagattcctggaaaacacagaaaaagaagtaccacatatgactacattaattacatctgttttgtacaccaaaatgaatggattatttttgcactgcatgtaatgcactaagaacaggactagtaaaaataaattttagtaatatttatttatttatttattttgagacagcgtctctctcttgcccaggctggagtgcaatggcacgatctcagctcactgcaacctccacctcctgggttcaagcgattctcctgcctcagcctcccaagtagctgggactacacgcatgcaccacaacactggctaatttttgtatttttaatagagatggggtttcaccatattgtccaggctggtctcgaactcctgacctcaagtgatccacctgcctcggcctcccaaagtgctgagattacagatgtgagccactgtgcccggccaaattttagtaatatttaataggcatacataaaatgtatagtctgtaaatatgagtgatatgaaaaattcgaatgacaacctaaaagtgatattatatggttttgttaaagagttttatatgtacatttaaatataagtattgatcatctgagaactcatcaaagcttaactgaataatgtatcaacttgtctttctgagtgtccttttctcatttccatttaaaaatgtgccacagctaagactgacaggccccagtctgcagcaaagatggggaagacttggtagttcacacgcctcccctgagggcaaggagtaattctggggggatgtaaactaacaaacataaaagtattatatcggcaaaggggtcgattaagtaaaagagttgatgttgacagtaaaaatttagaagcaataattaatgtggctgaatcactagataatttcctctttatgtatacatttatatgtgtatatatatatttatatatgggtccataatgcccatcattagcctcaaagattgtctaatgttcattggaaacaaaaacataagaactctcccacccgggtggacagagtaatttactgagccactttggtaagataagaacattagattgaaggtaatgtcacaccttaaacttgttaatttattggtgttttgatttgcattaaacattagacagatcctcaggctagcggctgacatggtagaactctccttagtatctcaccaaaatagcagtcaaacttctaagatgttcaaaacatagttactaatttgaaagtaagtagaaatggttgctgaggagccaggatttacagaggttatatgcatcattgtaggtgaggcaggaagtctcctaagatttcacagggagcctcctgacttataaatgcataaatcacagtattgatcaggtcagcagtgacagataaaaagtagtgacgtgggttttaactgttgctagccttagccacacactgacagttgtgataaatggtaacagaaaagggagttattatagatccaaacagtgaagagaaaatatatatttaaaaaccaacattttaagtaagataggtagtaatttactgtgtagaggacaaataaatggctttatacgtctttttgttctttttttgtttgaacggagtttcgcttttgttgcctaagctggagtgcaatggtgggatctcagctcaccacaacctctgcctcccaggttcaagcgattctcctgcctcagcctccggagtagctgggattacaggcatgtgccaccatgcccagctaattttttgtgtgtttttagtagagacggggtttctccacgttgctcaggctggtctcgaactcccgacctcaggtgatccgcccgccttggcctcccaaagtgctaggattacaggcgtgagccactgcacctggcatgtctttttgttctttaagggtatctactatggtccaagaaaatgagcagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctcacgcctgtaatcccagcactttgggaggccgaggtgggcggagcacaaggtcaggagatcgagaccatcctggctaacacggtgaaaccccatctctactaaaaatacaaaaaattagccaggcgcggtggcgggcgcctgtggtcccagctactcgggaggctgaggcaggagaatggcatgaacctgggaggcagagtttgcagtgagccgagatcacacaactgcactccagcccgggcaacagagcgagacagcgagactccatctcaaaaaaaaaaaaaaaaaaagataaggaaattgagacatagtggttaaaaatttacctaacattggctgggggcggtggctcacacctgtaatcccagcactttgggaggccaaggcaggcggatcaggaggtcaggagatcgagaccatcctagctaacacggtgaaaccccatctctactaaaaatacaaaaaaattagctgggcacatccagctactcgggaggctgaggcaggagaatcacctgaacccaggaggcagaggttgcagtgagccgaggtcacaccactgcactccagcctgggtgacagagcgagactccatctcaaaaaaaaaaaaaattttacctaacattgttcatgtggttaagtggcagagcccagaatcaaagtgaagtctgagtacctccatccaggtttactatctcagtctacgtgttttatggaaatgaggcatgccctttctgagaaggaatgatgttattatacctccttatatattttcattaagaatgagtgaggatctcctcctttattatttattcatgtgaccctttcttttccctcaccctgtgggaggctgaataatggccctaaagatattcaggccctaatccaggattatccaggtgaaccctaaatgtaatcacaagtgtccttttaagagggagtcagatagagatttgatgacgggagaggaagaagacaatgtgacacaagaagtgggtgtgtttggagcagggaagtgacatgacatggggccacaagccaaggaatgaggataacctctagaaactggaaaaagataggaaactgattctcccctagaacctccaggaggaaccagcctgctgacaccttgattttagtcccataagactcattttggacttctggcatccagaactctaagagaataaatttctgttgttttaagctaccaaattgtagtaatattttatagcaaccataggaattgaatacatatcccatattactggcttcaggacttatttgcattatactttctccttgtatttttcctacattttgtaactgtttattacttccagaatgcaactgtagagtgtgtaaataacatattcgtaaaagcattgtttcagataaagtctaaaaaagaggtattttattttaaaataatatccaatcctatggctatcccatatcccagcctttccaatggctgtaaaagggaaaattatgggacgaatgttgtcaagtatataatgaaaggaaatcttttcaatatgaatgatcaataaacttgtagaaaaatgtccaccataacgagagtcacaccagttaatcataacccacatctctgactaggaatgcagtaggtttcccccattcccaccactctttatttggagatttgttgaaacctataagagaattatgagaatagtatgaaggcacttgtctgcccttcaccaaatgctaactaatatgtcaccatatttgtgaacaacagatagataacttgaaactaagttatgggaatcatgacatcttacccctcacatccctcatctcctaagagtaaggactttctcctcttctcctgcataactccaatgtcatttgagaaaataacactaattttataacatcacctaacatccagtccagtgcaaattacaatttccccaattgttcctaaacattattaatagctgtttgttttctgacccagcatccagtcagggtttacacattgcacttggtaatgtctctttagtttcttttaatctggaacagaccccttacaattttgttttcatgatactgacttctttgtgttttcctgaccctcccacactagaatgtacattttacaggggcagggattttcgtctctgttaattgccatgtccttagcattgagaatgctgcctagcactttgtaaatatttgtttaataactagatgaatgaataagtaatacaagtacaatgagtgtcatgaaaggtgatttagaggatgccaagggtcctgagaatctaatctgttgttgtttgtgtgtaactcttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccacatggagcttacattccatgatgaacaaacaatacttaagtaagttttttgagggtaggggctctgtgctttcacaagagaggcaacatagcgtaatggtcaagagcagtggtttttgagccaccagacataggtttgagtcccagtttgtatacttttttgctgcttggtcttgggtaagttccttaagctctcagagcctgagtttccccagtagtaaggtcatggcaaataacagtacagcctcataggttgggaagggacttaagcgagataatgcatgagaattgtctcacatggtgcctggcacttaatagcttcttgataaatgttagttgttgttttcatcattattaacattgactaactaaaacatgtcttactagaaaagggatttgaaaccaaatgatgaagaacagttgaaggaaccagggatgttaaactcatagaaaagtaaatggaatacatgcttactggtttcaaatacttgatgatgtagcatgtgacctgagcttacttattctgtgtggtcccagaaaacagaattaggtccagccggtggaagttaccaggaagacaattttcacaatgtaagaagaaatgttcttaacaattagaattatctataaatagaaagagctgcttgggaggaaatggattttctgtcattagagataataaagcaggtactagacatgtgctctccaatatgtagccactagcctcctatggctatttaaatttaaagtaattaaaattaaatacagttataaaggcagaggataggatggtggtttccagggattggggaagggagaaactgggtattgttgttcaattggtgtaaagttacagttatgcaagatgaatcaattctaaagacctgctctatagcataatgcttataactaacaaaattaggaacctaacaatttattaagagggtagatctcatgtcaatcattcttaccacacacagagagagagagagagagagagaaacttttgaggatgtggatatgcctgttatcttgatggtagcggtgatttcaccattttatgcatatatccaagctcatcaaattgtacatattaaatatgtatagttttttgtatgtcagttaaacctcaataaagctaatttttaagaaattaaatacaaatacaattcagttatttagtcacattagtcacgtttcaaagtgctcacaagccacatatggctagtggctgctgccatattagtgcagaataacaaacattgccatcatcacagaaagttctgttgtatagtgctgttctggacaatgaacaaagatgtttaagaagaaatggaggcacaagatgagaaagaagagctgaattaattaggtaacttgtaaagtccattctaagcctcagttttatagattatgaaaggtcatcttttaaccatttcattttggaataaaggaagagttattctcacagaaataaaactgttgtgttatttggagatatttttattttactgatttgacttaaaaattgcttcttttcagctcatcactctagttagagaaataaatttctgaggggaaatggcctagcaatggcatggcccaggagaagtacagtaatcattgcatctttttcctgaaagaactttccatgattttttagttcagcctgaagagccatttgtgacgcttaaaaatcaatgaaggggaaaaatgggactgagctgggccagttttcaaaggacatgaggggtgagtcttgtttcagttgctagtattagacaggatttcatttatgaactttgttctcttgtccaactccagttcctacaggtttcctttttcctttgctctccagtcaaaaggaaaaatactcacatgattattagaaatactggagcaataaattgtttgagggacttgaaacaccctttttttctttcccttcaaagccttaaatgatagttgcttcattgaagcttacagatcattaaaagcagtcctgccagggtgttgtaatatatgttttagcttccaattgaaggaaaatctctaccaaactaacctttgagtcatacagaattttttattttctatttttgatgtcttgggtgttccagcactttttcatcacctgccatatacaaaattcccatatcttatttgagccaaaaatgaagcctggtatcacctctaacaagtacaaattcctagcgcttttcaactatgttattatttgcctattttatttattgcagaacagttcccaaggagtaatgtcctggagaaacagaaataacactgtagaagagcagtagtgttatggacattgagagtaccattgcaaaacctgattttttttgcattttcatggcttcagtttcgagtaattgtagatggacagaggccaagctgttttcaatttgacccttggttaagctaaaaaactacataacaactaagggtaccctatctcctgttacagagatagatacataaaagggccagactaacaagaaaccaaatagccagtctggggtatggccagagaatctgtaactctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaaaaaaaaaagttactatcaaaatgtttccaaagttcaaaagcagaagaattagcactttttagtttctttttataaaatgcatctacttcaagccatagcaaatttgaagtttcagatcctctgtccacaagattgagtacttaacgatagcccttttggctccttccagatctcctaataaagcagggagctcctctcagcccggccagccaccccgtccgggagggagatggggggtcagcccccccacccggccagccgccccgtccgggagggaggtaggggggtcagccccccgcctggccagccgccccgtccgggagggaggtgggggtgtcagccctccgcccggccagccgccccgtctgggaggtgaggggcgcctctgcccagccgcccctactgggaagtgaggagcccctctgcccggccagccgccccgtccgggagggaggtgggggggtcagccccccgcccagccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcggcccccctgcccggccagccgccccgtccgggaggtgaggggcgcctctgcccggccgcccctactgggaagtgaggagcccctctgcccggccagccgccccgtccgggagggaggtgggggggtcagccctccgcccggccagccgccccgtccgggagggaggtgggggggtcggccccccgcccggccagccgccccgtccgggagggaggtgggggggggtcggcccccctgcctggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaataaataaataaaaaataaaaaaaaataaagcagggagctccttcagtgtccagcatactactctggggagaaggcctcttcatcttgtctagagcagggcttcagatatctgtgccagaggcttaggaaagacctaccacttggaatgtagaacaaaagaaatgattgttttcttttttctttttttttttttttggagatggagtttcgctctgttgcccagggtggagtgcagtggcgggatctcggcacactgcagcctctgcctcttgggttcaagtgattctcctgcctcagcctcctgcgtagctgggattacaggtgtctgctaccacagctaatttttgtatttttagtagagatgaggtttcaccatattggccaggctggtctctaactcctgacctcaggtgctctgcccgcctcagcttgttttgttcattttaaacaattttccataaatttataaagccattctccatgacatgcttaccactttcacggtctgtgtaaatctgatccatcagtaatatagtatggcagcacctaattatgtgttttgtgaaaagctatggaacaaaaagtaccacctgttacttaactccctaattgtaaaattgtgttttatttctgtgccctgaggttggaccacagtattgtgataaaccatgggactgacgggtcttgctacccattcctgttctccattaaaaaaaaaagtaatcagatttcttctaactctcaaacctctaaaagcgcttctgaaaacttagatctaactgtttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtccctggcacaaatgaagactcgctcttcttggcagcatccatggctgctaagagaaactttgccccactgcctttgatgtggtgaaacaaagcctttaccagagtggttggaggatctgtcaccctggagactcctagggacccccacccacaacctctttgggaagttcttttcctaaagttgtattcagatttataccaatatgcagaggagacgtctttcttataaaaagcttgcttttcctctcaaagctgtgaagaagctagtgaaggggaagttgaactgggtataatattgacaaatgttttgagcacttcagataaaaatgtttgataagtgcagtcctgtttgtattgccttattacactgctcattggagaaagtgttttctttggtcacctgccaatgaaaaagattagccttttcctgtatttaggattgtttctttgactagttatgttggtagaacaagatagacaaatgctgctgaaattagcaaatcagtattggaacacagtgatactcatttctcctcactgccctttccaattcattgacagttgccgcaagcagtatgaatgggttttttataggactctctttctctccttacctattccaatttgtattttcactttagttcccttgctctgatgttcaagactttaaaggatttgccactgcccaccacaccatgctttcctattttataggatccaataagaaacattttttcatttaaatgcctcttctataacatgagtcaccttttagatttctataccttgtatcttctagtttctattttagtacagaaaaattatagtttcatcttctttgaggcaagatatgaagatttttttttgccctccctcaaatttattccctgtttacagcaaaggaagccactggctgcttttctaacatttctctatcagaagctagttgagctaaatgtatatacttttatattccccttaatatgtttagattgatctggggtacatcttttggatctggacattatgaaacaaagttaagccctttaacccatcatcagcctacatctgtctcttcagacaaaaaggaaatgaacttccattgctgtaggaaaaatttatgtcacacataagggcaaatttgttagcaataatgttattcaagccaggtgtggtggcgcatgcctgtaatcctagcactttgggaggccgaggcagtggattgcttgagaccaggagttcaagaccagcctgaccaacgtggcaaaaccctatttctactaaaaatacaaaaattagcctggcatggtggcatatgcctgtagtcccagctccttgggaggctgaggcacaagaatcgcttaaacccagaggcagatgttgcagtgagccgacattgtgccactgtactccagcatgggcgacagagggagaccctgtctcaaaaaacaaacaaaagagatagtgttattcagtactgggttcctaagcagtattacagtataaccttctctgaaattctttgcttttgtttttaatagaatagattttcataaggaatggattaggtgcagaccttcttgacagcatgagataacaagttatttcttgaagtcactctttagaataaataagtcgtattttattctgagggaatttttttttttttttagacagagtcttgctctgtcacccaggtaggagtgcagtggtataatcttggctcgctgcaacttccaccttctgggttcaagcaattcttctacctcagccttctgaatagctgggattacaggtgcctgccaccacaccggctaatttttttttttttttttttttttttattttatttttagtagagatggggtttcaccatgttggtcaggctggtcttgaactcctgaactcaggtgatccgcccacctcagcctctattccaagggaattttaacattgatttaattgagagaatcaaaagagcctgagggtagtttacagagaagagcccttttaggtagtattttttatttgacttgccaacctctaattctcactgacttatggtgagtttcaagtatggatagttttaagatgtggttagttcccatgactacaaaataaaatatgaatttcccatgttacttgaagactgtttgtgggaggtcttcatttaggtctttgcatcttctcaggagcatatcataatttaatagcctgtcatcggaaccctgcaaagatagtgatattcatcttagaaaaaaaaaaaacttgcatacctcctatacagcattctttgctgccacctaaagccatttgctcatgaaacagtaacctttagaacaatagcccgagttctcttcctatcagtcaattcttagagactctattagcaccttcctttgcttttgtcctgtcagatggagagacggggttggcagaagcaaaacagcctttataaatttttcttagaggtccgtgatcctagattaaagtaggaatcagaagacatcaggtctagaaatcctcagagtgaccttttttgacagagaagatatttatatgaagaaacatcagtgccaatgacctaaatttagctatctaacctctcaatatgatcatttctctgcttgtaaaaggggaatagtgacaccaatcactaccgtcctctggagtttgagagatacttaatgaaataatgaacgtaattctcctcttgcaagggaatatattgttgacttttaggagaatgatttgggggtccctaaggggcttaacaatctattacctctctggcactcaaataggattattgtaaaaagctaatctactgccaaaaagtaagccatttattctgtggatagatcaggtccagtgtgaaaaaaaggattttgatctcttttttggaataactattactaactagataggcacaaagatgtcttttttttctttctttctttaaaaaaaaaattagaacagaagtgtaattgtgtttgatggttcactttgggagaatgttaggttcaatcctgaacacagtaaatcagatgatatacttcttttaaaaagcctctagaatatgccttctcaattgaggcaatattgcctccaagggggcaaaaattggttctttgggaggcaaaaaaaaaaattagatattataatggtttgtgacccttaaaaaatatatagatagataatatgttcatgatatcaaaatttcatggggagtggacaaatagaaaaaaggtctaaaaagctagggggtgataatgaaaaaaagactgagaaacttttctcaagtctagaatgtgcatataactgtcaattactctttcagctgtgtttgtccctaagcatgggcaagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaaaaaaaaaaaaaaaaaagccagattgggagaaagtgtggccccaaaggcatactttggagagagtgtggccccaaaggcaggaagggaataattgactaaatagtaatgtaaagtgtacagcatcggcagggtgtggtggcttatgcctataatcccagcactttgggaggccaaggtgggaggatcgcttgagccctggagttcaagaccagcctgggcaacatagtgagacctcatctctacaaaaaatacaaaaaaattatcctggtgtggtggcacatacctgtagttccagctactctggaggctgaggtgggaggattgcttgagcctgggaggtgggggttgcagtgagctgagatcatgccactgcactctggcctgggcaacaaagcaagaccctgtctcaaaaaaaaaaaaaaatgtacagaatcaaagtcaagaaaattgatgggaattgacactgaagtacttaagaaattttaagtttgctcttgctgctggtattaataaactttcatatatccaacatattcttccttccacctttctcatatgtcttattagttctttcaaacactcagaatggatggaatgatccaaaattgacttgctacatactggggaatttggaagggacctgtgttttgcttagcagccctgaaacaatagaatggccttttttttttttttttttttttttgagacagggtctcactcttgcctaggctggagtaaagtggtgctatctcagctcactgtaacctctgcctcctgagttcatgcgattcttgtgcttcagcctcctgagtagctgggaccacaggtatgtgttaccacgccctgctaattttttttttaattaatggggtctcactatgttgcccaggatctcaaactgctgagctcaagtgatcctccctccttggcctcccaaagtgctgggattacaggcatgagcgactgtgcctgataatggccatatttaaagatatattttttcctcagtctctgactcttccttgcttaatcatcctattctttaatatacaaacctataactttgaggaaagagaatcagagattatttctccctacttacccatttcatggtgcgacaatgagcactcttctccaagccaagcatttgataagcattcattgctatgggtattttactgccttaaagaaatccaccccaattccctgccgattgatttcttaagatcacagaagaaagtggaatgaatcctagagaggccttcaagctccctgacacccatggggcccactcatctccacccccaatactccaatttcaaaatctaacacattgtccttttcttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatccagcgtgttgaaatgtttgtcattttatgaccccaggaatgctgcagggtaaggcagtctgataccagatctgtgcttgcaaacccctcttgtgttcagtttacatctgtttgtctcaacaggtggaagcctaggaaaaggctatatctgctaagccagaatctggggtgggaattctccaggtcaacctgcagttcccaaatcaaaatgaagttccagagtaccagggtttgatctctcattgcccttccatcagttaccccagataacccaaacacttgtttccagtgtagtgaaggatggtttgaggatctaagcccagcttggtaaggaatgaagaaactcccatttcatgtagctcatgtgcctgccagccaccagttaagtccctgtgcctattatttagaggattcaaagagtaacaagggccaggcatggtggctcatgcctgtaatccctacactttgggaagcagatgtgaggggatcacttaaagtgaggggttccagactagcctgggcaatatagggagacctctctcaaaaacaataaataaataaaaattttaaaagtagttgggcgtggtagcctgtattcccagctactcaggaggctgaggtgggaggatcacgtgagcctaggagtttgaggccacggtgagccatgatcatacaactgtactccagcatgggcaacagacagagactctgtctctgaaaaaaaaatttttttttaattaaaagaaacagtaagtacagctatcatttattgaacacttactgtgtcctaggcatggtactaaacatttttgttatataatcctcacaataatcccatgaaggtattcccattttacagatgaggaagttgaaactcactgatttgatgtcatgggtctaagatcacacatcagcaagtggcagaagaggagctcagatttcgatctgtctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacattgtttcaacaactgaacgcctggtttattacttaaagtactatcattgtactttgtcttaggggtgggaaggagaaccgatcaaattgttgttatcacaaaagctacacctgattgtttgtaaagaaggacttctagtgaaaggatgaaagtgaaacagctatttctctttcttctatttttctccttgaaaattcagggacctaggccaagacaggcggatcacttgaggccaggagttcaagacctgcctggctaacatggcaaaaccccgtctctactaaaaatacaaaaattagccaggcgtggtgacacgcacctgtagtcccaggtacacgggaagctgagacacaaaaattgcttgaacccaggagggagaggttgcagtgagccaagatcacaccactgcactccagcctgggtgatagagcaagaccctatctcaaaaaaaaaaaagaaaagaaaagaacatgaaagaaagaaagaaaactcagggaccttacttggtaatttttacctaggcaaaatgcccaggaatgtttccacagaatggtacccaaagcccacccatgcaggagcccttcctgccaccaaggtaaccaagactaggaagcaattgaaactgggccttcctttcccaggcctgtggctgtcaacttggctcagaaagaggcagactgatgactttgtctccttacccactcacactaccacacagttctcatttgagcctggtcacatggctgtgccttcttatggccaaacaaggatacgctgtttcccgttctttgcaccctgggtttggcctgagcatccttagatgaaaccatcaggacccccaaaccttgaagcttttccaggggcaaattgcatgcaggggaaggaggggctgagctgtgtagtggagcagcggatggtgtgcagtcgggatgtttgcaagagccaaggggttagttcattgctgctttgtatactcaggcacaccagaaaactcagattaataggctgtttattcttcagcatgttccttgaatcaaaggctctggatggtattattaaagagtgtttgtgagagcgccctggaacactcctcctgggctccgctcactgaagaggaacgattgagtcctttcatttcctgggcagcatccctctcactcattgctcactgtagtataaaggtctgtagaacctttgttagaaacaggatcttttgttctgtccttatgaggtcccattacctacagcaccttgatctgttggagtctaattatttaatgttcttgtcttttgagctacctgaacctaatgaatgcagtccactctatctcagggagttgttttgctttggttttttgcctctatttggcaccagtttcctgtttggacagtattgccttttattttcatggttttttttcaaggagtttgtccaggagagaaggagacatccacctgaaacctactctgtgaagcaaatgaatatgttttttctattagaagattctcctaaaatgttctgaagtttgttcatatctgggaattgaagcacattgaattaagaaagaattacttcctccacctccacccctgcaatagagatttatactggacaaggtggcaaaaaaaaattagggggaaactgctcggtacaattcccccccagttcccttggggcagcagcgtgctgcacatgaggaatcactgtaccttgttcccctggcagtgatacttctctgtggccaggcaaatacagtagtccaggccttccacaacttctgcatgtgcgcatgtgcgcacacacacacagacgctcaaaaccatacccctcctgggcatccccttaatagaggcatccagtatattgcaaaggtactcatcactatacacagtgcaaatactcagcactcgtttatagcaaacccagtatgaataattagcaatagtttgggatctggcacaacccttaattaccacaactagaggccagaaaatgaaatcagggtcatatatctgaggttagaactctagaatctgtctggcatcctatagcccaaagcaccacagggaggtacaccttggagcaatgggagcactgtcatccaggagacactgtcccctcactttcctccaaaaccagcacagctgtttgcacgagggctatctgccgtatatacagtgagactaagatatatatacacaccctggcgcttcgcctgatttcttctgtgaagtccatctgtttatccagttccagatcccaaaaggcagtcaccaaaaactaaatagtgagaagggacaggcttttttttttcttttttgataaacatgttacagtgaacaaaacagattttgcaaacacattccatctagtaaatcttacctcacagctgtgtgagaagagcttggaggagagaaggatggggagcaggagggtctcaggacttgattggagaattagaaagttcagaaacccacaagggtgggacagttcagtactatctacttttttttttttttttttttgagatggagtctcactgcgtcgcccaggctggagtacagtggcacaatctcagctcactgcaacctcggcctcttgggttcaagcgattctcttacctcagcctcctgagtaactgggattacaggcgccggccaccatgcctgactaatttttgtatttttagtagagacagggtttcaccatgttggtcaggcttgtcttgaactcctgacctcaagtgattcgcccacctcaccctcccaaagtgctgggattacaggcgtgagccaccgcccctagcctatctacttcttatagggtgataattggccttttcccttcattctagcccctcatcctaaacctggaatctgtgatgggctcaccaaaaatgaagatctggctgcagactttggcttctttcactgaaaagctgatctagccagactttatcttcaaaagacaggccctgcacttctgatgttccctgagcctctcccactgagcctactctcgtccactgtagccatgatgctctctggattcagacaatggtgtgttgtcccagaacactgtatctggcctgtctgtgcttcacatctacccctttggctaggaaaatgagggacagagctcacatcagtaacttggattctgaggaccgaggacaagcagaagaaattgaccttttgcctcagaggtggctggatgtttgtgtgtctctcttcgatgtcaaattggctcactgaaccactcaagagttgttttttaaaaatgttctgctcactcctcatttgcgggtcagatgctttggataatccagtggaattctctctgcttcactgctggttgctgccagacacagagtgctaaatcctgtcagtcggtgacttgaaatgatgatgtgtgaaacagtgctgcgatttggacatcctgcactcatttgcatggactcctttgccagttaaccacagtagtgaaatggggcagcctggggcagcttccacagcccttgccttatctttcctcagtgtccccaccctcccccatggcagtatgtagctccagtaattggtaaggcttggaattctgtttcatttaatattattcccttcctaggcatcatagagcaatttctttaacatgctagattgcaacatgccagagacagagaaatagcatttgtgtgcagaatggagaggcgggaagcaaaacactcttgttgctgattcccatctcccggtctttgcccttccttctttccctagattgcatggctggctgattctcatctggtgagttctcagctcaaatggtacgttctcaaagatgagcctggcacagccatctcatgtggtcccaccctcagtcactgtgtatcacaccaccctgcctgatttatgtcattgctctcctcacttcctaaaagtatttctttctttgttactttttattctctgtctccccaaccactgcctccacacatacacactagaatgtaagtaccatgaaaatagggatttttatctgtcttatcccttgctgtttccccagaatctagcacagtccctggcatacctttgacacttagtatattgactaaataagtagctaagaatgtagcaattaagaacttctaaagcaaatatccatggttactatcaggaaatagtaaaggcagacagacagagagtttgaggaatggaatgagaagacatgatttcttatactgattttaataatggtcttaattacaaattgaatacgttaagtcaaagatcacaatatcgagtcgctcttcatttcttctgactcagactaaactgccccttattgagtaggttaggtcagggtcatagagaccaagtactacaaacttcctggccaaactggcataattgatgccacaaagtatgcccacttccagatttccactgggtggtgcctggctttgctttccttagggcagttgccagaagaaactggcacaatttaaagcagtttaaagcccagcctgggtatcttcatctagcctttattatattcttgcctgcctccagttcccaaaaagactgcattcctgtctgcaactccagggccctgaagccccttcagtcatgaaagccatggaggtgggttagccctgatccacccagcgtgagacagtatgaccaagagaacacatctttttttttttttttttgagacagagtctagctctgccgcccaggctggagtgcagtggcgcaatcacggctcactgcaagctccgcctcccgggttcacgccattctcctgcctcagcctcccgagtagctgggactacaggcgcccgtcaccactcctggctaatttttttgtatttttttagtagagacggggttttactgtgttagccaggatggtctcgatctcctgacctcgtgatctgtccgcctcggcctgagaacacatctttagtccagcagatacatggcactcatctcctcaagagtccttcacccaaacgagaattattagcttctcagaagttatcctttgtcttgttggggcaagatctgtgcctagtgtcaagagagagatgttaaagattaaagagcctccaccaggaaagggaatggttttgcctgaatctcttaatttgtttttccccgctacgagtgcattcatgttgctgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactccacaccccactccttccctgtcttttattgatgctatgttgactttgcatgcctcagttagttcagttttctgagcacctgcagagaattaaccatctctgcttgctgctgcggatcacctaggcctttgatctgtttgatttctgtacttctaaaaatgttgaaggactctctaaccccaccaaagtacataaatggtgctacagttcctgtagcctgacctcctccagactagctctgcttagggaacagaagatcttcatgtaaatacagatgtagataccatttattaaatgttttctatgtacgattttactgttctaagcacttaatgtgaatatttcatttaatctttgcttatagagctaaaaggccatatacatgaactggcccattatttctctaacctcatctcttcttcctttccctcttattcttttggctcctgccatgttggtttccatgctgttcctcttacccaataggcacactccctccttaagactgtaatggctattccctctgcctggaatgctcttccctcagatgtctgtatcagttactccttaaccccttcaaatcttcacttgagtgttaccttctccattaaacctacctagaccactctagagagaattgaaccaccagtaccacctcatattccctatctctgacttgctgtattctctttttttccattatatttatcactgaatctcttaatttgcctcagttaactttctatatagcttatttgtttgtttgtttgtttgttttttgagactgagtcttgatctgtcacccaggctggagtccagtggcacaatctcagctcactgcagcctctgcctcctgggttcaagcgattctcctgcctcagcctcctgagtagctgggattacaggcatgcaccaccatgcccggctaatttttgtattttttgtagagacgggttttcaccatgttggccaggctggtctcaaattcttgacctcaagtgatccgcctgccttggcctcccaaactgtcaggactacaggcgtgagctgctgcgcccagcctatttgtttattttctttatcattcattatctgtcttccccactgcaagataagctccatgaaggcaaagagcttgtctatttcttctctaatgtatcctaagcacctaaaaagtaacatgtgacacataatagatgctacataatatctattaagtcagtgaactttgtcccctaaaaacccatgctgtaggttcttctgttatccccattttgtttatttatttatttttattatattttaagttctagggtacatgtgcacaatctgcaggtttggtacataggtgtacatgtgccatgttggtttgctgcacccgtcaactcatcatttacattaggcaaatctcctaatactatctctccccactcccccaaccccacgacaggacccggtgtgtgatgttccccgccctgtgtccaagtgatctcattgttcaattcccacctatgagtgagaacatgtggtgtttggttttctgtccttgtgacagttttctgagaatgatggtttctagcttcatctatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttataatcctttgagtatatacctagtaatgggatggctgggatggctgggtcaaatggtatttctagttctagatccctgaggaatcaccacactgacttccacaatggttgaattagtttacagtcccaccaacagtgtaaaagtgttcctattcctccacctcctctccagcatctattgtttcctgactttttaatgactgtcattctaactggcgtgagatggtatttcattatggttttgatttgcatttctctgatgaccagtgatgatgagcattttttcacatgtctgttggctgcatagatgtcttcttttgagaagtgtctgttcatatcctttgcccactttttgatggggttgttttttttcttgtaaatttgtttgagttctttgtagattctggatattagccctttgtcagatgggtagattgcaaaaattttctcccattctttaggttgcctgttcactctgatggtagtttcttttgccatgcatcagctctttagtttaattcgatcccatttgtctattttggcttttgttgccattgcttttggtgttttagtcatgaagtccttgcccatgcctatgtcctgaatagtattgcctaggttttcttctaaggtttttatggttttaggtcgaacatttaagtctttaatccatcttgaattaatttttgtataagatgtaaggaagggatccaatttcagctttctacatatggctagccagttttcccagcaccatttattaaatagggaatcctttccccatttcttgattttgtcaggtttgtcaaagatcagatggttgtagatgtgtggcattatttctgaggcctctgttctgttccattggtcaatatatctgttttggtaccagtaccaggctgttttggttattgtagccttgtagtatagtttgaagtcaggtagcatgaagcctccagctttgtcctttttgcttaggattgttttggcaatgcgggctcttttttggttccatatgaactttaaagtaattttttctaattctgtgaagaaagtcattggtagcttgatggggatggcagtgaatctacaaattactttgggcagtatcaccattttctatccatgagcatggaatattcttccatttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgatttttgcacattgattttgtatcctgagactttgctgcagttgctgatcagcttaaagagattttgggctgcgacaatgggttttctaaatatacaatcatgtcatctgcaaacagggacaatttgacttccttatatcctaattgaataccctttatttctttctcttgcctgattgccctggccagaacttccaacagtatgttgaataggagtggtgagagagggcatccttgtcttgtgccggttttcaaagggaatgcttccagcttttgcccattcagtgtgatattggctgtgggtttgtcataagtagctcttattattttgagatacgttccatcaatacctagtttattgagagtttttagcatgaagggctgttgaattttgtcaaggccttttctgcatctattgagataatcaagtggtttttgtctttggttctgtttatatgatggattacatttattgatttgcgtatgttgagccagccttgcatcccagggatgaaactaacttgatcgtggtggataaggtttttgatgtgctgctggatttggtttgccagtattttattgaggatttttgcattgaagttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatccatctggtcctggacttcttttggttggtaggctattaattatttccttaatttcagagcctgtctattcagacattcaacttcttcctggtttagtcttgggagagtgtatatgtccaggaatttatccatttcttctagattttctagtttatttgcgtaaatgtgtttatagtattctctgatggtagtttgtatttctgtgggatcggtgatgatatcccctttaacattttttattgcatctatttgattcttctctcttttcttctttattcatcttgctagcggtctatcaattttgttgatctttaaaaaaaaaaaaaccagctcctggattcattgatttttttgtagggttttttgtgtctctatctctttcagttctgctctgatcttagttatttcttgccttctgctagcttttgaatttgtttgctcttgcttctctagttcttttaattgtgatgttagggtgtcgattttagatctttcctgctttctcttgtgggcatttaatgctataaatttccctctacacactgctttaaatgtgtcagagattctggtacgttgtgtctttgttctcactggtttcaaagaacatctttatttctgccttcatttagttattaacccagtagtcattcaggagcaagttgttcagtttccatgtagttgtgcagttttgcgtgaatttcttaatcctgagttctaatttgatggcattgtggtctgagagacagtttgttgtgatttctgttcttttacatttgctgaggagtgctttacttccaattatgtggtcaattttagaataagcgtgatgtgatgctgagaagaatgtatattctgttgatttggggtggaaagttctgtagatgtctattaggtctgcttgttgcagagctgagttcaggtcctggatatccttgttaaccttatgtcttgttgaactgtctaatattgacagtggggtgttaaagtctcccattattattgtgtgggagtctaagtctctttgtaggtctctaaggacttgctatatgaatctgggtggtcatgtattgggggtgcatatatatttaggatagttagctcttcttgttgaattgatccctttaccattatgtaatggccttctttgtctcttttgatctttgttggtttaaagcctgttttatcagagactaggattgcaatccctgcttttttttgctttccatttgcttggtaggttttttttttttttttttttttgagacggagtcttgctctgtcacgcaggctggagtgcactggtgccatctcagctcactgcaagctccgcctcccgggttcacgccattctcctgcctcagcctcccgagtagctgggactacaggcgcctgccaccacgcctggctaattttctttgtatttttagtagagacggggtttcaccatgttagctaggatggcctcgatctcctgacctcgtgatctgcccacctcagcctcccaaagtgctgggattataggcgtgagccaccgcacctggcctgtttggtagatctttctccatccctttattttcagcctatgtgtgtctttgcacgtgagatgggtctcctgaatacagtacactgataggtcttgcctctttttccaatttgccagtctgtgtcttttaattggggcatttagcccatttacatttaaggttaatatttttgtgtgtgaatttgatcctgtcattaagatgttcgctggttattttgcctgttaattgatgcagtttcttcaaagcatcgatggtctttacaatttggcatgtttttgcagtggctggtaccagttgtttctttccatgtttagtgcttccttcaggaactcttgtaaggcaggcctggtggtgacaaaatctctcagcatttgcttgtctgtaaaggattttatttctccttcatttatgaagtttagtttggctggatatgaaattctgggttgaaaattctttaagaatgttgaatattggcccccactctcttctggcttgtagggtttctgccgagagatccactgttagtctgatgggcttccctttgtgggtaactcaacctttctctctggcttcccttaacactttttccttcatttcaaccttggggaatctgataattatgtgtcttggggttgctcttctcaaagagtatctttgtggtggtgtctgtatttcctgaatttgaatgttggcctgccttgctaggttggggaagttctcctggataacatcctgcagagtgttttccaactttgttctattctccccatcactttcaggtccaccaatcaaacatagatttggtcttttcacatagtcccatatttcttggaggcttagttcatttctttttagtcttttttctctaaccttgtcttctcgctgtatttcttttcttttttttttttttttttttttgagacagtctcactgtgtcgcccaggctagagtgcaatggcacgatcttggctcactgcaacctccgcctcccaggttcaagcaattctcctgcctcagcctcttgagtagctgggattacaggtgcctgccaccacgcccagctaatttttgtatttttagtagagacggggtttcaccatgttggtcaagctggtctcaaacccccgacctcgtgatccacctgcctcggcctcccaaagtgctgggattacaggtgtgagccaccgcgcctggcctcttgctgtatttcattaatttgatcttcaatcactgacaccctttcttccacttgatcgaatcagctattgaagcttgtgcatgcgtcacgaagttcttgtgccatggttttcagctccatcaggtcatttaaggtcttctctacactgtttattctagttagccatttgactaatcttttttcaaggtttttagcttccttgcgatgggttcgaaaattcttctttagctcggagaagtttgttattaccaaccttctgacgcctacttctgtcaactcttcaaagtcattctctgtccagctttgctctgttgctggtgaggagctgcgatcctttggaggagaagaggtgctctgatttttagaattttcagcttttctgctctggtttctccccatctttgtggttttatctacctttggtctttgatgttcatgacctacagatggggttttggtgtagatgaccttttggttgatgttgatgctattcctttctgtttgttagttttccttctaacagtcaggtccctcagctgcaggtctgttggagtttgctggagttccactacagaccctgtttgcctgggtatcaccagcggaggctgcagaacagcaaatattgctgcctgatccttcctctggaagcttcgtcccagagggcagccacctatatatgaggtgtctgtcggcccctactgggaggtgtctcccaattaggcttcatgggagtcagggatccacttgaggaggcagtctgtcctttctcagagctcaaacgctgtgctgggagaaccactgctctcctcagagctgtcagacagggacgtttaagtctgcagaagttgtctgctgccttttgttcagctatgccctgcccacagaggtggagttagaggcagtaggccttgtagagctgcggtgggctccgcccagtttgagcttcccagccgctctgtttacctactcaagcctcaccaaaggcagatgcccctcccccagccaggctgccgcctcgcagatcaatctcagactgctgcgctagcagtgagcaaggttctgtgggcgtgggacctgccaagcttggcacaggagagaatcaccttgtctgccagttgctaagaccttgggaaaagcacagtatttgggcggagagtgtcccgtttttccaggtagtctgtcacggctccccttggctaggaaagggaactccccgaccccttgtgcttcctgggtgaggcgacgccccaccctgcttcagctcgccctccatgggctgcacccactgtccaatgagtcccagtgagatgaaccaggtacctcagttggaaatgcagaaatcacccatcttcggcataggtcatgctgggagctacagaacggagctgttcctattcagccatcttggaacactgcccacttcttttttttttttttttttttttttttgagatggagtttcactcttgttgcccaggctggagtgcaatggtgcgagctcggctcaccacaacctccacctcccgggttcaagcaattctcctgcctcagcctcccgagtagctgggattacaggcatgcaccaccacgcccagctaattttgtatttttagtagagacagggtttctccacgttggtcaggctggtctcgaactcctgacctcagatgatctgcccaccttggcttcccaaagtgctgggattacaggcgtgagccaccatgcccggccttatccccatcttaatgatgatggaattgaagctcaaaaaatttaagtaactaacttgccccagatcatttgtctagtaaccagtggagctgagctatgaacccagaacccaggattgactaactccaaaaaatgtgctttcaaccatgaggacaatcctaagagtcacctgagctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataaatggtttagagacagtaaacatccaaagacgcagaagagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgtttaccctgtctaatctgtattgggcttagaaactagtggccaagcttgttaaaactgcgagtataatcagagtatgtcttggaaccctgtaagttagccacacgagcttttgtatgtggacttcatgaaatcttcttgcctacttggagacttattgacatttagatatttggcattgcctattagttaagttttaaattgactagatattactgtgtaaggtacagatacctgaaaaaaaattccattattctcagctttggaagttgatccaatctatgacttcacaacttaaaagagccttgggaatcatgggctcataggtctggccttttactctcaagtaaatagcaattgattattatctcttttttacagacaaagaaattgatccctaagtgtaagtagcttgttcaagtgaggtagtctggcaaagtcaaggcagagtttcaagtctcccaagcctgcccttccgctctgccacactgttcccaggaggaaacaatcatcttaggctgtagaaaggaaggaaaactatcaataaatatggttaaagattagaaaaatggcccagcacgatggctaatgcctataatcccaacactttgggaggattgcatgagcccaggagtttgaaaccagcctgggcaacatagtaaacacagtgacatccctacaaaaaaaaaattgctgagcatagtgatatgtgcttgtactctcagctactctggagactgaagcagaaggatcacttcagcccaggaattcgagggtgcaataagctatgatcacaccactgtactctagcctgacaacagagcaagaccctgtctcaaaaaaaaaaaaaaaaaaaaaaatatatatatatatatatatatatatattagaaaaatgagatctatggaggatattgtaactattcagttctatgcccttattttgatagatgtttttcctgtcactcctgccctcatttgaaggggtttataaccttagtatgccatcagtgagcctgaacatctctataagggaggaccaaggggcattataataagatccaaaaacatagaattataaaagatgatgatcttttcatcatggatgaaacaaggtgtagggaaggaactaaatggcattcaggtgacttagagggggaagaaagagccactgagaacgagggacatggaaacaggtttctgaaggaagatacatacttgaccatctctgtggatggtttcctgcctgccggcctgccatccttccttccacagctttgttaagatacaatttatataccataaatcaaaatggctttttaaaaaataaatcttcttaaataattcttttttattttttattttttttgaggcagagtcttgctctgtcacccaggctggagtgcagtggcatgatctcagctcactgcaacctccgcctcccaggttcaagcagttctgcctcagcctccctaatagctgggattacaggtgtgcaccactgtgcctggctaatttttgtatttttagtagaaacgtggtttgccatgtcggccaggctggtctcgaactcctgacctcaagtgatccaccggcctcggcctcccaaagtgctgggattacaggcatgagccactgcagccaaccaaaaaataaatcttattcttctgattgcaagaaagcacatatcatccacggtccccaaacactgagttaactactatttttaactctgttgatgtatcccattcttttccctatgcaaatttttattcttttttttgttgttattttaaagcaaacatggaaccatactctatatgacaatttttattttgctctttcctcttaatatcatgaggtcatgtactttgttttcatcttaaactcatttcatcagatgaattaaatctttattgtaaaagcttccaaagagaaattcctcatctggggttgaaaattcagatgccaacactggccaggcaggtcatataagaagcatacgtgttattcggtggtaaactggcaacagcatcctcttccccagctccagctgattgtggtcatgcaggaatgctggcccatcattaccaggtcttctgatttttttctaaaaaagagagctatctgaaatctagattgtgttgtgggaaatatcttaatgttttgcctcaaaatttaaaaagtacacttcaagccaaacaaaacctggctgccagctatattctctgtcccagacagtgagtgctaagagtttcacaagcattatctcatgtattcttcacagcagtcttgctcctctaatggttatttattaggaaccaacaatgaataaaaaatcaaaatccttgctctcttggagcttctgttggggagacagttactgctctggagaaaaaataaagcaggaaaacaagatgggggtagagggagagttcacagcattcccactctgctagcaagttatgtgctagatggtcagattatgactgggcaccgtggctcacgcccgtaatcccaacactttgagaggccgaggtgggtggatcacctgaggtcaggaattcaagaccagcctggccaatgtggtgaaatcccacctctactaaaaatacaaaaattagccagtgtggtggcttgaacccgggaggcggacgttgcagtgagccgagatcatgccattgcacttcagcctgggtgacaagagtgactctgtctcaaaaaacaaacaaacaaattatgcgctacccagtctttgtgctacttcctcaaccacagagaatgacaatgaaagaatcctagaatgttaaacccaaaagcaaccgtcacaattattgagattaaaaggtttgtacattttcaaatagttcttaatggtcttactttttttttttttttttttttttttttgagacagaggctcgttccgtcacccaggctggagtgcagtggtgcgatctcggctcactgcaacctccacctcccaggttcaagcaattcttctgcctcagcctcctgagtagctgggattacaggcacgtgccaccacgcctggctagtttttgtatatttagtagagacggggtttcaccatgttggtcaggctggtctcgaactcctgacctcgtgatctgcccacctcagactcccaaagtgctggggcataagccaccgcacccggccttaatggtcttacttttaaaaaatcctttgatgtcttctcattgctcatacttttgtttactttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgcattttaagaaaatcaaatgcataatctgttccacttcttatttattctgtggctgctttggacagtggaaagctcagaggaagtataataacttttattcatttttgttttctgtggcttgctctcttaagttctcatcagacagctttgctaataacataaaatttcatcctaatgataagcctgattttaaattgcaaagaaaaaggtagtggggccaggagcagtggctcacgcctgtaatcccagcactttgggaggccaaggctggcagatcacttgaggtcaagagttcaagaccagcctggctaagatggcaaaaccccgtctctactaaaaatacaaaaattagccgggcacggtggcacgtgcctgtaatcccagctacatgggaggctgaggcatgagaattgcttgaacccaggaggcagaggttgtagtgagctaagattgtaccgctgtattccatcccgggtgacagagcaagactctgtctcaaaaaaaaaaaaaagtgggaagtattttttatatatataaatgaaatatacttttctcttcctaatctgtgtctagtcctgttaaaattgcagatacaggcttataatggctttaactgtttattacttttgttgtctcttctctattttcttataggcatcagtagcaagtcacttaaaatagaaagggcctgtcagtttgaggggaagcaagttacaagccagacagactacatctgaccctggagccaccctaggacaaaaagtgatagaaagagatggaatagctagtgggagatttaaatgttcacagtaatagtcactggccaggtgcggtagctcacacctataatcccaatacttcgggaggccaaggcagaaggatcatttgaggccaggatttccagagcaacctgggcaacatatcaagactctgtctctagaaaaaataaaaatgaaaaaattagccaggcatgatggtgcatgcctgtagtctaactacttcccgcctaggctaaggcaggaagagctcttgaacccaaggaattccaggctgcagcgagctatgatcataccactgcactccagcctgggtaacagagcgagaccctatctctaaaaaaattaaaataatggccagcacggtggcttatgcctgtaatcccagcactttgggagaccgaggcaggtggattacttgagctcaggagtttgagaccagcctgagcaatatggcgaaaccttgtctctacaaaatatacaaaaattagccaggcgtggtggtgtgtgactgtggtcacagctatttggggagctgaggtgggggggattgcttgagcccaggaggtggaggttgcagtgagccaacatgacgccaccgcactccagcctgggcaacagagcaagatcctatctcaaaaaaaaaaaagaataaaattaaataataaacaaaataataatagccagttgcagctaacatttactgggttctcactgtgggaattcactgtgccaggtgtttttcatccatagacgaaggaaaagcaggttgggttcccagagacttacagcaaaaagaaaaggacatcatagggagccagtctgtgtagcagagaaaggccagcctttgaatgagaaggcttgatctgatccaggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaaaaaaaaaagattttttaatcctctcaaaaattcatgattagcattatcattattcataccattattactattattcactgtcattttcaattggctcgcctaatgtcacatggctagttagcagaagaaccaggatttggacccagatcggctgattcaggagccttgattattattattattttttttttgagatggagtctcgctgtgtcatgttgcccagactggagtgcagtggtgtgatcttggctcactgcaacctccacctcccaggttcaagcagttctcctgcttcagcctcctaagtagctgggattacaggcatgcgccaccaggcccagctactttttgtatttttagtatagacgaggtttcaccatgttggccaggctggtcttgaactcctgaccaagtgatctgcccgcctctggctcccaaagtgctgggattacaggtgtgagccaccatgcccagccttagcctgtactcttaaccattgcactatgtaagacccacttaggttttagggcctaactgccctttgtagagctctagagttttaaggtagcacctcaggccttctttcctcgacttctcgtctgggtgagagctgttgaagagaaagttggctaaaaaaggctttgtttttataaatattaaatattgagattccttacaagattttcatttgttatctctttgagacagggtctcactcagtcacccaggctggggcgcagtggtgcaatcatggctcattgcagccttaacatcctaggttcaagccatcctcccatctcagtctcttgagtagctgggactacaggcgtgtgccaccatgcacagctaattttttcatttttattttttgtggagatgaggtctcactatgttgcccaggctggtcttgaactcctgggttcaagcgattctcccgtcttggcctcccaaagtgccgggattacaagcatgagccattgcgccagacctagatttctattttttaaaatgtatatatattaaaacatttttttcaggccgggagcagtggctcacaacatccttattttacaggtgagaaaactgaggcctagaaaaattgtgcccagataggtataatcctttgccgaagtcagaccaagttcttttctctatcatgatgtgtctctgtagtaaacttttgcccccctaaaacaacataaaaaccttcattctggctttaaacaccccccagaaataaatttaaaattctgcctctttttcaaaggttgagtgaggtatatcaccattgggagggtgtgatgttttctcttgcctttagtcaccattaggagggattaaggtttattctccagtttagctcttgtgcctgtttaaccatttctgttcaattaagaacaggaatgggttgcaggagtttgtaacaacacctgcttcttggaggagaattataacttggccctgagttgtccgtttcaaagggcccaccctgtcctcctgtttccaaagaaaaactggaagtggtaacacctggtggagctgcatgagcacgtgagtggtggtgcaaattctaggctggagtcacttctttgatgggctgccggagcctttgagagcttatggtgccaagatcctgctctacattctagtgtccaaaactgccttccatttcctcaataatgggtaggaaactgtgtccatgccagagtagctagccccgttgctactagagaggctttcttttctcctagcactggtgcctccttccacaatgcatacggctgcccaccctcgccatatgcagcctgtgtttcatatcctcacactttctaagacaggacctcccccagaacaaagccttgccttggtcctccaatccctaatggccccatcgtgatgaacagacccccaagggttcgacacagtataggggattcttatcagaccaggcctgtggtttaagccaccagtggtggttcaggatggccatggttagcctaaaaacctgatcagattgccatggtatgtcctacatgaccctgggtagaatgttgagatcctggttagaaatgcctgcatttctttaaatctttacctgctgtatataaacagttcctggagagttgtttttgttcattttaaacgttgccataaaattgttactgtgtctgatttaatactttgcctagaacaaagatactgccaaatagaaatagactaaatacatttctagcttggtgtctggcttagtcataataaaatataaaactaaaggggcagccgggtgcggtggctcacgcctataatcccagcactttgggaggccgaggcgggcggaccacgaggtcaagagatggagaccatcctggccaacatggtgaaaccccatctctactaaaagtacaaaaattagccaggcatggtggcagacacctgtagtcccaggtactcgggaggctgaggtaggagactcgcttgaactcgggaggcagcgtttgcagtgagccgagatagcgccactgctcttcagcctggcgacagagcaagactctgtctcaaaaaaaaaaaaaccaaaaaaaaactaaaggggctttctgcccccattggaacacactgaagatgctctggggagtaatgagctggcaaagggtagtgttcataatggcccaaatactttaccccacaggtgtcattcgaggccattgcctcttattccttttgtaaggtcatttcccattcagtcaactaattatcatttccctccatttataatataaaacaacagtgctgccagaggagataaaattgaataacacagccttctcttcttctggggctttgcttgacaggaacatggccctagtagggtagcaatctttctgtgacatgtgataccaactgctacatggggagtgaagtcgtcagatgtcttgcctccttcttcccttcccccacactgtccctcactcccttccccctcctcacagagtagcactgagaagtatttactcagctgtggcctggtaacaaagccttggtgccccagggattggaaggggtggtgtggtcatgccccgaactatccatgtccttccgagcatctcttggcagagcagcctggctgaggatgagtgtcatttagagtgagccttcacaacccctgcataaaagaacataaaaacaattgcagctgaaaattggagagtccacacatgggctgtggtattctctggcctctgtggtagtactattgagatcatgcagccaacaaactagaggctgttcagtcctctgggactcccatggcttgtagcatttcattatctttagctcttgtccagcactagctcactcaaccaacatataggcactcacacaaatgaatttagactgagccccatttcatcccccataaatttagagctaaaagtctttgacttcaggctttagggaaggttttctctgaaggaatgaatatatggccccacttccttccatctggcactcctccatgggtattctttagtgacaccactgtgatcctggcaaaggtaccatttcccaggaagaggagaggtatccgatctacagctatattccaccacagttctgagcaaatgtggacacgcatggtggtctgcaaggaggatgtagaaatgactaagctgctcccacagagcttcagaagcaggacttgccacagcaagaaggcagaccagatgtcaaaaagacatccttttcctacaaatgagaatgagttagcccttgaatatattgggaatcaataatttctgactaattttcttagctaaagtaaattcatctaacactctctaggattagagtggatataaccaacagaagaatattttgagtcagggcagtgcttatcttgaaagcagtagtattcatgctagagttgtaacagcaataaagtgaatttctgtgaagtgaaccctaggcttcctttggttttcatggaaaaatcagtgacatggcctggcgcagtagctcatgcctgtaatcccagcactttgggaggctgaggcgggtggatcacctgaggtcaggagttcgagaccagcctggccaacatggtgaaacctcacctctactaaaaatacaaaaattagcctggcgtagtgatgcatgtctgtaatcccagctactcgggaggctgaggcaggagaatcgcttgaacccagtaagcagaggttgccatgagccgagattgtgccactgcactccagcctgggtgacagagtgagactctgttaaaaaaaaaaaaggaaaatcagtgatacattcttatgaaaagaaatattcaagctgattgaactgagcacttggtgcaaaggccaacaagcccatgaagtgtagtacactggtcatggtttatcatgtttactgacagttatagtacctagcacgtaggggattttccttttttcacactttacaactcctggtttctcctcatacccctgtaattttgcagaaatgcctcctgtgcctggagaccccctatctttgtgttcacacagtaaccagaactttttccctatgaatttttatttgggtcactgtgtgaggcatgtttttatttattcattccttcaacaggtgtttactgcaatgcaccaggcattgtgctgattgctttagctaagttcaaagattccttaatttcaggacttcaagttttaatcagttaataattataaaataatgctaccacttattgagcactttgctaacttttttcagaaaagtgtatatgttacctcttttgatcttttacaacaattccattaggtaggtactgtagttcttacacttttaagacaaggaaaccaaggttcagggaagttgtacagcttgtctaagtcatgctggtggcaagtagtggagccaggtttttgaagccaggtcatctgattgcaaagtcagagttctgcactaatacaactgccctgcccaactaccctgtgctgtttaaagtggcctgcctgaagggtacctgtatgtttaacttagatagaaaatctgtcagtcacctggtgtgaataatcctaacatcagaagtccttcacaaaccagctggatcccacctgctagggtggaacttgcaggaccttcagagcctgtgctaggcctaggtctgaatctcagccctcttcctagctgtttccttgagaaaatgattacacctcactgagccctagtttctttatttctaaaataataatagcaagtactaacagatggcccttacgatgggtcagacactgttctaagcactttacattaactcataacaactctgcaatgttcatactgtcatttcatagatggggaaactgaggcatggagagcttaaaagtcaagtaacttgaagtcagtggcaaagctaggatttggacccgaacaatctaactccaaagtccatgctattaaccacaatgctatgctgtgctgcctctggagaagataggatcaagggtgtaaaacacctctggtctggagccagccacataattggtgagactagtgcaaggcttagaagaagaaagtttagcagtctgaccacccacaaaaggagacacacaaatttgtggagagtgttctgattttgatcttacaccaaagccttattatgtctttgcctttgaacttgcaggacctactggctgacactcttctaattgtggggggatctagagaaggtgtctactgatacacaatacttacctcccctgcacctgccaggtagaagagtggctggcaggtgggtggggatgagagaccacggtgtggccaccagcacagtggtcccccagcccatgccctctggcctgaggctgctgtgctggagcctcagtcttccctgttgacagtaattagaacttttcagactcggtttcttacatggaaaatctcaattcacttgaattgtctccttgatccagttcaactggagctatttagttcctgcagttagtttggaggggaaaacaagctcttaagcctcacacattatagctgataagatcaaggtgctgacagtgttagctgggtaggctttggagccagactgcctgggtttgaattccagttctacctcttaagtgtgcacaatctgagtttttgtgtctgtgaaatgaggataatagtcgtgaagattagtgaggtgacatatgtaaaccccttagaacagtgcctccccaagaccaagtgctcaataaatgttagctgtgttattgttaagcccctcctgccatcagcctcccttctctccctcccaccctgagatcttgctcagggaagacaggtccccttcctctcccctaccctggaccctcctctctttccttgctcaccagcttatttcatccctctaaactttctcatcctcatctgtgaaatgggactggaaataatggagtctacttcataaggtagtatgctgtgaaggctaagtgagttaatttttttttattttttatttttttgaggggggaaggagtctcactctgtcacccaggctggagtgcagtggcatgacctcagctcactgcaacctctgccttctaggttcaagagattctcctgccccccaagtagctggattacaggcacctgccaccatgcttggataatttttgtatttttagtaaagatgggtttttgccacgttggccaggctggtctcgaactcctgacctcaggtgaactcttgccttggcctcgcaaagtgctgggattacaggcgtgagccactgcgcctggcctaagtgagttaattcaagagctgagcacagatctccatggctactcactctctttacagttattgctggagcacaaagggctgtgagaagggcctttgagatcttggacagttctaagagccaaagggcccaaaatagacaggagcattagggtgaactggtgcccaaatgcaggctgcagaagctagggggactgctaccttgttcatcataatggggagcctggaacagagcaggcacatgggaataggaagtgagtggccactgcaggagagtgttcaaaacggatttggctcaggcaacccaacagagaactttcaaggcagaaaacttttaggtgtttaagtgtccaaactcagcaacagccaggctcatgcctgtaatcccaacactttgggaagctgaggcgggaagttcaagactagcctgggtgacggcacgagaccccgtctctacaaaaattttttaaatgcgcagggtgtggtggcatatgcttgtagtcccagctacttgggaggctgagatgggaggatcacttgagctcaggagttcgagactgcagtgagctatgccactgcactccagcctgggtaacagagtgaggcccccatctcaaaactaattaattaattaattaattaaaatttaaaataaaaaaaactcagcaacaaataccttcctcctctcttcttctcacctccagaatttgaaaacagaaccaaaacaaactcccattgtttgatgttactaagttctagacattctgctaagcactttatagacatcatctctcttacacttgactttaaccctgagaagtgtcagtgtcacttgcattttacagatgagaaactgagacttagagagattaagcaatttgcccaagattacatacctggtgaatcgcagagccaaaatttgaatcctagcctatggagcagaaagggaacaagctcccatatgcctatcagtgttctgattttgaaataagtcttaccacttatagttctctcaatacccactgtacaacagctgaggagtgtctcgaagtagcagaaatcatctgcccttgacattatctggtcactacttcagtagaattagaactcctctctccacatcccaacacagagtctgcatggaagaataataataacaactaatagaactactctctccacaattaaaagttgtttatttgcttgcattttcattaatctctttatctgactactgtcctcacttaacatttagaagagtcaagttccagaagtggtgagcaggatgtattctgtttttcatatttttaagagcttttgttgtgttagagaagcacgcagtgatttttgtaaatcattcttctgtccttggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctgactctccctaagaatgctatcagatatatccaccaaagtttagcctagaaaagcacgatgattcaaagatagaactttcctttatttactccctgccctgccagaaatcactcttctcttttctctacatggggagttctggagtgagaataaagtgggaacacattagactcagtggattttctcccttcccttcgcctttttcctcaccccaagcctgagaccacgagtggcaatgactccctcccttgaagaacaagacctcctgccaggctgtgcccgaggtcaggcaagtgggaagaggagagtgccacaaaaccatcttgatcctttgacctatattgacgctgagtctgttcctttggtgtttctgactttggcagtgtggttagtcaaactctctgtccccaccttgaattaagctttgatgaaaaagtactaggaacccaggcctttccctggagatttggggtttttgtcttggaaaagcatcaaccaaactaacgggggcaggagatctggattcctgtggcttgggctaacttaggtccaaagaaaccaagtgcctgtgatcatcatcttcattccccaaatgtagccatgccctctggattccctcctctcactcatcctcctcccaattaggcaggcttccgggtggattgctctcactttagcattaccaggcccttccatattcgaaatgctttgatatatgataatacttacacattcttactccttggctgatctaaaatcttttgccttcagtacatgcagcaacaaaataacttaagcatcagtgtatttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggatattctgagaaaagaggggctgcatttgtgtgttttcacgctactgtaaagatactacccaagactgggtaatttatgaagaaaagaggattaattgactcacagttccgcgtggcctcaggaaacttacaatcgtggtggaaggcaaaggggaagcaaggacctttttcacatggtggtaggagagagaagtacagacaggggaaatgtcagacgcttataaaaccatcaaatgtcttcagaactcactcactatcacaagaacagcatgggggaaactgcccatgtgatccaatcaccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcccctgaagccaggtattcaagaccagcctggcctacatggcgaaactccatctctactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgtctcaaaaaaaaaaaaaaaaaaaaaaaaaaaaaaaaacctgagctagggttgcaaatggacgtacagcaaaaatcatgtttatcgaagaatgcctaccttccctatatcatactgaatgcatttaccttcattgttctatttaaatttgtttaccttaactatctcacctaatccttgtaaaaactgttacttccctttaaaatgatcctttgtggtttctgtggggagcctccggctctgaagacagagttggagggtggtgagagtattaggcaaacaacaaaacacacacacaaatacatacccacactcccacacacacccctagaggatattctgagaaaagaggaggcaagggttggcagtgacttgtgatgaagagggttgcggttggagaccagaagggcctgaaagcagctgggcgtggtagctcatgcctgtaatcccagcactttgggaggccgaggtggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacctgggaggcagaggttgcagtgagccgattgtgccactgcactccagcatgggggacagagtgagactgaacgtcaaaaaaaaaaaaaaagggagcatgaaagtgatgaaccccagttgagggaagggtactgttactgctcacttcactgaagtgggaactgaggctcagacgggtgacaatgttgtgcgaatatactgatagcttgtaagtagcagtggcagaactggaaccgcagtcagcctgaatccagagatgggggatcgggagcacaaggagtctcttcatgctcccacctccctgtgtcatggcatcatttctgctttgtggtttgacccactgaaaacaaagctgcattggctgcactgcaccaagaatcacctcgctccttttgaaatgtgccaaccagctcctctattgacttggaagatgggaactccattgctcccagtgacagacaccagcctcacggtggggcacggtgttttgcagctaacagctcatgacctacttttgctggtcatgtgcaaaacctgtttagtgatcacacatgcaaaattttgtaggtttttttctccctcattattcagtggataattttctttcctgatggcaactggccactggtaaaagccgcagttcaggttttataattttaatttatctgctatccaaaggagatttggatattttttttcttcactgaaaaaaaaaaagtatgggagattatctcttgtaatttaaaagcagccaaatggagttagctttaaatttccatgatcgttcccctttgggcagaaatcattttattaaaaacatttttgtttgtttgtttgttttctttgagacagaatctcactctgtagcccaggctggagggcagtggtgcaatcttggctgactgcagccttcaccccgcctctccctgggttcaagtgattctcctgcctcagcctcctgagtagctgggattataggtgtgcacaccatgcccggctaattttttttttttttgtatttttggtagagacggggtttcaccatgttgcccaggctggtctcaaattcctgacctcaaaagatctgcccacctaggccttctaaagtgcctgggattacaggcatgagccaccacagccagcctgggcccagattgttttaaggaatattcagccccaaaatctggggagataaactcagcatccttaaagaccgaacttaaggccgggcacggtggctcacgcctgtaatcccagcactttgggaggccaaggcaggcggatcacgaggtcaggagatggagaccatcctggctatcatggtgaaaccccatctctactaaaaatacaaaaaaattagccgggcgtgttggcgggtgcctgtagtaccagctactcaggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaattgcttttaatatatttccagagttgtgcatccattaccacagtccattgtagaatgttttcattaccctaaaaagaaatcctacaccccttagccattactcttcagtccccactccaccgtcttccccaaccctaggcaacccctaatctactttctggctctgtagatttatccactgggcatttcaaataagtagaattgaggccaggcacagtggctcatgcctgtaatcccaacacttggggaggctaagtggggaggattgctcaacatggtgaaaccccatctctaacaaaaatacaaaaacttagccaggcgtggtggtgtgcgtctgtggtcccaattacttgggaggctgaggtgggagaattgcttgagcctggggggcagaggttgtagtaagctgagattgtgccactgcactccagcctgggcaactgagtgagactctgtctttaaaaaaaaaaaaaatcaaataagtagaattgtatatgtggtcttggccaggcatagtggctcacgcctgtaatcccagcactttggaaggctgaagcaggaggatcatttgaggtcaggagttcaaacccagcctggccaacatggtgaaacctgtctctactaaaaatacaaaacttagctgggcatggtggtgcacatctataatcccagctactcaggaggctaaggcaggagaatcacttgaacccgggaggtggaggttgcagtgagccgagatcatgctgctgcactccagcctgggcaacagagctagactctgtctcaaaaaaaaaaaaaaaaaaaaaaaaaaccacgaccaggtgcagtggcttacgcctgtaatcccagcagtttgggaggccaaggtgggtggatcacgaggtcaagagatcgagaccatcctggtcaacatggtgaaaccccatctctactaaaaatacaaaaattagctgggcgtggtgatgcacgccagtagtcccagctacttgggagcctgaggcaggaaaatcgcttgaacccaggaggcagaggttgcagtgagccgagatcgcgccactgcactccaggctggtgacagagtgagactccatctcaaaaaaaaaaaaaaaagtgttttttttgtgactagtttcatgttttaggttggtgtaaaagtaattgtggttttgccattattttcaatggcaaagactgcaattacttttgcaccaacctaatagcacaatgttttcatggttcatccatcttgctgtatgtatcagtacttcatttcgccaaatgtttcttgagtgcatattttgtgccgggagctattctgcaaatggggatacagtcatgaataagatatagttcctgcccctcaaagaacttgatatagaaggggactgcttaggtactggtcattggctgccaccactctgtgacgtatgaccttggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcaggaggaagcatcgtagccagtccatatcaatagcagtctgagggaattatgggaatggcagtaacaacagaagggccaagggtaacccacatggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaaaaacaggaaaagaaaaagcaaacagactccatgacagcagccaagccagagatcccctccacctcacatattcctgcagcaactggagtagttcttttatccccagatgatcaccacagcatctcccactccccatcctccatggactggaagctttctggatggttaagagcatgcagttggaaccagacttcttgagttcaaatcctggttccacaatatactagctgtgcccttgagaaaggtatttaatttgagcctgtttcctcacttgtaaaatgggaataataatagttgtaatgattgaaggagaagtatatgatgtgcttaaaatggtggctggcacagagtaaacttgtcataatcgttagaaatggtaatattaaccttgacctagaagaacacaggccccatggcattagaaagatctactgtacatcccacctgtgccccattaactggatgaccttgaggatatctcttaacttctctgagccctgtttttatatctgtaaaatggggatgataataataatagtaactaactcatagggtgtttgtaagatttcagtaacaccaacaaaaccatgaacactgcttaccacattgtagacattaaatcagtaataattttttttttagatgaagtcttgctctgttgcccaggctggagtgcagtggcgtgatcttagctcgctgcaacctccgcctcctgggttcaagtgattcttgtgcctcagcctcccaagtagctaggattatagatgcccgccaccacgccttgctaattttttgtatttgtagtagagacggggtttcaccatgttggccaggctggtctcgaactcctgacctcaagcgatctgcctacctcagcctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgggtggggtggcacgcacctatggaatcccagctactcaggaggctgaggcaggagaactgcttgaacccgggaggcagaggttgcagtgagctgagatcgcaccattgcactccagcctgggtgacatagcaagactctgtccctcccaaaaaaaattatttaaaaaatgttattattttttgaaatgaggtcttgttctgtcacacaggctggagtgcagtggtgcattcatagctcactacagcctcaaactcctgtgctcaagtgattttcccacctcagcctcctgagtagctaggaccataggcacgttctacaaagcccagctaattttttattttgtagagatgggggcagtgatcttgctgtgttgctcaggctggtctcgaactcctggcctcaggcattcctcctgcctcagctttccgtaaattattttattttattttattttattttattttaagatggggtcttgctgtgttgctggggctagactcaagctcccaggctcaggcagttttcctgcctcagcctcccaagtagctgggactacaggtgcacaccaccacacccagctaagaactttttaataaagaattcctacaaattggctgggcacagtggctcacgcctgtaatcccagcactttgggaggccgaggcgggtggatcacctgaagtcaggagttcaagaccagcctggtcaacatagtgaaacctcctctctactaaaaatacaaaaaaattagccgggcatggtggcgggcgcctgtaattccagctacttgggaggttgaggcaggagaatcacttgaacccgggaggtggagattgcagtgagccgaaaccgtgccactgcactccagcctgggcaacaagaatgaaactctgtctcaaaaaaaaaaaaaaaaaaaagaattcctacaaatcaataagaaaaagattaaggatctcagtagaaaaatagtccaaagatataaacaggcaatgcacagaagaacattagtaataaacctttgggcatattttcatgcccacactcactagtaatcaggaaactcccaactaaattgagataccacttcatacctatcaaattggcaaaaattttaaagtctcataatacaaatattggtgaggatgtgaaatagtgggaactctcataaactgtgtgtgggagtgtaaattgttacaattactttcagacaatttaggcaaatttttaaagttcaagagctactcctgggaataaggaaacatgcagtattgtttgtaatggccgccattggaacaatctgcacgtccctctgctgaaggaaagaataaagtgtggcatattcataccatagttgtggaattctttccagcagctaaaatgaatagctatatatgcatcaatcctgatgaatctcaaaatatcaaagttacagaatgacacagagtttgagaaaaagcaaaacaaagctatataatgttttaagaacacagacatttgcatgagttaattatagtataaagacatgcagaggaatgctagactcccaagttttagtaaatcatggtgatccccccaggaagaaaggtagaggataggatgagggaggggtgcacaggtggctgaaatggtatctgtaatgctgcattttacaaagcttttaaaaactgaagcaaagatagtaagacgttatggtctgataaaattggctagtggggacacaagtgtttgttatgttattctctgtagttttctgaggttctaaacatttcctttaaataaaaaatgatggggggattaggtagagagcaatgagagcaaaaagcatttcagggaaagtaagcagcatggaaaagaagctaggctctcaccaatgatggcctggaggaaccaagagaagccagtaggtctggaatttgaggcatttgagggcagagggagggaaagtggggctttacaggccatacattgggtttgggtctttattctaaggtctgtggaccagttcacccctagctctcaggcttcttgggaagttccagagtaatgacaccttcaggctgtctacagggaagcagcagcacccaggccaaatcttccagtccttctgcgggcagctgctctaacaaacactcaggctgggagaagggaaaggggcagcaggaaggcttcattaccacgagacagcacagagtccactctttcttaccagaagtggctgcaggtggtctcggaactgtgactagcgtcagagaggcctgtatttgaattatagcttttttgctcctagtttgtaacctgagtcaggtttcttaattcctctgaatgtctgcgttctccataaagatactcactgaactgacctcataggattaatacgagcagaaaatgaacttatgggtgtgtagtgctgacagagtaagcccttggtgaatattcactattattatcatcatcatcatattgtttcccacaccctctggatcaagcgtcttaggcatttcagggcaagtagggtttgggataccctggaggtgcgggctggagctagggcagagcaatgacctggacaccccacgccacttcaaggccctaggctagaggcagcttgtgcagcacgagtgtgcctccaacacagtccagaagaggagcaaccctcaggaaatggcccaggacaccttcatagcggcctttttcctcccacctggagaaggtaaccagacatcgtgtcatcgctgcttctctcatggccctgacattcaaacaaaaaccctagaggtgcactgtgagcccaaacagacatggggacacccttcagccaccccatgactgccaccttgacctggggacacccttcagccaccccatgactgacaccttgacctgaggacaccctccagccaccccatgactgacaccttgacttgcggacacccttcagccaccccatgactgacaccttgatttggggacaccctccagccaccacatgactgacactagtcatgtgacctcctcaaagaagtccagtcatggaaagtggctcttctttctggccgtggctgagggctggcttcccccaaaagtaaactggaaactagatcgctggcttctgcctgagacctctgcctggtggatgctggcagcacgcatttcctctgggctctatttttatttgctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtggccagtctctcagaccagccacgtgctctttctccactccagttgcctgtcctaggctccaccccacacatggttctgctcagcacagcctgaaccaaagtgcctctacttctccccaagagtccctctctctagcccggaggcatggtccgcaagggtccctccatgatccaatagatttgtgcagactctcactggcagcagctccctgttggctccacttcaaagcaggggcggccgggcacctccaggtgtcagaagcagctggcacgttagcagaaggcctctggcaggaaggggtgttgagccaactgccagcaactggaaaacagcacatggggatgacctcgtctccaagaagattctttcccgagccctctgggagtggcaatgagcttgagttcagaaggaaggagctgtctgtggggatagaagggttgcaggcaaaggcaaagaggcaaagacagaccaggagcttcctgcttgccttttcccatagttctgctgagattccaaagcaagatgcagatgcccacagccagaaagatcccataggtgggttaaagacacagatgcctagaactttcatggtctcagcattcatttggagacagacagcacagcatatgatgtgattaaaagcacctttcagtaagtcttctgcagccatagacctctgaacatcaaactgtccccccactagatttaacactaacaggaggagctgttagttctgtccacccttgggacaacactgtcagagctggaagaagccctttgggaagtatgagccttcaaacttctgcttgaacatttctggcaatacacatctcattcctttacaaatcagccacaatcctagaactaagcagcttgaaaatgtctctagagccaaactctagatccccgtggcatctccccaagaggcagtcctttgagagttgggtctcagccttcacttcctccctagtcttcacttctaagcaaaagatctaaatgcagccatttatccagtatcctggtttttagactgtccatcagcctgaccctcttctccaggactctagtttactccccttaaacggactgtccagacctgaaggtagtagtatttgaatgacagctcttttgctcctagcttgtaaccttcgccaagtttcttaatccctctgaatgtctgcattctccataaagattgtaagtatctttatgagagggattaagaaactgctccaggtgccacctggccagaggaaaaggggaccgtggcttctctcactcatttgttcatgcatttcttcattcaacagacgttgactgagtgcctactatgtgccagacaccataccagagtcaagccacaagcagggagacagaggtgtcacttggtagatcttatgttcccaggacaaagacaacagtgtgaggaggtttccgagaactgcagaagccagtagcaggggggcctattctaggctgggttagaaaaggtgctttcctctttcatcttccccaagagatgctgtggaggcttcagcctgaagaatatggagatatccggtaggtgaggaggaggcatggagggcagggagcatcatgggtagaagggacagggagcattatggctagagggacagacttgtctggagggcatgagtaaggacagcttcagggaggatggaaggactagtgtggccagaatgcagtgggggagtcgagggaggcagggggcagatggagcgggctcacaggccagatccaaatgggggaacgtgtcctaagggcaatgggaagactgtgaaggtttttttttttttttttttttgacatggagtcttgctctgtcatccaggctggagtgcagtggcacaagcttggctcactgacatggccacctcccaggttcaagcgattctccagcctcagcctcttgagtagctgggattacaggcatgagccactgtgcccggcctctgtgaagggtttccaacacaatggtaaaatggtcacattcacattttaggaaaatctttctgcccacaggatggatactcaattagaagaaggctcacgcctgtaatcccaacactttgggaggcctaggtgggcagctcatgaggtcaagagatcaagaccatcctggccaacatggtgaaaccccgtctctactaaaatacaaaaattagctggacatgctggcgcacgcctgtagtcccagtactactcgggaggctgaggcaggagaatcgcttgaacctagggggcggaggttgcagtgagccactgcacttcagcctggtgacagagtgagactccatctcaaaaaaaaaaaagcaagaggagtagttgcagggaaactgggtaggaggtcatgccatcatcaagaaaagagaggtgaaggctgggggtaggatggtggctgtggacgtggaaagaagtagatggattcaagagaaatttcagcaatagcattgataggacttggtgactggttgattggcttggagcagagggtggcggggggaagtttccaggatgtctagtatgcccagcgtttctggttgaggagagtcatagccggtgttgctgttaacacaagctcggatccatttggctttttaaaaggtagccagtcttacttcttgcagttgaaaaaaaaccctcagtcctttatacatgtgctgctgggatccagccacatgtcccccagaaagaaagccctcgcctctgtctgcacccgcttcactcgccccctactccctcctgctcggcatatgtttcagctccccagtctctgagactcagactcttcacctgtagaatggaaataacaataagacccacccgtaggactgttgtagaataaaatttaattaatgtagtcaaatgccttaatagcctgccatgaggtagggtactcaggaaagatacctgcctctataggcggatcacttgaggtcaagagttcgagaccagcctggccaacatggtgaaaccctgtctctactaaaaatacaaaaattagccgggcatggtgacaggcacctgtaatcccagctgctagggaggctgaggcaggagaatcacctgaacctaggaggcggaggttgcagtgagccgatctgcaccactgcactccagcctgggcaacagagcaagactcaaaaaaaaaaaaaatgcctctattgttacccgtattaagggcacctgcagggctgccctgctctgacggacactcctaccctcccacggtgtgcgccccctcttctgcaacggcccatctccaaagggactgctgatgtttgaggtcaagatggcccctagcagaaagctgcagaccacttctgaggctggaagggtgtgccctgtttatagcttctagtcccatctgtggctgaaagaggaagatgctagtggcactcagcattaaggcttccgcgaggctgcgaggcaggggtagccctttgggaagtacgagctcaagcttctgctccgaggcaggctctggaatgggcctattggtgagaattgcaaatggaggtaacttctgtaattagacagtggtgatggtggcgctactttgtgaatatactaaaaaactgaattgtacgcttttaaagggtgacttttatggtgtgtcattatatcacaatgtaaataaatagcaagtggaagttgctgctatgggagtgctgtgttccaactgatgatcaacagaagccatggaacacggggaaagccttgggctccctggtggtttcctgcttggggatattcacagcccagtgctgttctgtcgtaattcactttagactattggggctccagctgtcctgagaacagggcagtaaaggaaagtcagtggcttctcatgtccagagcctttgcctgccctgctgagcctgccaaggaaaagctttgaggtgctggtggcccttgctccctgagcgctcccgggggagctcactcttcctctgcagtttggaggtctttgctaaccccagtcctctctagctgcccgctctctgctgtctccctgctccctcaatccagatgtcaaaacagattctgccatctgggtggggagggagctgttctgctgcctgggttttccttgggttatgagatggggtaaccacttggcctttggcactgcacttagtcctgtgaactactgacagagggaccagggcaccctcttgtggccctcagcggcactgcttcttcccgccctccagccttgaatttcttccagctggaattctagtgttgaactctggtggtggaggcagctgtcgttctccccaggagatgcctaacatatcagtaacaagaaagaaaataaatcagccacagaaactaggaggtaaaatgttagtgtttttgctctgcagctttattttcaaagaggcagtgtgctctcatggaagatgtgtggcctgtggagtccagcaagctccccagctgtgtgtgtgactttggcaggctgacctctgagcctcagactcttcacgtgtagaatggaaataataagacccacctgtaggattgttgtgggataaaatttaacgaatgcagttaaatacctcaatagcctgccacgcagtagggcactcaggaaatggcacctgcttctattgttatctgtattacaataaagactaggcaggaaccactgtctctcttcaggaagatcgcagcaaagggagtggcaccacaatatcgtagtctctgtgaagccctttccccagcagtgagcaatcctggctttctctggggctgatccagttgccagtctgggaaacctctgactcagggaagtggagagagatttagaaaaatatgagagagcaaaagaaaactttttttgttttttttttgacagggtctctctctgtctcacgggctggagtgcagtggtgtgatctccgctcactgcaacctccgcctcccaggttcaagcgcttctcctgcttcagcctcctgagtagctgggactacaggtgcccaccatgcccagctaatttttctatttttagtagaagtggggtttcaccatgttggccaggctggtctcgaactcctgacctcaaatgattcacccatctcggcctcccaaagtgctgggattacaggcatgagccaccgcgcctggccaaaaacaactgaaaaaagaaaaaaagaaagataaagccagaaggacctgatcagaaacagattgggggcccgccccaccccatctgatagcttggcgcctgcctggcatgtgatggagcccagcaaacgctcgtttccttctcttcttgtcctggctcagatgaggtgctgagcagaggatgaacatagccttggtcggatccctttatgagtcagacggttttcttcctgtgaggtgggtcctcagtgggagggactagagacaggaaaaccgttgggtgggcaacctgtgaacatggatgcaaggaggagcagggcggcagcacaagatgagtgtgggttttgaccctcacaagtgcagattccccaatagctctttgccctctccccttgtctgccatctgtgccccagggtggcggtgtctgtcgctgttctggccctttggtagcttattaaatctcagtaccacttgccaagaccctttaaaccccttagctgttctttttgccttttctgatcagctgtatttattctgaactaaatggtcctcacggcagaatgaaaggatttactgcttaagtatatgaaaagaaaccttggctgcattacagttgcaccctctcctcgccaccccctgcccatgctccatccgctagctggtgccactgagactgaaccgggagcccgctctgggtacagtgtggtcagttcagtttggtggcagagtccaattgatggagcagtgaggtgactgggaggagcttgcttttgggagccctctcctaaatgtcctgctgccccaggggagactggcggcccaggaacagctctctctctccctctcccccgcacttttcccttcctccctctccctctctccctcccctccttaaacctctcccccattctctctctcagattctctctttccccttcaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagctcacgcacagagacatcaaatggagtgccgggtttacaaattgctgactgtgttcataaacaaacttgcttaaaacaggctcttccagtaaatagaaggctgtccttagatcctagaggtggccttcctgccaactggtgtccccagccagccctggcctcatttgggcgccacattctgtttacttgatggcagcccaagggctgtacagttaggggctggagcctggggtctcgccacctgctcttagcagcaccagtcatttcccatttctctgaagctcttgggccctagagaaggagcagccatgtctgggagaacatttttccctcactgtctccccagccctcttctcacagcacccccagagggatgggacagccaccacattgggctgggagcattactgacactgcccagcggtgtgtgtagagacgagatgggccataagtcagcagttctaacaatggctcaactacgaaatttgaaaaccatttcaaatgactgactcatcagcagctttcaggctttctctgttcctcgctggtattccaacacgctttcttgaggtagagaggcaggtggccacacaccatggggcttaccagtgggagcatactcatgttcactcctccaaaaaatatttatggccttaatatgtgccaagcacagtgctaggcaggagaggccaacaaggcatgaccccgcctttgtgcattccagcaaggagacagattagacaattaatgacacagaaagctcctcactggctaagtgccagaaaaaaaaaagcctatggtgctatgaaagtgtgcaatggcaggtctcacctggtccaggaacaactgagccaaggatgggacatttgagcaaaaacacagattagtgtcatctctcatcaatgtgttgtcaaacaaggttgagaacttctgctctcaggacaccatgccctgagcactgaggctggtgtggaactgggctgacagagaagggaagacatagtgaacagacaaaacatgtcctccctgcctgagccgtccacacccacacccccacccccacggttccagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacaggtgaggaacgggcatgcagcccccagccccccagccccagggggtcggactgctggctgcggaacagagctccgcaggatgttctgcgcggcccaggcattctagggcccttgctggtcataatgtaacagtgccatttgcccccaaaccagttgttgactgaaaggctctcaattagctcacttcaaaaggactgctttcactcaggcaagaccactgtagttgaccaatttactgggtgacagactggccttaacattttagagagaaggaaagagtactccttgtataaaacttttctacacaaagagaggggtaagctgtcctgtgtggcacaagtacccttagggactgagcaacaggtttggtttcccgtagccatttcccacccccactccccaccccggtgaaagcaccagttagtgaacatgccagcccctcctgaccatagtgaaggcctgatcccccagggccttggggctcccaaggcaggtccctggcttggctgtgggtatcctcatgaacctgaaagtatggatgcagaggtggccctgaggctggctaggctctgaatgtggcatctctccttcttagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcacaggtgtgtctgcggagaccttttttccaagctgaaaaaaaaaatctgattaatctgaaagggagaaaaacaaaagtaggggaagtctgcagtggcccagtttttcctgcctgctgttttttttcactgagccttctccacccaccccactgttcctcctcccacagccactgctctcctaagagaagagccagtaagcctccattctactacagtttaaggttttttgttttttgttttattttgggacagagtctcgctctgttgcccaggctggagtgctgtgtacaatctcagctcactgcagcctcgacctcccgggctcaagtgatgctctcacctcagcctccctagtagctgggactacaggcatgcgccaccatcctggaaaatttttgtgttttttgtacagactgggtttcaccatgttgcccaggctggtttcaaactcctgggctcaagggatcccctcaccttgctctcccaaagtactgggattacagttgtgagccactacgcccagcaaggagttcttttttgtgtctcgagagatcctcctgctgtgcttgggatcccaggtgcctgagtctcaaggaaaagacacacagcatcccccttccttttgccagttgagggaatgggattaagggaaggaaagttaacattcactaaatgccaaccacagcaggctaagtactgtgctggatgctttatattttttatcttacacaatatacagttagccagggatgctctgggatacacaagcacaaaccccagcaggctgaactgcatgccacccacagcctggttattctgagtcagtgcttggggcatgcacaggtctggggagccctcaactgaagttggtagccaaggttacccactggactaagactagaaaggaggcaattgacaggccaggcgtggtgcctcacgcctgtaatcccagcactttgggaggctgaggcaggtggatcacctaaggtcaggagttcaagaccagcctgaccaacatggtgaaaccccatcactactgaaaatacaaaaattagctgggtatagtggcccgcacctgtaatcccagctactcgggaggctgaggcatgagaatcggttgagcccagaaggcggaggttgcggtgagccgagatcacgccattgcacgccagcctgtgcgacagagcaagacagtctcaaaaaagaaaaaaaaaacaaaaacaggcgagagtcaggaatcaagagtaagggggaggcgggtgggatctgccctggtgttctttcatactcctcgttatgaccactctttcttcccaccagtagcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagcctggccaacatggagaaaccccgtctctactgaaaatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactccagcctgggtgacaaagcaaaactctgtctcaaaaaaaaaaaaaaaaaaaaagtcactctcattcaaccacttttactgcacactaacattgggtggttggatggaatgggagacagaaagaagcatgtggtctcaggcctcacctgcatctccagcgtatgaaatagaaatccggagatacactggttgacgcgtcacggaggtcagccctgttcccttagtccccagggcaccccacaaatgagagggttctatgagatgtactttgaaaaccactaacttagggcaagaggggccaggaggcatcatctgaaaaagatttggaaaaaggggaaatctgcctgtgccgggttaattctggccctgacccagccttctcctcttgcccctgggatcctccttggagaagcagaggcagcattttttttttaaccatctgtctccaaagtggggtcatcctgatttagggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 811 - DNA, 227682 bp, Homo sapiens
gctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctgggtaggaaccccctttaactttggggagggaaagacgtgcagacgaattaggccagggtctgggaggaggcgggggcggggtctgagtgggatcgggtccgggtggtatggggaggggcggagaggcgggggttccagggcctgagcctgtaaggccgagcaggaaggaaaaaagcacctgggaagtaaagaatgtttgaagtgtaggggctggaactcaggcaatgtggattgtgttcaaatgggtcaggttggcgttgaggatttggggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaattaccgtgttttcttccagttttgcaggtggagaaactggggctgaagaggtaacttgcgttaagttaggccacacagctagaaaatggtagcgctaggatcagaaccggatttgcccactccaacagaacttgagatattgacttggctcttgagctaagactgtatatgtagtactttgttgagcatctttagtgtataaggcatttaatgaatgaaaaaaggcacacacacgcatagatatgtacacacacacacatatgcacacaatacacattttattttattttatttttgagacggagtctagctctgtcgcccgggctggagtgcagtggcgcgatcttggctcactgcaagctccgcctcccgggtagctgggactacaggcgcccgccacctcgcccggctacttttttgtatacttaatagagacggggtttcaccgtgttaaccaggatggtctcgatctcctgacctcgtgatctgcccgcctcagcctccaaaagtgcttggattacaggcgtgagccaccgcgcccggccacaatacacattttaaataattcatagacttttatttttttaaagacgttttgttttgttttgttttgttttttgagacagagtttctctcctgttgcccaggctggagtacactgcaacctctgcctcccggattcaagcgattctcctgcctcagcctcccgagtagttgagattacaggcatgcgccaccacgccaggttaattttatatttttagtagagacggggtttcaccatgttggtcaggctggtctcaaactcctgacctcaggtgatccgcccacctcggcctcccaaagtgttgggattacaggcgtgagccactgcacatggcgagaagttttaagtttacagaaaattgagcagatagtacggcgagttcccatataccttgggtctccctcactcacagtttccgctattatttacatcttgcattagtgtggtacatttgttacaatggataaacatatatatttataatatataataatatattatatattattattattatatagatatattattatagatacatattattaactaaagtccatagtttacattagggttctttgtgttgttcagttctgtgggttttgataaatgcatgtcatgtattcaccattccattatcatacagaatagtttcactgtcctgaaaaatcccctgtgctccacctattgatccttctccctccccctgcagcccttgccaaccactgatcttatggtctctaaagttttgccttttccagaatatcatgtagttggagtcatacagtgtgtaaatttttcagatgggcttctttaacttagcagtaagcatttaagtttcctccatgtctttctgtggcatgataactcatttctttttatttctgaataatattccattgtatggatgtaccatgcacatcttttttttttttcttcttctttttttttttttttgagacaatgtctggcactgtcactcaggctggagtgcagtggcactatcacggctcactgcagcctcaacctccgggctcaagtgatcctgctacctcagccttccaagtagctgggactacaggcacatgccaccatccctggttaattttttaattttttgtagagaaagagtctcactatgttgtccaggttggtcttgaactccagggctcaagcaagcctcttactgtggccttccaaagtactgagattacaggtgtgagtcactgcacctggcttacatctttttttttttttttttttttttttgagatggagtttcactcttgttgcctaggctggagtgcaatgatgcgatctgggctcaccccaacctccgcctcctgggttcaagtgattctcctgcctcagcctccctagtacctgggattacaggcatgcgccaccacgcctggctaattttgtatttttagtagagatgggtttctccatgttggtcaggctggtctcaaactcctgacctcaggtgatccacccacctcggcctcccaaactgcttggattacaggcgtgagccaccgcgcccagccaacatctttttaaatgaaaaacaattctggtttacattttgtttaacttattttaaaaattaattttaaaatattttttaaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatatatatagacatatatatagagagagagcttaagacagtgaccacatccattaatcagctaaaaggggatatcacagacaattttgtatctaatgaataacagtatcaatgtcaagcaatgcctagacttttttccaaagattttatgtattttattacccagtactcaatgaatatatgaaatatttgaaaaggctagttcattgttcagttccttgggtgtttgctgtttgaattttatgtctcaaaggcttggcagatttggtgtattggtgccttggtgaatagaagttggtggtctcttcataaatggcgttttcaggaaggccaattcagtggcagtgttgagaatgaatctacaaacagaatcagagtctcaggttggttgaaaaagcttcaatgtttgtgaagcccaaccaatcacctaataattgaatcctatacaaatgcttcttcatgctttgttgcatatttaagtgtcttaattccttgtcctaaccactaactagacattcatactgccctcagcatggtcacacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccacctacgtgctgacctgagtataagcatgagggcgtgaggtttattttttactccacctaatttggtgaggtgcatgctttcactcacgctccaagttgcctcttcttttccatggaacctgcttattctcactacggttgatagtgggttagtataatagataactctagaaatcaaagatggcctttctcctttggggactagacatttagaagaatcacaataaattgggtagttttttttttaagctatagtttttgaactcttcctatatgcctggcactgtggtttatctcatttaattttcacaactaccatatgaagtgggtactcttactggtcccaattagtagttattaatatcatcttctcattttataaataaggaagctgaggcttagaaaggctaattgatttgcacaaggtcacacaggcaatgatgcatagtaaacaggggttcatacccaggtttgtcatattccacagcttgtgttttttcctcttcactaaaaagataaaaacaaaccaaaaaacccctattggttcaaagggcagtaattcttgcttccttattaaggatgaggctcttgcaaataaatttcttgggaacaagaattgtgttttactcatcattgtcaaccttctatcattgtctaccttctatcactgtataccttctatcattgtatactctcctacacttaattcatacgtatatgtgaaatggaatatgaataatctgaccttagggtaccctaaacatgagtagctaacaaaagcaaccgagacttattaagaacttactctgtaccaggtaccattttaaatgctttacatatattgatgtatatgaagatagtttcagttgttatctccattcggcagatgaggaaactacacacaaagataccaaataacaagttgtaagtggtggatccagaattctaacccagcagtctaattgaagtccacatggttaaactctatgctataaatactttgagcaactcccaaagtggggctccaactattgtgtagacctatacgtggatcctggagtaaggtcaagtgattccagtgtcttcatttaacatttctgccatgaggaggcatccgaggaatgaggatggatcagggaatggtaaaatttccaatttcttcttgccactggactcatctctcagaggcaggcagtgaggaagataacttctaccatttgggagaattttattgacaatcatctttgtactttgggtagctgtatgacctagaagaaatcacttaacctctctgtgccttagtttccacatctccaaaatgtgggtggtaatagtacagtcatggtggcttacgcctatattcccagcactgtgggaggccaaggagggaggattgcttgagcccaggagtttgagaccaatgggacatagtgagacttcgtctctactaaaaataaaaaaaaaatagctgggtgcaacagcatgcatctgtagtcccagttactcaggaggcggaggtgggaggatggcttgagcccaggaggtcaaggctgcagtgagctgttttcacaccactgcactccagcctgggtgacaaagtgagaccctttctcaaaaaatttaaaaaaggccaggcatggtggctcatgcctataatcccagcattttgggaggccgaggcgggtggatcacctgaggtcaggagttcgagaccagcctggccaaaatggtgaaaccccatctctactaaaaatgcaaaaattagcagagcgtgggggtgtgttcctatagtcccagctactcaggaggttgagacacgagaattgcttgaacccgggaggaggaggctgcagtgagctgaaatctcaccactgcactccagcctgggtgacagagtgagactgcttctcaaaaaaaaaaaaaaaaaaattgtgcttgcctcatacatgtaagcatttatcctgttagagcacctgtgtaggtgctcaataaatattagctgctagtgttattaccatatttttgtgcaaatacgtaaacatctggtggcaaccaggaatgtgtgcctctcagatctcctacactggggaggggagggtaattgactcctgaccccagctctgaatctaacaccttgttcacactgaggtcacactttccacagactgctcctagtcaatgactgggcaggacagacccacttccatgagatgttttactcctctagtgggtgactttggcttaaagactctcactgcacactgctaagtccctcattctcccttctccctcctaaaggagggataataattagggtccctcctaaaggagggataataaattagggtcacacctgcatttgatctcttagctctcccagactcctccggcttccttcccattttctatcatgggcgtttcccccagtacatctctcgcatgtctgatcctgttttggtgtctgtttctcacagtatctgagctaagacaacatctaacagttactgatatagtctcttccagccatgaggttaatacaacttctttaggacttggcaaaggttctgacataggaccccttctatgtggaagataagtgttactaatcttaattttttttgtatttgctgataccacagcatatgatagttacttgtctgacttccagacacattctattttttgattttgaatgaatcctgataaacttatttttatttgaatataactagtgagccttccaaacccaattctattctaggaaatattgctgtttacagtaagttagcagaaattctcttagggccttaaagtgtttggttgctgcagaaaggaaatgaaataaaataggtgttaaactgacttcctaaatctttggaaactaggtttataatacataaaactggtcactttgaaatgattatgggccaggtgcggtggctcatgcctgtaatcccagcattttggaaggctgaggcgggcagatcacttgaggtcaggagttcgagaccagcttggccaacatggtgaaaccctgtctctactaaaaatatgaaaaatagctgggcatggtggtgcgcacctggagtcccagctacttgggaggctgaggcatgagaatcgcttgaacccgggaggcagaggttgcagtccactgagatcacgccagtgcactccagcctgggcgacagagcaagactctgtctcaaaataataataataaataaataaaataattatgaacatgttcacaaagtcacctctttctttccttttcctccccctacccttctccttccttttcttcctccctgaataccttctctatataaagccaggcatgaatatatgaatataaagcatccctccccacaggaaacttacacagtagatgggagatgggacatattcataaatgaccataacataaaaagacagtataataagtaaagagtatgtgacctatatggttctagagccagcagctatcttggccttttctcagtttggtcagcagcttctcagtcatggaagggacagcagttcccttggtagcctagttctggaatgggccttttgggagttgttcctggaaggtcgatctagatttttttccttttccaaagattctgtaacctatttaatacatgtaataaataaatatctttttgttggggggaaaaaagagccagtaagttctaagccatgttgttcccaacccttgcctacctccatttctccaaagtaaattgcagagtgatgtcagtgttattctggggttttaagatagctttaaaatttttgactttgtttatcatttatatattcaagtaatgttaaaatctttattccaaatgctattcagaagttggggatcacttttatttgcacaaatgcaatatgtgctaaatgaataattctaggaggccgagtagataaattgaagttttaaaaataatagtagagcaggccgggagcagtggctcaacgcctgtaatcccagcactttgggaggccaaggcgggtggatcacgaggtcaggagatcgagaccatcctggctaacacggtgaaaccctgtctctactaaaaatacaaaaaattagccgggcgtggtggcaggcgcctgtagtcccagctactcgcgaggctgaggcaggagaatggtgtgaacccgggaggcggagcttgcagtgagccgagattgcaccacggcactccagcctgggcgacagagcgagactccatctcaaaaataagtaaataaataaaaataatagtagagcagaagagacatgatccattatcctatttctggttcatcatcctatttatgtccttcatagcacttatcagagttatcttgtgtacctacttgtatacttggttattgtctgtttcttattagaatgtgagccatgagggcaggccttttctctctaaaatctagcacaatgcttggcccaaatgaagtgctcagttgttgaatgaatggtctactttaagtaacagaataaattttaaaataaatgggagaaaggaatccagttcaacaaatagttactgaattcctaacatgtgagagaaactatgtttttccccccttccatgaatgaaaaaggatgattaaatctgctctggatcttttcggttttaactctgatttatacctaaagttaatttcttggttgataccatagtttctgtgtttgggttacataacattaaaatttaatccattttgtaaaaccaatattttaaaaaggaaggagattttctacaattttggagcatctcaatgagatcctgtcctttagttggacagagtgatatgctttgattaagactggaattacccttgtaaactaatctctgggtcctctttctgtgttgggatcacccttacactacttccctaggggccttaggaaatagctcattctatgattggaatttcaagtcaaaacacatttatctgagcagaattttaatgatttatcaaagagaggagggattttcccaaacacaactgaacttacaaattactgatcccactagctatgttttttcttaagcacctttctttaaacaaagcaattactgctgaaatcatcaaatgtatttttttcatggaaagcttttgactaagttttgtttgattagcaggaacctactaaaagtaaatattgtttgagacagcactttcagagcctgttctttttcttcattcaattagcttttaaagcactattctttggagaaagtaagagccttttttccagctgtcctattgtgtaactcaaggtctcgttaatactattatctagccccgagattacaggtaattgtgataaaacacaagcttcagtttctgtaatctcagacagaaatctgcttgtgccccaggacttcagatcaggtgttttttaaattcagacttctctcacctgggacagtcccattggcccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaaaaataatttagcccttgggcacctagacgaaacttaagtagtccaatttagagaaatgataacaataaacttcataaacagtgaacacatgagcttaaacagcaagcatgactccagtcctttttggaatgcgatgcattgaaagatggctatagagaaaactagaagctccacacgtcagttatgtgcagttaagccttgagtccatggtctagtgttaatctcaagagtacattctagttagtggataaaatacaggctaccatgtgagtaagtcattaagctccttgagccacagcatttcacctataaaagtgggaaaggtaatattgccacctacctcacaggaatgaaagatgattgagaagataaacttgtggagttccttatagggaaggtattttgtaaatagaaaacactgttattattctccttgatcaaatttccccaacaaatggagttgataaaagctacctcacagagggttgagaggctgaattaattaatatacgtctagtatcttaagagtaaactatttaatgaaacctaaaattgattgtctttcttgatagtctatgaactaccagacctgctgtttagaaacatgattgtcttctaaagtctcacatatgcagtctttgccttctcttcaagggttggcacgataaagaatagtgaatgtacaggcaaaagataggctaaatcttcagggagaacagccttgccttttttcttttcaagggtatatttacaaatagcctttggagtcttgctaatctttgttaccatgcctgaacatagggactgttttgacctttgttcttccaataaatatttatttttgatatcatatttctaaatgagaaacaaacttagaaggaaaagaagtggttgaatttgtctcacattataaattttttcttatctttcctaggatggtaagagaaaataacttttttttttttttttgagacagagtttcgctccatcacccaggctggagtgcaatggcacaatctcagctcactgcaacctctgcctcctgggttcatgcaatcaattctcatgcctcagcctcccgagtagctggaattataggtgcatgccaccatgcctggctaatttttgtatttttagtagagatgggggtttcgccatgttggccaggctggtctcaaactcctgatctcaagtgatcctcccgcctcggcctccccaaatgctgggattacaagcatgagccaccgtgcccggcctgaaaataactattattgaaggaccagacatcaggctctccaactggaaagttctcaaacttagccaagtgattaaaaacagctttggctgttcagaatttaatcttttgttttcaattacagttagtagtatttgggtaacttcatttcccagatttcatttgctgttaggtgacacaaaaaggggaaagactttttcttttctttttttttttttttgagatggagtctcgctctgtcgcccaggctggagtgcagtggcgtgatcttggctcactgcaagctccgcctcccaggttcacgccattctcctgcctcagcctcccgagtagctaggactacaggcgcccgccacctcgcccagctaattttttgtatttttagtagagacggagtttcaccgtgttagccaggatggtctcgatctcctgaccttgtgatccgcctgcctcggcctcccaaagtgctgggattacaggcatgagccaccgcgcccggcctaaagactttcttttaaattctaatcccttaggcagggatcatgtctcatatatatattttttaatacagagataatatttcaacttttaagtagtacagctgcctaaatactgtcttaagtagaaactgttttcttttttccttttttctttttttgaggtggagtctcactttgttgcccaggctggagtgcaatggcccgatctcggctcactgcaacctccacctcccgggttcaagcaattctcctgcctcagcctcccgagtagctgggattataggcgcctgctatcacgcctggctaatttttgtatttttagtagagacagggtttcaccatattggccaggctggtctgttggtcagggtggtcttgaactcctgacctcatgagccacccgcctcagcctcccaaaatgctgggattacagccatgagccaccaggcctggcctggaaactgttttcaaataggtgttcttcatatgccatctagagtaattctcatatgcaggaggactgaaggagacagcagtctcgttcagtcctcacagcaggtagacaccagctgatcccacttttctttgaggaaactgggatttaagttatataacttgtccaaggtcactgagctagtatgtctggagctgaagtttgaatgaagtttatctgactctaaagccagtagtattgttagccactttctttcaggttttgtaatttctaagagccttctttcccattcagttcaataaaaatttaagtgtcagaacttaaattcagtagaaaattctacagaatatatgatatattccttagactctttttttttttttttttttgagacaaggtctcactctgtcatccaggctgaagtgcagtggcatgatcatggctcagtgtagcctcgacctcctgagctcaggtgatcctcccacctcagcctcccaggtagctgggactataggagtgtgctaccatgcctagctaatttttaaattctttgtttgttatgttgcccaggctggtctcgaactcctgggctcaggtgatccacccgccttggcctcccacagtgctgagattacagacgtgagccaccataccctgccagattgttttaatatatagaagataatttaacattttcttggtgaggtagtgtcattattttagacctaatttattatattgtgctataaatgtgttataacagttacccatgaagatggatgttattttttttatgcatgagaagaaatggtggctcaaataacttaagtaaattttccatttatatagatagcagttagtgaagctgttatttgattctaattcttctaatttgaaattaagtggtttaggtgccactcagtgttaaattctaatttatagctattaattaataagaagacatctccctgctcccacaccagtacttaccattcccttctctccagactaatgtttcctactgagtcagtaagctgttgaggtctactgaggtttgtttggcgcttcaggtggtttggtgctcctaatctctcagggtattagggtgagggctgagctggtgttataaaaacaaaacaaaacaaaaaacctccaccacttaactccccctccctcccagtgcaatggctcatacaagaagcactttctttctttcttacttaatccaaatccaggatgtgaaaggcagggtctgctttaggaagtcatcattggatttcagctagcagagcagtcattctgtctgaaacacatggtttccaaagctgcctcaattgtagccattttcagccagtaaaaggggaaacagtgaatccagggcaaggaccttttaggcaagtgaagccgaagatgcaaacatcacttgtgctcacatttcataggtgagaacttaataaggtccctgctaactgccaacgaggcagggaattttagtctaatggacagtcgtgtgcaagaagaatggcagtgtatttttggtggtacacaaacaaaaatctgtcatacctagtatatgcggtggagacatctaccctactcaaggcaagttgtattgttggtagctgcttgcccttattcacaggtgaagcatagatgtgctggtcagtatttggtttttgtcctctacctcttgaagtacaaagttattttatccttggtccctgtctctgagttcagttgctccctttttacaatggttattattttctttcttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcataagtaagaattttctcaattaggaagaattcccaagtgagaaatcaggtcttaaggtgatcttaaaaccgcttcacatggcgtaattaaatttgaacaacagaggtgggaagtaagggtgatgaaggacatggttaaacttagaaatggagctagaaattggtgttctttacctgatgacctcttctttgtctgaagtaagaatcaagattatcttcttagagttagggaagcagaagtaaaaggcttgaggagagcaaagaaagtttgtattagctactgggggaaagaagaaagatagctcgactagggccaagtacaagtattctgagctacattaaagcatgtgaagtaaggctgcataaatcattttaaaaaaagaagtaactaagaatgctaacaggagcaaagttgactatgggaattggtaaaagaaaaaatacaaaagcattacaaaataataattagaagaaacagttgaaaaactcttttaggaaaacatgatgtcacaaataatgcataagaagagggaggattcggctggatgcagtagcttatgcctataatcctagcacgttgggaggctgaggctggtggatcacttgaggtcaggagttcgagaccagcctggccaatgtggtgaaaccccatttctactaaaaatacaaaatttggttgggtatggtggcaggtgcctataattccggctaccctggaggctgaggcaggagaatcgcttgaaccctggaggcagaggtggcagtgagccgagatcgtaccactgcacttcagcctgggcgacacagtgagactctgttttgaaaaaataaataaataaataaaaaataaaataaaaaagaagagggagaatccagagagcgcaaaattccacttcttccattgaagaaagttcaaagaattgctggatttaaagtttttgatgtttatgtttcttaactacagaattttaaaaatcaaatgggtctataagagttataacaaaaaaaagcagtaccctacaccataaccttctcaccccgaagtctcactcctcagaggaggccattttctttcttttttttttttttgagtaccagtaagtctttatttattcattgtattttcccagggaaaggagaagggaagggaagagtcagcatgtgttaaaaaatgatgagaaaatgggaaaggaagtacccagtacagcaaaatcaaccgtcaaataaacacaccccagtgatggggtcaccaaagcccaaaggggctcagtctcctgcagttcaggaatgagggaaaaggatcaggaaaaaaacagacaggtacaggctttcctaccctccctccccataaattcaagattttacacaaagctttggtttctagcagtaaacatggagttacattcattcatctcctattaaacaatcttgtggccactttgacataagtttctaccacctgcataaaagttcctgagtgacttggatatacattcatattccctttcttggcctcctgaccccactttctacatggaaggcccccaattgcatctctttactttaggattagaaattaaaagtaagtaggtttgatccatccaaaatacagtagtgtggttttttttttgttgtttttttgttttttttttttcgagacagggtcttgctctgtaaccaggctggagtgcagtggtgcgatctcagctcactgcaacctccgccttccaggttaaagcgattcccccgcctcagcctcctgaatagccgggaccacaggtatgcgccaccacacctggctaatttttttgtatttcagcagagacggggtttcaccgtgttggccaggatggttttgaactcctgaccttgtgattcgcccgcctcagccttccaaagtgctgggactacaggtgtgagccactgcgcccaggctacagcagtgtcttaagtgtttggcatgaatacatgaagaaatggtcggcctagcgtggtggctcatgcctgcaatcctagtaccctgggaagccaaggtgggcagatcacctgaggtcaggagttccagaccagcctggacaacacggtgaaaccccgtctctactaaaaataaaaaaattagctgggcgcggcgggtgcctgaaatcccagctactcaggaggctgaggcaggagaatcgcccgaacccaagaggcagaggctgcagtgagccgatcatgccactgcactccagcctgggcgacagagcgagactccatccacccccccccccccaccaaaaaaagaaagaaatggtaatggtcttgacttaggaggttgggaacaagggatggagggttttcctagcttcaggatttttgcatacatcatttaagagttgtggagacactccaagcattaaatgtgtatgtgtgtgggtgtgtaagttttcttttgggggtgaacagaaaagagggcagggtagaagacaagtttttaggacagaagatctggtctaataggtaataggggaaggggaatacaaaagaaaggatggttcaagatccccactttaagaagcgggccccccaaactaatgtttcagatctttttgcctggtgcagaaacttctgtcaaagatgctttggctatttttctctcaatacaaaaagaactttgtaaacaaaacccccaaagaacacggaggaagaccaatacattatatttacacaaactaggccacctagcaatcaacttagtgaagtcctacaaagcccagacaaatacagtaacttggggggcagcatttaggggagacaagaacccaggatcagacacacaccacccaatgcgttctattgtatttgtcccgtttcaacacagtgaggtaggtttgcggtgatctcacagcatgtaaacgaaaccccctttttcgaggaggccattttcaaatttttcagcattaaaaacaatttttttttgctgtgtactttaaaataacatgcttaaattgctcttcttgatttttcagttttagatattatttaatgactttatattatagaagatgaggatttaggtctcttatactactcaatttcccttcttcctagtcttccaacaaaattattataatttttggttaaatcaatattcagtgtttattatgactgtgaaaattatacatatgtatgcacgtatacatagtatatatgtatatatatatacacacagtatacaacatatatatgtaaaatatatataatatagtatactatgattacatttctcctttttgaacattttttttcattttcctgcaattaataattgcctttccttttgtgcatggttttcgatgaacttgtgccccagactttatagcctaaggtcagttcaaacacatcaggcatcctctcagtttcaatttcttttcttcaaggtaacttttctgaagtacttcttcatctaactggtccccctgcttcagtctggcctggttgctctctaaatccttcatctttatcatgggtattacttcattcttcatccttacatggatattacttgtcttgcttaagtaagttttagtgcatatttcctaaagcctatgtcttcctttttccttacatgttccttctttttattagattgcatcctctagtagctttctgagaaagggtgcatgcaaagtaatattttagggaatcttctgtttatgaaaatgactttatactacccttacccttgattgatagtttagatacatataaaattctgtgttggagataattttcccttagaatttttaaagcatttctcccctatcttttagctttctgtattgctattgagtgatctaatgccattctgatttgtgatatttcatgtagttttacattggtgtggatcttctttcattgtcttgagatcctttcagtgtagaaattcatgtatatcagttctgagaagttttcttgaattatgtgtttaatattgtctcatctctgttctatctctggaactgttgttacttagacattggacttatggatttatgctctaatttttcttgttttctcttttctgtcttttttgatttttgtatgttatatgaatatccttaacctttccaatccttttgttgaatatcaaaaatatctattgtattagccagagttccccagaaaaactgaactaataggatatgtaaagacctagatacatagctatatagatatacagctgacccttgaacaacatggatttgaattgtgtgatccacttatacacagattttctttgccacctctgagacagtaagatcaaccccctccatttctacctcctcagcctattcagtgtgaaaacaacgatgaagacctttataatgaatgatctacttccacttaatgaatagtaaatatattttctccttgtgattttcttttttttaaattttaaattattattattgtagagatgggatcttgctttgttgtccaggctggtcttgaactcctggcttcaagtgattctcctgccttggcctcccacagtgttgggattacaggcatgagccaccacgcctggccccataattttcttaacattttcttttccctagcttactttattgtaagaatacagtatataatacatatacaaaatatgtgctaattgactgtttatgttattggtaacgctgtcagtcaaatattggctattaatagttatgttttgggggagtccaaagttatatgtggatattttttcttttctttttatagagatagagtctcgctatattgtccaggctggtcttgaactcctgggttcaagcattcctccctccttgaagtcccaatgtgctggggttacaagtgtgagccactatacccaggccccactttgttaaagggtcagctgtatagatttattatgggaattggctgacatgactatggaggctgagaagtcccaccatttgtgcctgcaaggtagagaaccaggaaagccagtggtgtagttccgtctgagttcataggcttgagaaggtagggtgaggaggagcagtgtgctggtataagttccagagtctgaaagcctgagaaccagaagccttggtgtcccagggcaagatgagagggagaatttgcctttcccctctgccttttgttctgcgtgggccctcattgggttagatggtgcccacccacattggtgaaggtgaatcttctttattcaatctactcattcaaatgctagtctctgccagaaagtctatcacaaacacaaccagaaatgatgttttaccagctatctgggcatcccttagcccaatcaagttgacataaaaaaattcaattatggtagatttgatgatttaaatttctactccatttaaaaaagtttgttgaattcctaaatataagatttaatcttgcctttctgagaatattaattgtagagtttcttttttgttgttgttttattggtttttttttttgcatgtgaatgtcgtctacattttctttttctcctgagttctttttttctagtttttaaatgtgtttttcatatacagacttttctcaagtttttgaagctacttgtttaggaaagggtcttacagatcaatatatagagttttatgtaatattcctgtttttagtagggcacctctgtcttcaaactattcttggtgttcccaagttcaacatccttctgattcaacttctcaatagagaataaacctttaattttaaacctgggtggaggaggagtagtaactttactatgtaaggttgggaagaggatctagaaatataactgcttcttatgtagacttttaacccaattttccatttttacctttacttactcccacggctttagaggtgcctgatacctactgttcctaagcctttctgatgttgtataagagggtgtgcttgttttttgttctcttttctcagtatagccacttaagttttagctttttttctgttcatacaataagttgtgtgtctaatttccattttccaaaatttttaacatttcttatctgctgccatcttaacttcaactctatttttataaatctatgtcttcttttatttagatatgcttagcacaccaattcagtggggtttaaataatttttttttttttttttttgagatggagtctttctctgtaacccaggctggaatgcaatggtgcgatttcggctcactgcaacctccacctcccaggttcaagcaattcttctgccttagcttcccgagtagctgggattacaggcacatgccaccatacctggctaatttttgtatttttagtagagacagcgtttcaccatgctggccaggctggtctcgaacacccaacttcaggcaatctgcctaacttggctttccaaagtgctgggattataggcgtgagccactgcactgggcctaaataattttttgaaagacacagagtctcaatatattgcccaggctgatcttgaactcctgggctcaagtgattctcttgcctcagtttcctgtgtaggtgagattttttagtatactatgcatgacgccacaatgcctggcattttttagtgtactcacaaggttatgtaactaccaccatgatataattgcagaacatttttatcaacccataaagaaacttcataccaattagcagccactcccattttactttccccgcaacccctggcaaccactaatctaatttttgtctctatgaatttgcttattctagatattgcatacaaatgataattattatacaatatggggtttattgtgtctggcttctttcacttagcataatgtttttaagattcatcgatgtttgctgggcgcggtggctaacccagcactttgggaggccgaggtgggtaaatgacctgaggtcaggagttcgagaccagcctggccaacatggtgaaaccccgtctctactaaaaatacaaaaaattagccaggcatggtggcgggtgcctgtaatctcagcaactcaggagtctgaggcaggagaactgcttgaatccagtaggcagaggttgcagtgagccaagatcgtgccactgcactccagcctgggcaacaagagcgaaactctgtctcaaaaaaaagaaaaaaaaaaagattcatcaattgttgtagggtatttcagcacttcattcctgttgtggctaaataatgtttgattgtatgggtacatcacattttgtttattcattcatcacttgatggacctttggattattttcactacttggattttatgaaaatactgctgtgaacatctgtatacaagtttttgttcgaacaccttttttcatttcttttaagcatatacctaggcgtggaatttctaggtcatttggtaactctatgtttaactttttaaaggattgccaaactttttcaaagcagctgctccattttacccaccagcagtatatgagggttctaatttctccatatcctttccaacacttgttgttgttgccttttttattatagccatcctagtgcatgtgaagtagtatctcattgtgggtttgttttgcatttccctaatgattaatgatgttgagtgtcttttcatgtgtttttggccaagggtttgtcttcttggagaaatgtctactcaaatcttttgcctctttttaattgggttgaggttaagatggcagtttagatctggactgttgaattgtaacagtctttacatattctggatactagacccttatagatatatgatttgcaaatattttctcccatcttgtgggttgtctttttactttcttggtagtgtcctttggagtacagtttttaattttgatgaagtccaatttattttttctttggatatttatgctttaggtgttatatctaagaaatggttacctaaaccaagttcacaaaactttgtacctattttttattctaagagttttatagtattagcttttacatttaggtttttgatccattttaaaatggcttgaggtaggagtcaaaaatcatttttttacatatgagtatccagttgtcccagcaccatttaaaaaaaagactgttctttccccattgagtgtttttggcactgtattagtccattctcacactgctaataaagacatacccaagactggataatttataaaggaaaaaggtttaattgattcacagttcagcatggctggggaggcctcaggaagtttacaatcatggcagaagaggaagcaaacacgtccttcacatgataggagcaaggagaagtgctgagcaaaagggggaaaagtcccttataaaaccatcagatcttgtgagaagtctctcactatcacaagaacagcatggaggtaatcacccccatgattcagttaccccactgggtcccttccatgacacgtggggattatgggaactacagttcaagatgagatttgggtggggacacagccaagccatatcaggcacttacgtcaaaaatcaatttgctataaaatataagggtttatttatagactctcaattatatttcattggtttctatgtctgccttatgccagtaccacacagtcttggttactgtagctttgaataagttttgaaattgggaatgtgaatcctacaaatttgttcttctttttcgagattgttttggttattctgggtcttttgcatttccttatgaattttaggatcagcttgtcagtttctctccaaaaagccagctgggattttgatagggattgtattgatattgtaggtcagtttgtggagtgtgccatttaacaatattaagtctaacaacctacgaacatggagtgtctttcctattatttaggcctttaatttctttcaacaatgttctatagttttcattgtataagtcttatacttctttgttaaatgtgttcttaagtatttcatttttatattatcatagttagcactgttttctctatttcacctttgaattgttcattgctcatatatagaaatatagtgccagcctgggcaacatggcgaaaccccatctctactaaaaatacaaaaaattacctgggcttgatggtgctcacctgtagtcccagctattcaggaagctaaggtgggagaatcacctgaacctaggaagctgaggctgcagggagccgtgttcacattactgcactccagcctgggcaacgggagtgagaccctgtccaaaaaggaaaaatgatcttgtatctttcaacattgctgaactagtatattagctctaatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggagttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggagggaaaaaaagaaaacacatttaagctgatacatttaactgcaagatacaaagagattttaaaaaagatattaggggccgggcgcgagaaggcctggatgggcagaccatatgaggccaggagttcgagaccagcctggccaacatggtgaaacccgtctatactaaaaatacaaaaaaaattagctgggtgtggtgcacacacctgtaatcccagctactccggaggctgaggcatgagaatcgtttgaaccctggagataaaggttgcagtgagctgagatcacgccattgcactccatcctgggcaacagagtgagactctgtatcaaaaaaaaaaaaaaaagatattagaaactaatgtagtttgtttgaagttggtcatagctagaccaactagctatgaccaattactagaccatagctagaccatagtttaagaaatttggaaatttagaaaagataactgcttgatcatgctaaaacacctaattcattatttttaaatgtataattaaaataataaataacaacctattatccctcaaagaaaaaggaaaagtataggtttttattcgatgactcagcagttttctatctggtctcgttaccttcaattctttctctttatttctatcagagctatctttctaaaacctaaactggatctggttaaaatctttcactaactccccatgttagcatggcatacaaaccttgtgatatggcagcttttttccctccgtctagcacaattcttccatcaaactgttttctctagctatgctgaacaatgtacagttccagaattcacagtgtcttctctctctctctcttttttttttttttgaaatggagtctcgctctgtcacccaggctggagtgcagtgacgcgatttcggctcactggaagctccgcctcccgggttcacgccattctcctgccttagcctcccgagtagctgggactataggcgcccgcctccacgcctgactaatattttgtatttttagtagagacggggtttcactgtgttagccaggatggtcttgatctcctgacctcgtgatccgcccgcctcggccccccagagtgctgggattacaggcgtgagccaccgcgcctggcccacagtgctttctcttatctctgggccttaatacggactgttttgtttacttagaactgtaattctcaaactttttggtttcaggatctctttacacttttaaaaataattgaggatttcattgagctttaggtaggatatatctatcaaattgttactgaaactctaggggtttggtataggtcccattgcttgcccctcagaaagctgatcactgagactacgagtattgccagggaacaaggctttaatcgggtgctgaagctgaggacatgggagatcagtcccaaattcatctcccgggactgactaaaattgggggtttctatagcagggaagaaacgtaaccatgtgtgggaaaacaggaattagggagggctaaggaaaaggaattggttagtaggaagcagatggttggacaggtaatcatgacaggtgagtgcacaaattttaagactgggggggtcgatttctatgtttattcaaagaaaccataaacatcagttctatgggacaagtggactactttcaaaatactttcaaaatgttactatatttgaatttaaaacagaaaatttaaacattaattcatttaaaataacaataatcagcctatagcatattaacacaaacagcttttttttttttatttttttttggagacagagtctggctctgtcgctcgggctggaatgcagtggtgcaatctcgggtaactctacctcctcctcccgggttcaagcgattcttcttcctcagcctcctgagtagctgggattacaggcatgcaccaccacgcccagctaatttttgtatttttagtagagatggggttttgccatgttggtcaggctggtcttgaactcctgacctaaagtgatctgcccgcctgggcctcccaaagtgttaggattacaggcatgagccaccgtgcctggcctaaagagcatttttattaaaaatattttctaaaaaccaaaataattagtgacaatagtagcattgttttacacttttgcatatctttttaatctctagcttagtaatagaagacagatgaattctcatatttgcttttgcattcagactgttacaaaatgttgctttagttgaagaatatgaaggaagtctatccttacacagatacgtagttcaaaaaacaggaatattttaaattgccttttcaggtatttatttcaccaaaactagagaaatagtagtttcttacaggttagttgcattgtgaaatctaaaactacatcagtgaacttttcagagtcttttatattaaagttcacaggtctatgtgcactacgaaaggacattttaccctcgtatgatttatgcagaaaatggtgcttcacttaagtatagcaggtcttccaaatgtgtatttcatgatacagtatcaaaagatcacgttcattaatatcaccacagatcttatcagaaaagtcttttttttgtttgtttgtttgagatggaatcttgctgtgtcaccaggctggagttcagtggcgtgatcttggctcactgcaacctctacctcccgggttcaagtgattctcctgcctcagcctcccaagtagctgggactacagacgtgcgccaccatgcccagctaatttttgtatttttagtagagacggggtttcaccatgttggccaggatggtctcgatctcttgacctcgtgatctgcctgcctcggcctcccaaagtgttgggattacaggcgtgagccaccgcgcctggcccagaaaagtctttaagaatcgagaagctctcaggctcatggatgaagtatgttttcctcctttttttcccatactgcacagatgtagagttttccaaaattttaatttttcatgtgaaagcttgactttttatcactgataacaaatactatcacttgttttccttgaagtaacaggctcattttgttcatttttgagaaaatttctgccaaatacccaagtctgaacaaccaggatttgtgcattagttctttcaagtaaaaatggtgttttataaaaaaaaaacagctagttgagcttgcatgtcaaataatcttccagtgcttttctttaagacaactttcatgcttttgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcctggcaaaaaataatcttaaaataggaaactatattattatttataactatattattatatattattattaactatattattatcgagacaacatttcaacaaatttagttcaaatatcaaattaacttttattaatgattcatgaacagggcagtatctcctctaaaaatttagaaaaggggctccggtgagctgagtggaggagattggctttataggtagggaagggcggaagaaagcagaaacaagaaactgaagcagattggttgttttgaagttactttccttgtagggtcagaacagaggagacttcttttcatgctggctgaaactggcccatttggagatttggctgttatctctcttgacttctcagaaggtcagataactgacttagttttagtttggtgacctggagctttagcctgagtgactccattttggtttagtctactggggcctagcgcaggaactcagttgaaatcaaaggccttctataaattttatttaacactattttaagatacaagcaaaaatgtaaacatccctcaatacaattctagcaaatggcataaatatatatatatttaattaatatatataatatataattatatataatatttaatatatttaaataatatatttaatatattattaaaataaatatatatacatatatatgtttatcccagaaatagaccagtcttatctataatattatttataagaaaatgataactggaattacccataggagcacattagtagacattcaaagccttttgataaaattatctaattttttttagtatctaatcttgatcacccccccgaacaattaaaaatagagtgtttctgctgggcgcagtggctcacagctgtaatcccagcactttgggcggctgaggcaggtggatcacgaggtcaggagttcgagaccagcctgaccaacatggtgacaccccgtctctactaaaaatacaaaaattagccgggtgtgatggtgtgtgcctgtaatcccagctactcaggaggctgaggcaggagaatcgcttgaacccggggggcggaggttgcagtgagccgagatcgtgccactgcattccagcctgggcaacagagtgagattctgtctcaataataataataaaaaaaagagtgtttctaacttttgttaatgtcttcatttacaaccaagagaagcattagggttatatttcttgaaaaataagaaaaagaaacactgttcttaggcctctagaatcctctagaaccactgttcgtttttatactattggatattcttgtcttacagaaagaccagatctgaacattttttttaaaaagatgaatataggtccccatgactcccacggcaacactgagtggccttgttctacctggctcactttgctaatacagtggggttttttttctttctcttctgtccttatgtgtaaggcagaatacaagggcctgaagcccccgcccctcctgcatttgacaacagggttggacattgtgtattgagtttttttgtttacattgttctgattaaagtatgcaaaataaaaagatgcagttttatataacagaagatggatatagaaacattataaatggtaaaagcttttataattgtttgctgatgagaatatgaaatgatatattttggaaaattgtttggcagtatataaagctgaacctatgtataccctgtgacccagttattcacttctaggcacagaaacaagggaagtgtggacatatgtttaccaaaaaactcatactagaatgctcgtagtggcactattcataataggtccagattatgggaaactggaactaaagaaaacaaatgccgtcaacagtggaactgataaataaattgtggtatattcaacaatggactgttattctgtaatgagattgaacaatgggatattatgctgcaatgagaattaatgaacagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaaattttaaactatatataaaggagaaaggtaagttaactaaatattcacatttaccaataaataaaccactggaaataagatacttttgagttagttaaaacacagaactttatattgggacatctgcaaggaaattggtctcttccgtttcttggatgtaatataatctggtgtaatctttctggaaagtaatctgacaatacataacaggagccataaaaatgagcatatcttttgatcctagagccttacttctgggaatataccctaaggaagtaactcaaaagagaaaagaaatttgcttgtgcaaatatatttatagccacattattttaagcagaaaactgaaaataatccaaaaagaattctgtatttaagcaatattttaaaatgcagtaatacattgatcttctaattttttttttttaagtattgctgggtgcagtggctcacgccagtaatctcaaccctttgggaggccaaggcaggaggatcgcttgagcctaggagtttgagaccaccctgggcaacacagtgagaccctgtctctgcaaaaactttttaaaaattaggcaggtgtggtggtgtggcacttgtggtcctagctacttgggaggctgagataggagaatagtgagagcctgggaggttgaggctgcagtgagccgtgattgtgccactgcacttcagcaagcaacacagcgagaccttgtctcaaaaagaaaaaagctaggtgacctaataagattgccatcagcttcatccttttataatgtcaaaaaaatgaaattaaaagtaaagtttcttttatcttttccctatagtaccattcaaattcttctgctcagtttaacatttttcttcaacttggtccctctaacaagactttttactgggtcattttgttttggaaagacaaagtatgaatttagagaagtagaagagagtatagtaattttttctccttatctatttatagtaaacattatagaagcaaaatatttacttacacttaatcaggtttccaaattgtcctggagagtagaatatcctcctccatgatctagtgaggaggttaagttggaggttaaataccttgcataataccccaaagagataggacagggattagagaccaggtcttatataatgagacccccttgctagggttgttgagcattggtgcctgtctgtgggatggcagtgcagggctgggatcaattctctgtttaagagcaagtctgaaggtcagttctttcctttttgagctgggctatttgagcggtacagtgtacactttctgaagagatttctggaagcaattgcagaagtttcttatacagggtagaatctgacctaagctgtccaaagagaaatggcccttagagagaagttgtgcttcccctttgctacctcatattttatgtgctgcctctcatttgttccttttcctctctagttcaaaatgcaggatctgagaaggagacggagctgtcatcagttctaaacctgaacagaatgtttcctcagttagtaaatggaaaaattattttaaaaaatcttcatgtatgtttgtgaaataccaagacattgatttgtggtctagtttgcaatcatgataattatattaattagtaccaatcatgatcattttaaactttctgaatttctctatcctaattctgtgattcagtggaaaatatttatactcaagagattaaggttcaattttctgccctaccacttaacaactgtgtgaccttgggcagtttcttcactggtaatatggagataataatcccagccttatctgactcctaggtttgttgtaaggttcaatgagataatgtatgtgaaagtattcggtaaactttcaagagcaatacaaatgtttttgttgaagttatgaaagtcattaccctgtttaaaacacagtaagcactgaagatgtcagtacgtctcttaagattctaaaatagtgtcaagaaatgttctatcctatcctagcatgcgctaacctaggtctgtgaataggccaaggagccctctccttggttgattggttgcttgccagatatattagtttgatctcttcatttatactttctggaaaatatatggatgctttatgttaggtttgtctgcatacaacagagaaacctaaaataccgtggtttaaacaagatagaagattatttctctttcatggaaaacaagtctgaaaataggcagtccacagctggtagagtatactccagggtttcatcaggactcaagcatatatttttctgtgccaacatcctcaccatagaatccattctttacctcatgacccatgaggactgaaggaactcctttttatccattgggataaataaaggatatctcaactgaatcagtcccatttaagtactttctagaaaatccacacagtattttgcttacattttataactgagtcacatgactaaagactagctacaagagaagctgagaaatataatctttatgccagtgaccatgaacccaggtatgtatactggagggtgtatgtgtgtgtgtgtgtgtgtctgtgtgtgtctgtgtgtctgtgtgtgttgaagagggtaatttataaccaaaaacattcatatttttatataatgctgtggcagagacttcaagttgcaaacttcaatggcttcttcttccttagaaacgtacttgcagttttggccagtcatggtggctcacacctgtaatcccagtgctttgggaaactgaggtgggaagattgcttgaggctggaagtttgagactaccctgggcaacatagcaagaccctgtctctaccaaaaaacaaaaacaaaaaattaaactgggtttggtggtgcacacctgtagtcccagctactccagggggctgaggcaggaggattccttgagcccagctgtggaggttgcgatgagctatgattgcaccacactgcactccactgtgggcaacagagcaagaccttgtctcaaaaatgaaacaggcctggcgcagtggctcacgcctgtaatcccagcactttggaaggccgaggcgggcagatcgcttgaggtcaagagttcgagaccagcctgtccaagatggtgcaaccccgtctctactaaaaatacaaaaattatccaggcgtggtgccaggcgcctgtaatcccagctacttgggaggctgaggcaggagaatcacttgaatctgggagcagaggttgcagtgagcagagaccttgccattgcactccagcctgggcaaaagagcgagactctgtctcaaaaaaaaaaaaaaaagaaagaaaaagaaacaggccaggcatggtgactaacacctgtaatcccagcactttgggaggccgaggtgggtggttcacttgagatcaggagtttgagaccagcctggccaacatggtgaaaccccatctataccaaaaaacaaaacaaaacaaaacaaaaattagctgggtgtggtggtgtgcacctgtagtcccagctacttgggaggctgaggtgggaggctcgcttgaacctgggaggtagaggttgcagtgagctgagatcatgccactgcattccagtctgggtgacagagtgagactctatctcaaaacacacacacacacacacacacacacacacacacacacacacacacaatactccaatttttacctggagattcgagaaattagggaagaaaccaaagaaaatatatttccttataaaataaatattaaaataaagaaaaaaaagtctgggtgcagtggctcacacctgtaatcccagcactttggggaggctgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaggaaagaaaaatgagaggaaaaatgctagaaatacagggggtacattggtttaatttgaaccctcttatgtatatgtatctttagctccttttactttagcttttctcgtctctttggaaatgaaaatattcagttgttgccatgattttgcttgctttgtacaaatgaaatgttggctttatggttatagacagaaatatggaaaactttagagctactttgagcaagcccaagaactttgaatcattgaatcaagaggagaaaaaatgaagaaaatatttcaagttctttatctgtaaaatgatggagataaacaatatgatctgaaagtctttcaacttcttaagtttttataattcaggagcagtggtaagaatagtaatgaagtttctaactactacttccaagttaagtacaatccagagaggccagtgggacagaatctgtgggacgatgtgggaggacttaagtgattttaagtcctggtgaagaggaatagtgtgttcaatggaaattgaggaagacaaggacttttcaggtcagggggcttaatgggtcatcattgtgtttgttacagagttttaggagagtggtggagaaaaagatggagaaaaagaaaatggactatgtgctcctaggaagagagatgtgattgttttctaacatgtaggcaatgaaccctcagaggaactatagatgagcattagggtgttcttgaatgctctaaaattatatgcaacatattatattcgtttttctgtgagaaagcatttgtagctttaatcagattcttattgtaagctaacaaagccacttgctcttaaaaatgaataataaagactttaaatgattaaaaacagaaaaagtgacacttcagtggtcctgcagtgggtgaatatagtcattgtgatattttcagagtaagctaggtttcagtcacacacacacacacacacacacacacacagtacacacacacacacaatgagagaaatgtatagaatcgtggggaatttgctgtacagttttgggttttggcttgctattattagctgcaccttgggcatgttacagaacctccctaagcttcaatttcctctgctataaaataaggataaaagtaccttaaatggtggttgtgaaaattagagacaatgtaagttgagtacatagtacagtgcttggcacagaataggtatttggtaaccctttccccacatgagttttttaagtttctgtatttactttaaggcccttattgtatgcagtcatccatgagtatatgcagggggttagttccagggctctctgagtataccaaaatctgtgcatactcaagtcctgcagttggccctgtggaacccgaatctacgagaagttgaccctccctatacgtgtgttttgcttcctgagaatactgaagtttcgacctacatttggttggaaaaaaccctcacttttaagtggacccaagctattgaaatccgtattgttcaagggtcaatcgtatttcactttgaaggactggtcctcagcaagttcatcttctgaactactcagtgatgctcacactcaagaagaccatatcttattaagtggttagtttagaagctctttcccatgcagatttgcaagcggagtgtgtaaaaatcacacattgcacttgttgcctggcagcacgtgtccctgagtggtagtacatggcttgcattgtaatgttatcagtgctggggccagctggctagacatgtactgctacatgggctagggactccattcctcaacaaaacagcagccagcactagggttaacagaaaatgacaaaccaggaatggatgagggaggcgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactggccctgccatgcaagagcacaacagaacctttgttaggctttcagcaaagctgtttatgaacggtggcttactgaggactgcttcctgtgctgtgtgcttccattttgtctaaaaagaaaaaaagaaaatagttattaggagtaaaaagaatttggactttcttttattcaagtcctggatgttgaaatgacaagtagcccccaaatttgtgaggaactggtaattgcatcgaatgcattttttcgctttaccttgaacataatgaggctcttagtaacaatagaaggaacaagtgccttctcattggaatagagagaaggaacagtagtaaaaaggcaacagaaagagtagttgagaacaggacaaaagtggcttccagtaagaacactaacattgtaatagaatgtgttttgatatttagcgtttcccacctgggaggcacagtcctaaagtggttgagttgaataaagaacagcatcacagtttataaatagtggatacagtttgtatgttcattaagtaaatatttgaatgtctaccatgtgaaagacactgaatggtcctgagtgttaaaggaaataaaagataaatgagtcatggtgcctatctttaaggatcaggacatccaacaaagaagataacatacgcataacagaaataactgtgtatcaaggtagaaagtgccactggaaatatttaaaatagatgtttagggagtttgggaaaagggaagatcacttctggctgggacagaatcagggaaaggttcacaaagaaggtggcatttgagttgggcctggcagaaaaggtaggactgaacattgcaacattcctaaaagtgatgagtcaaaaattatgttgttctagtaaaacagatccaaagtatgtttttatagggtactttggtggtgtttttataccattaatttagatgatatgttaagtgttatgagttttctgtgtagactaaactggggcctctctgtctagtctatgttgttccaaccatttgccccatacggtttttgtgcactttggcctaggcctttttgtatctataaatatctacaatagcatcctttactttcataacaaaaatagaaactcaaagggattattgagcactattacagctatatcccataaacagtatgtggagatagttcttagtggggatttcacatgtgagactcttatttgaaaaagaatccccaccttcgtgcagagccacatcaaccacaagagagaggacagggaattctaagcccgtgagttttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgataattgataaatacatggtttgcccccaaaggctatactttttcttttttttaaagagacaggagtcctactatgttggtcttgaactcctgggctcaagggatcatcctgcctcagcctcctgagtaactgggaccataggcatgcatcaccatgcccggctgcaagactacaactcgtgctatagcacaattaattttcaccttgtaattttattacttccctgtttgaaaacatgagtggcatatgatttactacatgtttagcaatttacaggattttttttttacccatgatactttctggaaaatagttatgtgaatgtttatggcgttgacttgataactatactgctttattagtaactatttttgcaaagttattgccatgacaaatattacttgggttcttcatatgtcccttagattgtaactgtgggaaacttaagtgctactttagatttctctggtgttcaggaagtacattttgttatggtcagctagctgagtgctttaagtttgaactatgaaaatctccttaaaaaaaaaaaggacgcggtggcttatgcctgtaatcgcagcactttgggaggccaaggcaggcggatcacctgaggtcaagagtttgagaccagcctggccaacatggtgaaaccctgtctctactaaaagtacaaaaattagctgagcatggtggcgggcgcctgtaatcccacctactcaggaggctgaggcaggagaatcgcttgaaccctggaggtggaggttgcagtgagccgcgatcacgccactacactccagcctgggtgacaacagcgagactctgacttaaaataaaaaagattctgtagtttctggcacttgaaattgcaggactccaacctacaaatgctgtattattatgagatttaggctggaaatactgaggcagtaggatttaagcacttacccttaattgacatcccaaaactatatataaaacaaacaaacaaacaaaaaaacaaaaaaacccaccagttttaggaaagagaagggaagaggggaggattaatggttgaccagagactgttttgagtgtcaaggcactcagcttttcacagctattaaccagtacaataccccttttggttgagggaaatagactttagtttttcatcctctacttaacataaagatctttagacacctcttgttttctggttgtcacaggtgatgttagcatatgtgtaatgctttgtttgcctctggcgtgtcttttagtatttgagtttgactagccgtatagcaggactttagtggtttggatgcatagatgcaatgtattgcttttgtctgttttataattaacaattataaaataaaaggtcattccttaatttgcaaatttgttctcagaaagttctgtttgatacatgtcatactgcatggctctttaaaggtggcagtatcatgcagtacagactggaatataggataataggcttatacacttggagtagagaaggcctttttgaataggacacaaagcacaccaaaaaaaagccacagatacattattttgactgtatcaacacttaaaacttctgtaaaatgaaagataccacagacaagttaaaagaagaccatgaagtagatgtatgtatttgtgacatgtatagaattatctacaagtcaagaagaagaaaaaaagacaaccagagaagaaaattggcaaaggataagaaatacaaataaacatgaaaatgtgcttaactttatttgtaatcaagaaaagtaaaattaaaacaacagagaaaagctattttctaactattaaatcggcaaaattaaaaagcattaggccaaggatagtgaaaatagatactcatacagctggtggtgtgtaaattggaataactaatttgtaaaagcaattgtctatctctggtaaacatgaagatatcctgtgcatcctatgaaatgccaattccatcttgaggaatctaccttagaaaaactcttgcacatatatacaaggaaacacgtacaagaatgttcaacacagcccagtttattatagtgaaaacatggaaacaacctaaatgtttatcagtagggaaatatttaccattgggaactatcaaaaaggtaagtaggttccatattgttttataaaagatctccagacattgttgattaaaaaaaaaaaagatgcagaaaggatatatcagacacttaaaaacaacttaaaacatgaaaacagaacaagctcacaaactatatttctgtatttttgaaaatatgtaccccaaactgataatagttgttatctatgggaactggaattagtctttagctttatctgtattgtttgaacctttaaaaattattgtgtgtttaactagaaataaacatttttaaaaatttaaagatcataccagtactttgatttaccaatttaagcttcttaatactataaagtattaacagggaagagccagcaatttctagataatacaacgtaagatggggcactttgtaggtttttggatttttcttgttttgctttcatttttggttttgagaggtagtggggtgaatggaagaatacgggctttggagtcaaatctaagtttgaatccaagctctgccatttatttagactttgggcaggtttcttaacctctctagtttttaaaaaaattgctattacctacttcgttgggttgtataagaattacatgtgctagatttcctcatttccccattccctttggttaagggaaattggtctagtgtggtctaagatcaaagatggtctcgtatggatgacaaaatgtttcacaagaacacactatatccttggaccaggatataccagtaaagatggaggatgtaaataataaattttagaggtctattaactgtttaaaccattaagctatctatttgtacctcacaagatcaaatactagattatgttagtgatttataaatgatattgaacttgaaacttctaagcagtttacatgacaggttgttgattaacaggtttacttttttttttaaatctcagagaacattttaatttagttcagcaaacatttatttgtgccatccagcatctcaatctcaagaggcctcatagaccaaaatatgtctcaaaaggaagaaaggaaaactctatgtatttatcaatttatttatcaaactctggcaaggggggaaaaagtcaggtttaaagttgagtatatgtatatactctgcttttcacttgtactgctattgcctatgtgtgcatctgttaatatcatatatagcaattcatatgaagattttttccagtgagacttagttattctattattgggactctgtattaaataataatttttaaaaaagagtgctctaactaatgttaaggtggaaattctagacccctcaaacaaaaatttccaaataggaccccttatcatttaattgtgaaataaacaactaatgcttttatggtatttatgcttgggaagagaataaaataaatagttttggattttccccatataaattagggcctgctgagtaattagcagttaataagtgaatgcttcctacaagtttaaaggtcatacctgaaatgggtatatgatgatgtatatttttatagttatagattttatatagcccaagaatccttgaagatagtctaaacatcttggtttgatgagcagaactttcaataagggggtaaggggctaatattgtttgagcacttactatgtgccaagcactattctaagatgattacatagattattttatttaatcttcaccacagtcttctgtggtaggtactagtattgcccaattttatagaaaagggcagagagataaggtaacttatatgaagttacacagtcagtaaatgacagagctagaaatcatatccaggttcagttggctcaagaacccatattcttaaccattgcagtaaaaattgttatgctgttttaatctgtagagtcagcatgtagcaataataatataatcattaacatgttacattttgcatatattgaatgctttctaaagaagtagtttattatcagacatattcttagaatcatacccattttatagcaggattgacagtgttataaagagattacgtgatcaacatggggtgagtcaacagaaccaagaagtttctgatccacaattgccttcacttgctaggttcaagtaaggatcatatagtgtttacttacatttgccttagatttttcagtatagcatgatgaaattctaaatgcttatctcagacagtgatgctatctgagcaagacatggacaattgggcattagtgtgaattttaggacactagagcgtaggtacaggttagaaaacttaatcctcatcttgtggaagtcatggcaaagccaaagaggaaaagcctgtcttaaatgcttttccttttccaaggggcagctaaggtgcccagatatctttgccctccagggatgcaggtgtgctgttttttattctttaatcattcacataaattaaagcctattcctttgcattaaaaaaaatgtaaaatgacactctccgtgttttattgccaggcaagagctttgaacttctgtctcattgaagtttgataaactaaggattttcccgtgttgggtggtacccttaaccacagagggagcattagactgataagagctgcaggtgaaggaaaccaccagggcacggcaattagggagagcttcgcacttggctgttggctggtgtaaaactctctgcagggaggaacttttcttcttagcttcttcccttcacccacacgtaaaaagaacaccagggctttctatttctactttgcgaactaggaatggatgggatggttcttttcaagaaactttcaaatttagggacaagttctaacttcacacaaatgctgattggtatgaaggtggggggacaggacagacagacatacacacacataaattcacgtggacccaaatggaccatatctctcaggtgattttactatcaacatacattcctgcctttgtgcactgtgtaaaataaagataatttttacttccataactgattataaagtgttaatggtgaggcaacgtgttaagagaatgggttcttgtatcaggtaaaccttggttcaaatcttggcttctcttcccactagctgtgtaaattaattttgtaagtctcagttctcccacttgtaaaaatagaagtctaagaataactattataggattgtatttggaagaaatagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttctagaaggacaaaagtactttgatttttactgctctgaaaatatttatcccgtaaaaagctttcacattaactttgagtccctggagctagggaggagaagcagcaggatttgctactaagtagagctctttcatttctaccatcaaaaagaaaaaaaaaaaaaatcctgtgctagccttaggtagagctaagtcataaaaggccatatagcctaaggaaggactctttttataagatcaggataaaccgatagaagaaaggaaggagaacacagaggtgaaaatgcagctgattttaatgtttccctggccattttccctcccaatttaatatacacctaattataattattatattttgaaaacaataccagaaattggcaggtattatctcacagcttcactcttagttttggccgtttcttaaagaaacagttttctagttggatgaactgttgagttgaggcactgattttgttttcacctctttttgggtggggttgggggtgggcagtcagggtttgcagtggtttatagttgttagttttgggaagcactcatttagatagaatgagtcacagaatgtaaacaggtcatccatctggactttaggctgctgggaacgtggtgaaaccttaggtcaccgcgatcattatggtcaaatgaagacttttgggctcaggttggcaggtaaacttacttgttttatgagcttcactagactaccaggacttcagaaatagttttttgaaataccaatatttataaattttaggtaattccatcatattttcctgaggaatgaaactgtgaaagaagtaaatgtctactttggcagcaacttcatagaattgctttttggaaggatattcatcactttggggttttttgttctcactgctccagatgaaagtatttttctgaattttttatggtaaatgtggacactgaattggaagcttctatgtaaagtttgtcaggaaacctctgtcatacctaaggataaaattcagagaaagggaagaagtatttgagtacctgacatctaagaagttctggcctatgttgtttactgagtaaactcccaataatgctttgagacaggcttttaaggaaacatgttatcaatcacgtactatgtaccaaacacatagtggtgttttacctgtattatcttatttatttctcataaccctataatgtaagtaccattattatccccattttaccatgaagaataggcttgaagaataatttgtttatggtcacataactaggaagtggcagagctgagaatggagctctcaactctctgtaatccaaagcccaggttcttaaccagtgattcttaaacttaagagtacataagaagcatcaggagtacttgttaaaaattactgggctgtagtaaaaaatgtaaggtcactaaatctgggacagtgccagactataaatctgcgttttaaacggcatcccaggggattcagatcaagaaattgattgaccatattttgagaaacatagttaaattatattgcttttcacacttgataaagaagaaaacaggtgtagactaagtaactatccaagattaagctaccaagacagagccatgattcaaactcaggtctgtctcactctaatactcatactttttattatacgcccatgattaactcacacatttccaagtcacaacaaatgcagaaaacatgacatctaataaaccaagccagatagatttcatggtcttgttatttaccaaagttaataacttatatatacaccagtacgaaaattttcatggtccttaaacctttccagtgactttttttttttttttctaatttaaattaactgagttttcttttttttctgttctgaaatgaagtctggctctgtcgcccaggctggagtgcaatggcatgatcttggctcactgcaacctccacctcccaggttcaagcaattcccctgccgcagcttcctgagtagctgggattactagctactcaggaagtagccactgcatctggctaatttttgtattattggtagagacaggttttcaccatgttgccaagctggtctcgaactcctgacctcaagtgatccacccgcctcagcctcccaaaatgctgggattacaggcctgagccactgtgcctggccagagttttctttacaatcataccatccatgcttcaagcatggaattactaactccctgggataagtttctgatgcagaaatggaaaagaatagaaggaggtagaaagaaaagaacttccaggtgtatctgctgaatggtgctaaatctcctcttcaacccacccttgtgattgagatgaagaatgaagggttgatgctaatactaacagccagtcaaatggcaattggtcatgttcacatcatctcccaatctatcctttgagactatagctcagttagggtcagcaagtttgctttgcctattccagtccactgatgaagtgtcatcagacagagccaacacctggattgccttacacatgacctcctactaggattgggatcattctttttaaaatctttctctcattttctctttctctcttgctatttgattgcagctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagttttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagttttctttctacaggatgctgtgccaatcacttaatgatttaagtgtatttctaatcagcaaagtgaagagacaacccacagaatgggagaaagtatttgcaaactacccatctgacaagggattaataaccagaatatataaggagctcaaatatctctataggaaaacatccaataatcccatcaaaaaatggacaaaagatgtgcatagacacttctcaaaacaagacatacaaatggcaaacaggcataagcaaaggtgctcaacatcattgatcatcagagaaatgcaaatcaaaactacaatgagataacatctcaccccagttacaatggcttgtatcctaaagacaggcaataacaaatgctggcgaggatgtggagaaagggaacccttctacactgttgatggggatgtaaattagtataaccactgtggagaacagtttggaggttcctcaaaaaactaggaatagggctgccatatgatccagcaattcaactgctgggtatatacccaaaagaaaggaaattagtgtatcgaataaatatcagtactcctatgtttgttacagcactgtttagagtactaagatttggaagcaatctaagtgtccatcaacagatgaatgggtaaagaaaatgtggtacatatacacaatggagtattatttggccctaagaaagaatgagatcctgtcatttgcaacaacatgaatggaactgaagatcattatgttaagtgaaataagccaggcacagaaagacaaacattggatgttctcacttgtttgtgggatgtaaaaatcaaaacaattaaactcatggacaaagagaatagaaggatggttaccagagattgggaagggtagcagggggctgggggaagaggtggggatggttgatggttacaaaaaagaaaaaaaagaatgaaaaagacctgctatttgatagcacaacagggtgactctagtcaatgataacttaattgttcattttaaaataactcaaagggtacatttagattgtttgtaacacaaaggaaaaatgcttgatggggtggataccctattctccatgatatgattagttaacattgcatgtctgtatcaaaacatattatgtgccctaaaaatatatacacctactatgtacccatgaaaattagaacttaaaaaaattttttaaaggaatatttctagagggaggatatctttcatagattatatatttgaaaggtcatacctaggccaggcatggtggctcaaacccgtaatcccagcactttgggaggctgaggtgggcagatcatgaggtcaggagttggagaccagcctgaccaacatgttgaaaccccatctctactaaaaatacaaaaatcagccaggcatggtggcacgcacctgtaatcccagctactagggaggctgaggcaggagaatcgcttgaacccagtaggcagaggtggcagtgagccaagatggtgccactgcactccagcctggccaacagagagagactccgtctcaaaaaaaaaaacaggtcatacttctttataaagtatacttagaatgtgtaaaagtcaaaatgattactaccttttttatttttctgagatagaattttactctgttgttaaggctggagtacagtggcatcatcatggctcattgtagccttgaactcctgggttcaaggaatcctcctgcctcagcctccccagtagctgggactacaggtatgtactatcatgctcagctaaatttaaaatttatcttttgtagagacagggtttcagtatgttgaccaggctggttttgaactgcaggcctcaagtaatcctctcaccttggcctctcaaagtgttgggattgtaggcatgagccaccatgcccaactgattaccactttttgaatatcacagaactgtttttaggctgaatgagataaacactttaaaaacacattaatattctttttcttccaacttttattttagatacagggaatacatgtgcaggtttgttacatgggtacattgcacccaggtagtgagcatagtacccaataggtagtttttgacccattacccctctcccttctcccctctagcagtccacagtgtctgttgctcccatgttcatgtccatgaatgctcaatgtttagctcccacttataagtgagaacatgtggtatttggttttctgtacctacattaattcacttaggattatggcctctagctccatccatgttgctacaaaggacatgatttcattcttttttatggctgcatagtactccatggtatatatgtaccatattttctttatccagttcaccttgatgggcacctaggttgactccatgtctttgctattgtgaatagtgcagcaatgaatgtacgagtgcatggggagaatgatgtattttcctttggcatacccactaatgaatgggactgctgagtcaaattgtagctctgttttaagttctttgagaaatctccaaactcatttccacagtagctgaattaatttacattcccaccaacagtgtataagcatcctcttttctcagcagccttgccagcatctgtgttttttcttttttgactttttaataatagtcattctgactggcatgagatggtatctcactgtggttttgatttgcatttctctgatgatgagtgataatgagcattttttcatatgtttcttggccacttatatatcttcttttgagaaaatgtctgttcatgtcctttgaccatttttaaatggggttatttcgtttttgcttcttaagttccttatagattctggatattagacctttgttggatgcatagtttgtgaatattttttcccattctgtaggttgtctattgatagtttcttttgctgtgcagaagctttttagtttaattaggtcccacttgtcagtttttgtttttgttgcaattgcttttggggacttggccaagaattatttgccaaggctgatgttgagaaggatatttcctaggttttcttctaggatttttatagtttgagatcttacatttaaatctttaatctatcttgaattaatttttgtatatagtgaaaggtaagggtccagtttcattcttctgcatatggctagccagttatcccagcaccatttattaaacagggagtcctttccccagtgcttgtttttgtcagccttgtcaaagataagattgttttaagtgtgtgctttatttttgagttttctgtactttccattggtctatgtttctgtttttgtaccggtaccatgcaaaacgcaatcttcatgaaaggatgtgctagagaaatacatatgccatcacatatttatataatcgtttggattctctttccttttcttctggtttttgggaacattctaagaaaggaagagtaatccttataggcttccatttaagtgaatcttgaactcaagttcatctttcttgaacatagtttttttttttttttttcctttctgttctccagaggctccttggagatcagacagctattcaaatggcctcaccttgggtttctgttaggggaatacttgagattccctagctcttttgctgaactctaaagttcttttcaatgaaatctagattttttatggattggcatttaggttcgttggaaaaagaagctttctgggagtaaagttgttcctttcacccagtcttctaaaggaggatgaagtagagaaaggaattttatttgttctcatgatgtgggctggagcaaatgaggtgggcagggaataaagactgagattgaatagccttgcttgcttttacagaacagacaagtgaactgacaagcctacgggtcaagtttctataccatttaatctgtaccagcactcttgaggctccttgccaagtgaaatatgactcttctgggggtaatgcttcttcctggcttttttcattttactcccctccccatctctgttacaagtcttttccctattacactggttgcttgaaggtaggcatcatttaaatttttttttgaggcagagtctccctctgttgcccaggccggagtgcagtggtgcaatcttggctcactgcaacctccgtctcccgggttcaagagattctcccgcctcagcctcccgagtagctgggattacaggcacccgccaccatacctggctaatttttgtatttttactagagacggggtttcaccgtgttagccaggcttgtcttgaactcctggcctcaagtgatctgcccgccttggcatcccaaagtgttgggattataggtgtgagccatttgtgcccggcctcatttattcttcatctttgcattcctggtacttggcatgatgctttgcatataatagatgttagctaaatatttattgaatcaacagcagtatctatattttaagttattgaatactatctactcttctagattttgttataataaggactactttcttgttttttcctccctttctttttttattttttttatttattattattttttattatactttaagttctagggtatatgtgcacaacatggaggtttgttacatatgtatacatgtgccatgttggtgtgctgcacccattaacttgtcatttacattgggtatatctactaatgctatcccttccccctccccccaccccaagacaggccccagtgtgtgatgtttcccatcctgtgtccaagtgttttcattgttcaatgcccacctatgagtgagaacatgcggtgtttggttttctctccttgtgacagtttgctcagagtgatggtttccagcttcatccatgtccctacaaaggacatgatctcatccttttttatggctgcatagtattccatggtgtatatgtgcccattttcttaacccagtctatcattgatggacatttgggttggttccaagtctttgctatcgtgaatagtgccacaataaacatacatgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaaatgttcctatttctccacatcctctccagcacctgttgtttcctgactttttaatgatcaccattctaactggtgtgaaatggtatctcattgtggttttgatttgcgttctctgatggccagtgatgatgagcattttttcatgtgtctgttggctgcataaatgtcttcttttgagaagtatctgttcgtatcctttgcccactttttgatggggttgtttgattttttcttgtaaatttgttgaagttctttgtagattctggatagtagccctttgtcagatgggtagattgcagaaattttctcccattctgtaggttgcctgttcactctgatggtagtttcttttgcagtgcagaagctctttagtttaattataccccatttctcagttttggcttttgttgccattgcttttggtgttttagacgtgaagaagtccttgcccatgcctgtcctgaatggtattgcctaggttttcttttcttttcttttctttttttttttgcctaggttttcttctagggtttttatggttttaggtctgacatttaagtctttaattcatcttgaattaatttttgtataaggtgtaaggaagggatccagtttcagctttctacatatggctagccagttttcccagaaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgtctccagctttgttcttttggcttaggattgtcttggaaatgagggctcttttttggttccatatgtactttaaagtagttttttccagttctgtgaagaaagtcattggtagcttgatggggatggcattgaatctataaattaccttgggcagtatggccattttcacgatattgattcttcccatccatgagcatggaatgttcttccttttgtttgtgtcctcttttatttcgttgagcagtggtttgtaattctccttgaagaggtccttcacatcccttgtaagttggattcctgggtattttattctctttgaagtaattgtgaatgggcgttcactcatgattttgctctcagtttgtctgttattggtgtataggaatgcttgtgatttttgcacattgattttgtatcctgagactttgctgaagttgcttatcagcttaaggagattttgggctgagatgatggggttttctaaatatataatcatgtcatctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagcttttgcccattcagtatgatattggctgtgggattgtcataaatagctcattattttgagatacaccccgtcaatacctgatttattgagagtttttagcaggaagggctgttgaattttgtcaaaggccttttctgcatctgttgagataatcatgtggtttttgtctttggttctgtttatatgatggattacatttattgatttgtgtatgttgaaccagtcttgcatcccagggatgaagcccacttgatcatggtggataagctttttgatgtactgctggattcggtttgccagtattttattgaggatttttgcatcgatgttcatcagggatattggtctaaaattctctttttttgttatgtctctgccaggctttggtatcaggatgatgctggcctcataaaatgagttagggaggattccctctttttctattgattggaatagtttcagaaggaatagtaccagctcctctttgtacctctggtagaattcagctgtgaatccatctggtcctggactttttttggttggtaggctattaattattgccttaatttcagagcctgttattggtctactcagggattcaacttcttcctggtttagtcttgggagagtgtatgtgtccaggaatttatccatttcttctagattttctagtttatttgcgtagaggtgtttatagcattctctgatggtagtttgtatttctgtgggatcagtggtaatatcccctttatcattttttattgcgtctatttgattcttctctcttttcttctttattagtcttgctagtggtctatcaattttgttgatcttttcaaaaaaccagctcctggattcattgattttttgaaagtttttttgtgtctctatctccttcagttctgctctgatcttagttatttcttgccttctgctagcttttgaatttgtttgctcttgcttctttagttcttttaattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtagtcattcaggagcaagttgttcagtttccatgtagttgattggttttgagagagtttcttcatgctgagttctagtttgattgcactgtggtctgagagacagtttgttataatttctggtgttttacatttgctgaggagtgctttactaccaactatgtggtcaattttggaataagtgcgatgtggtgctgagtagaatgtatattctgttgatatggggtggagagttctgtagatgtctactaggtctgcttggtgcagagctgagttcaattcctggatatccttgttaactttctgtctcgttgatctgtcatatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttctttgtctcttttgatctttgttggtttaaagtctgtttaatcaaagactaggattgcaacccctgcttttttttgttttccatttgcatggtagatcttcctccatccctttattttgagcctatgtgtgtctctgcatgtgagatgggtctcctgaatatagcacactgatgggtcttgactctttatccaatttgccagtctgtgtcttttaactggagcatttagcccatttacatttaaggttaatattgttttttattttattttatttttttttttgagacggagtttcgctctgtcgcccaggctggagtgcagtggtgcaatctcgactcactgcaagctccgcctcccgggttcacgccattctcctgcctcagcctcccgtctagctgggactacaggcacgcgccaccatgcccggctaatttttgtatttttagtagagacggggtttcaccatgttagccaggatggtctcgatctcctgacctcgtgatccgcccgtctcggtctcccaaagttaaggttaatattgttaatgtgtgaatttgatcctgtcattatgatgttagctgattattttgctctttagttgatgcagtttcttcctagcattgatggtctttacaatttggcatgtttttgcagtggctggtactggtttttcctttccacgtttagtgcttccttcaggggctcgcctggtggtgataaaatctctcagcatttgcttgtctgtaaaggattttatttctccttcacttatgaagcttagtttgactgggtatgaaattctgggttgaaaattcttttctttaagaatgttgaatattggcccccactctcttctggcttgtagagtttctgccaagagatctgctgttagtctgatgggcttccctttgcgggtaacccgacctttccctctggctgtccttaacattttttccttcatttcagctttgatgaatctgacaattttgtgtcttggagttgctcttctcgaggagtatctttgtggtgttctctgtatttcctgaatttgaatgttggctttcctcgctaggttggggaagttctcctggataatatcctgaagagtgttttccaacttggttctgttctccgcattactttcaggtacaccaatcagatgtagatttggtcttttcacatagtcccatatttcttggaggctttgttcgtttctttttactcttttttctctaaacttctcttcttgcttcatttcattcatttgatcttcaatcactcttacccttttttccagttgatcaaatcggctactgaagcttgtgtgtgtgtcacatagttcttgtgccatggttttcagctccatcaggtcatttaaggtcttttctacactggttattctagttagccattcgtctaatcatttttcaaggtttttagcttctttgcgatggattcggacatcctcctttagctcggagaagtttgttattacctatcgtctgaagccttcttctctcaactcgtcaaagtcgttctccgtccagctttcctctgttgctggcgaggatctgcgtttctttggagaaaaggcactctgatttttagaattttcagcttttctgctctggtttctccccatctttgtggttttatctacctttggtctttgatgatggtgacgtacagatggggttttggtgtggatgccctttctgtttgttagttttccttctaacagacaggaccctcagctgcaggtctgttggagtttgttggaggtccactccagaccctgtttgcctgggtatcaccagcggaggctgcagaaccgcaaatattgcagaggagcaaatgtagttgcctgatcgttcctctggaagctttgtctcagaggggcacccagccgtatgaagtgtcagtcggcccctactgggaggtgcttaccagttaggctactcgggggtcagggacccacttgaggaggcagtctttccattctcagatctcaaactccgtgctgggagatccattaccctcttcaaagctccgttggaaatgcggaaatcacccgtcttctgcgtcgctcacgctgggagctgtagactggagctgttcctattcggccatcttggaacctccccttttcctccctttcttgattctttgtggtaaagctctatattgtgccattttagaagctgtatactgtgcgccttgcactccaaaagtgaattccacttgttctgtgtagccaatgctgagctgtagtgaaccaacagtaaggctgactgtaggcagcttttatctaccaacacactgttgaaaaaaaatcgtaagattttctacagtgctgatagaaatgtacttgccaagcaggctgtttcttgtccccagaaagctgaaatttacataatatacgagtgacacatacctgacacttccataagtctatgacaccagattggcttgaggtaaattattctaagaagtgaaaagtaaaccagctccagaaacttttgggttttctttttttttgaagacctgaaaggtgtggatgtatgacagaatgggaaatagtgtaagtataatttggtagacaaggagacctggatgatggaagctcctgagtttactttgtgaatttgatttagttagtgaaaatccttcactttcaggcttcagtttttttgttttgtttttttttgttttttgagatggagtcttgctctgtcgcccaggctggggtgcagtggcgcgatctcggctcaccgcaagctccgcctctcaggttcacgacattctcccgcctcagcctcccgagtatctgggactacaggtgcccgccacatgcccggctaatttttgttttttgtatttttagtagagagggggcttcaccgtgttagccaggatggtctcgatttcctgaccttgtgatccgcctgcctcggccttccaaagtgctgggattacaggtgtgagccaccgcgcctggcctcaggcttcagttttgtattgattaataagagaaacatagtgaagtggaaagagcactaccctagaaggaaaaagagctgcttattcttctaagtcctcactctataaccctgggcaaatttctgaaatatgggcttcagttgcctcatctatgaagtgggtttaataaagccttacatgataataataataatataataattatatattataatatgcagtttttactaaactaataccatgtctcagctactacaattctttgagatgggtactattattattgttatctctgttttatagaggaggaagtggatgctcagaaagattaaaatagcttcttcaagttcacaagctgttaagtgacagactcaggaatcaagcctcatctgcagtattatagagtccactgttctctactgcctccaagccactttactgcttaatgttgctagagggctaaccagatcatatttggaggtttcttctagctataatttctactatttttgaattctcccttatgaactatactttgcaagcttatcacacagccttagctggtgacctcagtttactgccatttaaatgtttaatatggccttttgggggatgcaactagagctgactataaagagcaggaagcatgattttcaaaaatatgttaacggtatccttccatcttacagtttcgagttcacatcttgagactttcatatatttagccgtgggtgatttacctttaaacagtgataaaagtactccttgaaattgtatttggaaggcttctcttctgattttcttctctgggtctgcttgccctctcacctatgctgtctgtcactccttggttgttggtgttttcaaacaagtccatgactgttccagcaaatctggataaactgtaaaacacaagtggctgaacagtactttgtgtatgtctgcaagaccatgagctctgtagatcatattcctctggacactcttgaaagacggatactaaatcccagaggattttcttttatgttgtatgtaacctctacctctgaatgttgtccttcaaccagtggaaggtaaaagaaattaatatttagaggtgctactctaagaataggccaaatgtcagcactgggtcaggacctctgaagaaatacatccaagaaaatgggcgagagtagctctaacttagaaaccacagcagagtgtgaccagattcttgtggtaaagataaaatgagaaatgtggctttttgagacattggaaaataatgatgagagaaaaacaggatgaaatctgagaatttgtatcagaattgggaaccattcttcacaggctaaattgatagttccaacactatggcatcagggagcttgacttccacatactaatatagaaaagaataatattctgtggtcttggttggtgggcccaggagagctcgcttttatgatcaagtgtcttgttttcgttttttaaaggatgattttagttttttggtgaagtttttatgatgactgttttggttgcaagggaaagaagtacacagactacctttggtttattttaaggatacgtgagaatatgcagcattcatttgtgaattattcattcacaaattacttttgggcacctactctgtgcctgtgtgtactatgcaatgggaatagagcagtgagcaagacaaataaggtacctatctttatgaacctagtgttttaatgagggtaataatcaataaacaagcaaactgatggggatgagaatagctaatagttaataagcactgtgtgctaggcactgttctaagcatataatatccattattttatttaatcttcacagttctatataaacagggtattagtattatcctcattttactcataaggaaattcaggctataaaagtaacattctcatggttacatagctggtaactgtaacaagacaaataacaagaaaacagccagagtaaggtaatatatagtatggacagggaagtcctcttggaagagatgacgattgagagctcatcccatcagagagccaataacttagctcagagggtgatgcaccttttctttgtccaccttgattatctaagtaagcttcctgtgtccaaaaatgatcatttgattgattttatttgttgctactgagaatggagtacccttactaggcagtgttcttaggaccccctcatgggtaactggcctccctcatgctctgctcctatttaaccagtgaaagtaaataaaataattcatcatcaaaagtatttgtgttctacactacatagtataaatatggagatggaaatctttgtcagtttttagaaaaggagcattaataatttcattttgatacatgttaatcatcagaattaattttgattcaaataaatccataaaatatgaacttcattaattcatccttggagaaaaaaagagattccaatagtgcatacccgttttttttttcttttttcttttcttttactttaagttctgggatacatgtgtagaacgtgcaggtttgttacataggtaatagtgcatattcctaaataacttaaaacgtaactctaatgaaaacaatccatgattataaaatatgtatcatttcttgttattttttttttcagacaggtgctttaagccctatgaaaagatgacccacttctttcctacataatctataacaatcagggcataaacattcattctaaaggtgacagattttttaaggatcattcaccatctagagtttaaataatgttgtttggggttcttcttgtgtccatggtaacagaggagcaggtgtgaggcaacaagaagcacatcagaacaaaccaagacttcgctgatttccagcttgtagctctgaatgagagatggacttgagacttctttgggccatttctgctcatgttttctctacttatttacgttaaattgagccaaaatgtggtgtggtaaagtaatggtgactaatcctattatagacttcttcaaaaggggtaatgcttccccctttacccaccccctcccctgacttttttccatagttcagttcttagctgttaaacattgtaacagaaaattacccgtttctcattgtcagcatctggtttcccacagactcagataattgtcaggaagagatttgccttcagttaaagcaaccctatccccactgttactaggccaggcacctctgttagaccatcatagaaccaaatctatagaggattctttctggctcttttctgtattactagaggtatgctatagcaaaaagactacagggagccatggtggtgagttaagagtcaaaatctgttttgaaacttaaaaatccagggtcattgaggatgcaagaagttgcctgtttttgtagaatccatctcacttcttcagtccctttgtattatggttacaggaaactatccagcagcacttgacctggtaatggaggaagctatttcacagcccactggtcccttgactcgtttagaagtcagagtcaaaggttacagaagtaataattgggcccagattctccctgtcaggaaagaccttgttccccccaccccaccccctgccttctacaagttaagagaaacttatctgttataaaaccattcaataagaggaaatgaagaaacaccatccttggctgaagtgttctcaagccccaatgatactatttctgttttcatgggagctgcttttgcagctagctagtataaaatttaggtctgattttttacattaaaatatctccccttagataaataacttgatttatttcaatctataaataatatgaaggatctttatttggtccaagccctgatattccttcacaccaccactctgataattccctgaatacttgtctggcaatcaagtacactcacacgagtcttaattaacaagtgttatgccattagcaatgtaaagtcagtcatcaaaagttaagaaactaggccagattataggctcacacctataatcccagcactttgggaagccaaggtgggaaaatcacttgaggccaggagtttgaggccatcctgggcaacacaatgagacccctgtctctacaagaagaataagaagtttaaaaagctttacttcaccagcaacagaacaatttaaaattttcagtgcttttaatttcttccataatttgctcagaactctagcagatcaatctgtggtgccattggcacaggcttggcactggagtaggaaagaatgacacaatttggcacctttaaccagaagatctttaatgagctggcgtgggggtggaggggacagagaggaaggaaggacagttaggattttggcagtaacacaaaggttcttcttccctgagaaaagtgaaatgaaagtcaaatgaagcttcactctgcttttagaatttgctaagatgtttgtctgtctctcagctcccggcccccttgcaggtgcatcattatagtcagtgacttctccaaaaaacaaattgtctctcaggatccttcaggaggggtcatatctaaccaatttcttgtctgaggacataattgtgattcccttcttcaactatcagatgcaatgctaccagcactgcagaaactgtcttatcagaaagtggcacaaatgtgtacatttcttctaggtcacagttctagtattgctgagttctggggctgcaacaatagataatactacaatgagagatgtttgggaaaagcattgtttcctgggtggccgtagaagcagacttgaaatcatccctttgtcattaaataatatcaacaacaaatgtctttgttgatgtcattgtattgtaattttctaggtctagattattgctagggatgataatacctatcttctagggttgttatgcaaatcacatgaaattacacatgcaagatgtctggctatatataattcatcttcattgtgtgttgttctccttaagctccacttttctgggatttttgtatctctgtggatctggatagtcttccttttctctctctttaaatggcatcagagttgaagatcttgaggactttttagtctctcttttgttttttgttgttgttgttgttactggtttgtttttgtttttgtttttttgtttttgttttttttttttgagatagtgtctcactctgtcacccaggctggagttgtagcacaaacatggctcattgcagccttaacctgggctcaagcaatcctcctgcctcagcttcccatgtagccatgaccacaggtgcgtgccaccatacccagctaacttttttttttcttttttatagagacgggtctcattttattgctcaaactggtcttgaactcctgggctcatgttatgctcctgcctcagcctcccaaaatgctagaattacaggtgtgcgccactgtacctggcctctcttactttctataacacttctttcttgccctgtattttgtgtacgtttttggagactaaaacattcaatgattgcctgcatgactcttaaccacttcactcatcatttagttcattcacagaatagcctaagaaagcttttctatctttgttttctttgcatatgccattttctcacttcctgtctttaccccctttcctctagatacagaattttaaaactcaaggtgtagtgggagacttgagtcagtcaactctatccaacttgtgttgttcccactcttagctctagcagtacagtgatgggctcagggtaatgaaaagcagactttctctgctgaggtcattgctcctcatgctggcagcctgctccaggaagctgtttatctatgcttgcagagccaagctccagcctctgaacagttggaatgtattgagaaaccacagagcccaaagagagaacattacacaggcagttccaggcagggagagtatatttacaccagacaaactgcagcttacatgtgtggggataattgttcatctgcacactctcatactttaccttctatgcaatctatataccctctcaagaaggtttaaccaggagaacttgtactgctatgtccaaattaccctgaacatcccctaaaatgtcataaggaaaaagagatactacagaaaattgatgtaaaaactttttaagatagtggtttttttgtttttctgagtcaaattttatgtttagaatcttagaccatgtaagcctgatcactaaagcattcaaaaacactgtttcttgcatggaaatgtttttcttcatccctttacaaaaatattaagtattgttatagagcttcaaatgtgctctatattaataggaatataagatatggtcacttccctgtaagatgtaatctggttaaagaggtaaaactcattgaataacgaacaattacagagcaatacaagaccttatataatggcattaagttatatggcccagtacactgagaattgagagtaaggaaaaataatggctattagttaagtaaaattagttgagtcttatagaggagtttgtcttaattttggaaaggaaggtagagtttggataaacaaaacagaaaggagacatattttgcaacatgaaagcaccataacatagtggttaagaacatggactttggaatcagataggtctatgttagagggcctgccactttctggtatgagatcttgggcagattgcttacctcatctataaaatagggagactcatatataaaatataaaattccatgttacataattgttggaatgattaaatgagttaatgaaagtaaagtgcttggcatttcacttaagatacaataagtgttgaattaattagtagctactgctactactgttgttcactcattcattcaatatatatttattgagtgcctacgtcttagcgttctagatactagggatatagcagtgaaaaaaacagaccagaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatctttttttaaatctctggatggtttttggatatttctacttggtctttggtttttgatagttttagtgtaatgtgtctagttttgcttttctttatatttaaactattcggtgttcttagtgcttcttgaacctatagcttgatatcatttatcagtcctggaaaactctcaataattagctcttcaaatttacttctgttctactctctctctgtctctgtctcttttttttttttgaggcaggatctctgtctgtcacccaggttggagtgcagtggtgcagtcatggctcactgcagcctctacctcctgggctcaggcaatcctcttgcctcactcagcctcccaagtggctgggaccacagttgcacgccaccacactcagctaatttttttttttttttttttagagatagggtcttgccatcttgcccagactggtctcaaactcctgggctcaagtgatcctcctgcctcgccctcccaaagtgctgggattacagacatgagccaacacgactggcctctaccctctctttactcctattgggattctaattacacaaacattagaccttttcatagtattctctgtctcttatgctcttttttgcattttctatcattttgtgtggttttttttttttttttttttttgagacagagtctcactctgtcacccaggctggagtgcagtagcactatcttggctcactgcaacccaggtttgcctcccaggttcaacccactctgccttcctggttcaagtgattcttctgcctcagcctcctgagtagctgggattacaggcgcccaccaccgtggctggctaatttgtgtttttagtagagatggggtttcaccatgttgggcaggctggtctcaaactcctgacctcaaatgatctgcctgcctcggcctcccaaagtgctggaattacagtcatgagccaccatgcccagcccatcattttgtagtttatgctttattctggatattttcttctgatctattttccaggtcattaattctctcttcatttctgtgtaatttactattaaacccatctactgagttcttaattctaattattgtatttttttagttcaagtatttttattcagtttttgtttgtttccttgctaaatcttgtctttcatttgcttgaacatagtaaataaagcatggttattacaaagtccataatttattgtctggataccctgtgggtctgtttctgttttctgtcctatccattttttttttactccattatcttatcttgtgttatacttttttttttctctagttgagttatgtaaattgtgtatgagttatgtaaattgaaaaactatacagataatgtgaggcccagaatgatgttatctttcttcggaggggatttatatttgcttttggcagatggcctgggcactagcaatcctggattacctcaatcccatgagggtttgaaaggatttgaatatagatttacatctcagggagggctgattttcagtatagctctgaggagtgccaaaagagctttagggtttaccagagtcccagcccccaacgtgggtgggtcctgaactctattttttttttcttttctttttgagactgagtctcactctgtcgcccaggctggagtgcagtggaatgatcttggctcactgcaacctctgcctcccgggttcaagtgattctcctgcctcagcctcccaagtagctgggattacaggcctgcgccaccatgccaggctaattttttgtttttagtagagacggggtttcaccgtgctggccaggctggtctcgaactcctgacctggtgatctgcccgccttggcctctcaaagtgctgggattacaggtgtgagccaccgcgcccagccaactctgattttttatctgcaagccctaacagtcatttgaaaactcaggaacttaacattaattcaaaattattaactgcttagtgtatcagttgaatcttccagaactggcagaggcccctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtagcagtaaatgttcttggccgaagcaacggaatctgtctctggctatcttaagcaaagagactggagtggaaagatgtgtcagttgcagtagctgcttatggatcagactgttgtggtgagacctttgcctagtttcctgatgctcagcctccaaagctcctttgattcctgtctgtttttcaagtctgatggttcagccacctgtggattttgtgagccactaataatacccttccagcagagcccttttttgcttaagatagtgagacttggtttctgttgcttgcaaccaagaaccctattactgttattaatttttttggtacattcttgagtcatttaggaatgtattagttaccagatgaaactgaattctcataaatgttatttggtagtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgtttaaaaaaaaaaaaaaaattagccaggcttagtggcacacacctatagtcccagctactcagggggctgaggcaagaggattgcttcagcccagtgaactgtgatcatcccactgcactccaacctgggcaacagagtgagactgtgtctccaaaaaaaggaaataaaggagggctttgggatactgaatgactgggagatggaaatctactttcaatagtgtagtcagagaaggcctcactgaggctttctattgccattgctattttagatacttgcttaaagaaagagaggtggtcttttaaaaagtatattcttgattaagataatggagagagaagaggaagaaaaaagggatattacaacctgtagctgtataggggaaaggaagagaaaaaagataggggataggggatagcaaagcaaactttatttgctttgtagatagctgtataggggaaaggaagagaaaaaagaaaaagagaagcttgaactttattatttgctttgtaaataatttgtgaccattgacttccatttcaaggatataataatgataggaattggctggcaggtacgactggattcacgatgggagccctttctttaaattatgccactaggtcttctctgaggtgccttctatataaatcaggattcataatctccctgattttacaggagccaggaactgagtcttcttttctttctatctctcataggaataaaagggggaaatgaacatttttttatactaccgaggtcaggtatccttgggtctaatgttaaacttaaaacagaaatttctgagagagcccttttatcctttgttatttagaaaatacttgaccctcctgtgcccttgctgtattggtgcgagacagaatggttatatatatattttattatataaataataactatatataataatatgttattatataaataataacatatatattttattatataaataacatataatcatatattattatataaataacatatataatcatatagcatatataaccatatgtagttatatataaatggttattatatataacatatataaccatatgtagttatatataaatggttatatatatatatttatttatttattgttgttgttttgttttgttttaagttccagggtacatgtacaggatatgcaggtttgttacatagataaacatgtgtgccatggtgatttgctgcatctctcaacccatcacctaggtattaagcccagcatgcaatagctatttttcctaatattctccctcctgcacccctcctaacagaccccagtgtatgttgttcccatccccatgtccatgttttctcactgttcatctcccacttgtaagtgagaacatgcagtgtttggttttctgtttctgtgttagtttgctgaggataatggcttccagctccatccatgtccctgcaaaggacatgacctcattcctttttatggctgcatagtattctatggtgtatatgtaccacattttctttatgcagtctatcattgatgggcatttgggttgattctatgtctttgctattgtgaatgaacatatgcatgcatgtatctttacaatagaataatttatattcctttgggtgtatacccggtaatgggattgctgagtcaaatggtatttctggttctaggtctttgaggaatcatcacactatcttccacaatggttgaactaatttacattcccaccaacagtgtaaaagtgttcatatttcttcacagccttgccagcatctgttgttttttgactttgtaataatagccaggtgcagtagctcacacccataatcctaacactttgggaggccaaggtgggtggattgtttgagcccaggagtttgagaccagcctgggcaacatgacaaaaccccatctctacaaaaaaatacaacaaaattagccatgcatggcagtgcacacctgtagtcccagctacttggtatggcttgagcccagaaggtcaaggctgcaattagccatgagtatgccattgtactccagcctgagtgacacagtgagacccccatgaaaagaaagagagaaagagaaaaagaaaggaaaaagaaagaaggaaggaaggaagaaaggaaggaaggagagaaagaaagagaaaagaaaggaaggagggaggaagaaagagagaagagaaagaaagagtaaaagagagaaagaaacagaaaagaaagagaaaggaaggaagaaagaaaaaaagaaagaaaaagaaaaaaaaaagagagaaaggaaagaaagaaagcctggcgcggtggctcatgcttgtaatcccagcactttgggagactgaggtgggtggatcaccgatcacctaagttgggaatttgagatcagcctgaccaacgcggaaaaaccccatctctactaaaaatacaaaattagccaggcgtggtggtgcatgactataatcccagctattcgggaggctgaggcaggagaatcacacttggacccgggaggcagaggttgtggtgagcagagatcacaccattgcactccagcctgggcaacgagcgaaactctgtctcaaagaaagagaaagagagagaaagaaagagagagagaaggaaaggaaggaagggagggagggaaggaaggaaggagggagggagggagggaaagagaaagaaattagaaaaagaagagcaatttaaaagttaggggggaaggggatggaaagagtaaagattagagtagaaatcaatgaaatagataccagaaaaacagtagagaaaattagtgaagccaagcaggttctttgagaagataaataaaatcggaaaatcatgagccagactgatcacaacaaaagagagaaaagacacaaattaccaatatcaggaacgagagagatacatcattacagattctataggtattaagagataataaggaaatattatcaattttataccaataaattcaatgacttagaccaaacggacaaagacacaaaggacattcaagaataaatagataacttgaagaaacagaatttgtagttaaaaataatctcacaggctgggcacggtggctcacgcctataatcccagcaatccaaggcagggggatcgcgaggtcaggagactgagaccatcctggccaacatggtgaaaccccgtctctactaaaaaaaaaaaatacaaaaattagccaggcatggtggtgcgcgcctgtaatcccagctactcaggaggctgaggcaggagaatcacttgaactcgggaggaggaggctgcagtgagccaaggtcatgccactgcactccagcctggcaacagagcaagactccgtctcaaaaacaaacaaacaaacaaacaaaaaatatatatatgtatatatgtatatatatcagaaactccaggcccaggtggcttcactggtgaattctaccaagcatattaggaagaaagaacaccagttctacacaaatgcttccagaaaattgaaaagaagtacttctgaactcaatctaggagactagcattattctaatacccaaacaaaacaaagacatttccagaaaagaaaactgcaaaccaatattccttgtcacaaaaattcttaaaattttagtaaattgaatccaacaatatataaaaaccatgtgggatttattccaggaatgcatgtggtggtttcacatttaaaaatcaatgtaaacttaaaaattctggaaaaagaaatgcgtaacccaccatataaaaagaaaaaaaaagatcatttcaataaatagagaaaaagcattttataaaatcgagcattcattcctgattcaaaaaaacaaaaatcaagactgttcatgctgtctctcacctgtaatcccagcactttgggaggctgaagcaggaggattgcttgagccccagaggtggaggttgcagtgagctgagatcatgccactgtactccagcctgggcaatagagccagaccttgcctcaaacaacaacaaagaccacctagcaaagcaggaatagaagggaattttttcaccaagtgaagggcatctacgaaaaacctatcaaacttaatggtgaaagacagaagactttcctgctaaaatcaggaacagggcaacgatttccattctcaccatttttgttcaacattgtcctggaggttctagccagtggataaggcaagaaaacttgaaaaaaaacaagtttgttcacataggacatgattgtctatatagaaaagcctatggaatctacaaaaaacaaaaaacaaaaaacaaaaaaaaaacgctactagaactaataagtgaatttatcaaggctgtatatcaatatataaaaattgtatttttgtattccagcaaagaacaattggaaatttaaattttaaaagcagtgtcatttacaatagcatcaaaaaatacaaaatacttagaaataattctgacaaaaggtttacactgaaaattacaaaacattgctgagaggaattaaagactatagtgactgattaatatatggtaacaaagtatatcagttgtggacaggaggtcacaggcagacaggagggaggaattccaaatagggtcaaaggaaactttgggaggtaatggatatgttcattatcttgattgtggtgatggtttcttgggtatacacatatataaaaacttaccaaattatatgtgtactttttcatttagtactttttttttttttttttttttgagatggagtctcgctctgtcgcccaggctggagtgcagtggcccaatctcggctcactgcaggctccgcctcccaggttcacgccattctcctgcctcagcctcccgagtagctggaactacaggcgcccaccaccacgcctggctaatttttttttttttttgtatttttagtagagatgagttttcaccgtgttagccaggatggtctcgatctcctgatctcatgatctgcccgcctcagcctcttaaagtgctgggattacaggtgtgagccaccatgcccagccactttttcatttaattctatgaatttttttttttttttttttgagatggagtctcactctgttccccaggctggagtgcagtggcgcaatcttggctcactgcaacctccacttcccaggttcaagcggttctcccacctcaatcacccgagtagctgggactacaggtgcatgccaccacgcccagctaatttttgtatttttagtagagatggggtttcaccatattggtcaggctgatcttgaactgctgacctcgtgatcttcccgccttggcctcccaaagtgctgggattacaggcgtgagccacagtgcccgaccagttctatgaatttttaacacatgtatatatacagaacaatttcatcaccacaaaaaactccatactatccctttataatcacaccctcttctgtctcccaacgcaaacccctgacaaccactgatttgttctccatcactatagttttgtcttttcaacaatgtcatatccatggacttatacaatatataaacttttttttttttttttttgagacagagtctcactctgttgcccaggctggggtgcagtggcacgatcttggctcactgaaacctccccttcttgggttcaggcaattctcatgcctcagcctcccaagtagctgggattataagcagacatcaccatgcctggctaatttttgtgttattagtagagatgggatttcaccatgctggccaggctggtctcgaactcctggcctcaagtgatctgcccaccttggcctcccaaagtgttggtattacaggcgtgagccactgtgcccagctttatacagtatataacgttttgagattagcttttttcactctgcataatgctttgagagctttgagattcctccaggttgtggcatgtgtcagtactttgcttctttttattgctgagtagtattgtattgtatatatgtaccacaatttgtttatccattcacccttggaaggatatttgggtttcccccaattggcaattatgaatagagttgctataaatactcatgtactcatttctgtgtgaacatacattttcttttctctgaattgtgtacccaagaataagattgctcactcaatcacatggtatgtttagctttttttttttttttttttttttttgagatggagtcttactctgtcacccaggctggaatgcagtggtgcaatgttggctcactgcaacctctgctgcctgggttcaagtgattctcctgcatcagcctcctgagtacctgggattacaggcacctgccactgcgcctggctaatttttgtagttttagtagttacggggtttcaccatcttggccaggctggtcttgaactcctgacctcgtgatccacctgcctctgcctcccaaagtgctgggattacaggcatgagccactacgcccagccatgtttagctttttaagaaaatgccacagtgttgtccagagtggctgtaccagttagtatttctaccagcaatatatgaatgattgggttgttctatatccttgtcagcacttggcactgtcagtatttttaattttaactattctaataggtatctcattgtggtcttgatttgcatttctcaagtggctaatgatgttgaaaaacttcttatttgccattcacatatcctctttggtgaagtgtctgttcaaacttttgcccatttttaaattgggttgtttgttttcctactattgagttttgagagttgtttatatattctggatacaagtcctttgtaatctgcaaatattttctactagcatttagcttgtattttcattctcttctcagtgttatatacagagcaaaagtttattttttttttttgagacggagttttgctcttgttgcccaagctggaatgcaatggtgcaatctcagctcactacaacctctgcctcccaggttcaagcaattcttgttcctcagcctccctagtagctgggattacaggcgtgagccatcatgcctgcctaatttttttgtatttttagtagagacggggtttcaccatgttggccaggctggtttcaaactcctggcctcatgtaatctgctcgcctcggccttaccaaagtgctaggattatagacatgagccaccgcacctggcctggaatgtcctttaaatttctttcaagaactttttctttgcattcacaacttggctaactgttttgtgtaagaggcctagctttcggcctatcttggcttttgacatgctctcttcactaagcttaataatttctagcttttaatttaaagtaagagactcttcctttcacttgaacacttagaggccattgtagggttattagttgacctaatttcaataccattgtagctcagggaatagagagcaccaaggaaagagagggagaaagaggaatggctggtcggtggaggagtcagaacataacgacatttattgattaagttcaccctcctatatggatgtggtttgtggcaccccaaaataattacaataataacatcaaagatcagtgatcacagaccatgataacagatatacaaataatgaaaaagtttgaaatattgtgagaattaccaaaatgtgaagcagagatatgaagtgagcacatgctgttggcacccatagacttgcttgacacagaattaccaaaatccttcaattttcaaaaaatgcaatatctacaaagtacaataaaatgaagcataataaaacaaggtatgcctgtaaatggtgcactacacatgctattctgtataatgaatttttttctgaatacataggctatatatattttaagattattaaataatatgacatttaaacatagccaatcatataagcaaagttgttcagctgtttctcacacctgaaagtgccccccacaccaaataaaacatttttagattatgtgtcccaatttggacttctgaaagtatggtcaccatatgccaaggcatgaaggcattaactggggaatgagtatggagtttgatgcctttcatctcctttgctcatctgtccctatccacatgatggctgcatttgaaatgaaataaagtctacatactggagaatagtttataaatcaatattttatgaaaacagttatatctaataattttttataaaataatgtatttatttgagtcttaagcttagtgatgtaattaaaagcctatttggttttttcttaggaatccaaatcctctctttaatatttaaaccctttaatttgctaaagataagttttgtgccctgttgaccacctaatggaacaagcaagtgttgaagatctcttgtggttttttttttagttgcaaattctaccaagctaacccatttattgcagtggataggagctggagagctgttcattcggcaataataggcaaagggtggtggagggaagaaaactatctttccaatatttttgcttaggaatttggggattcagaatttagtcataaacaactagattaatgtgtttaaatactttgaatcagttctaaatcattccttgttttgtaacatacaagatcttagagataactaaaacagtggttgaaaaattctgttgtggattgaagatcctccagaagcataattcactaataggcacagtgtttggggtgatgggtaaacaaacatctgtgtcctgtggttgcctctctgcataggaggagatatatagttttcaggcaagagatttctttggagagtccactgtctctgttttgcaagttatttatttatttttaatcccagagataacgaaaccatgtagtggcagtagatggtattattcatcaggagtttaggatgttaccatgttaggccatttaaaataagacagaaaggattactttttgccagctgcatcatttctggcaagagcttactactttgcttattgcggtcattgttgtggttgttgttaacccatcagagaaactaaccactacattggttttagccaaatccttgtcatcattggccttacattcttttggggaccaaagagcacctggtcattctgaaagcttccatccccagtgattgatgctcatctctgcaggctcctgcaggctctctcaagcttgcctcccatttttcctgaagcacctttaagcatttctgcatggctactcactctcttctattatacctcctcctcctgccttactgaatgctgaatttcccagctcacaactctaagaaggagctttatttcagagtagaaaggggcccccatatgtggcctattatatccatatcaacttgcttacccttttcaaacagctattgtcttttaatagggtcctgcctggcagggggagtccttaattcctgccatataagaatgggcagcttgagttacagctagctgcagtttggtgctctgatcaaaaggcctctgttgttttttagggtttttccccctccttctctctctctttctatatcctgtgctaataattcagcacagcaaggtcattacaggctttgaattgggagctgagagtgttaaattactgacctagaataaaagagatctggggggctctcaagaaagataaagtgattccggctagtaaaatgcaagcccagcaacctcacttcttaacaatattattattttttaatcccctctgtctctaaaagtcttttctgggacaaggagagatcccctgccagagaattaggttagaaacccaatgacatcttctgagagttgtggcccaggtgctggcagcttatgggcgcctgtgcagttgtcctttttgtctccctaccttgtcaatatttcactctgttctaccttggtctctcagccacatatatggtttttttttttttttatcacgtaagtcatatatgtttatgacatttcagctgaaaggtaatatcccatgaagggatttcagacatgtggaaagcataccacttagcccccaaaatatcttaaacatgacatcatcttattaaaagccactttcattccatttatgttttgtaaataatattagtctggtcctcccatactttaacaaaaaaaaagtcccattgtaaatgaatttgatgtctccactctattctacattgtatcttctgaagaaagtcatttccatttcttcatactattttctttcatatctttcatatgtccttttttttttttttttttttttttttttggagacagagtcttgccctgtcacccagactggagtacagtggtgtgatctcggttcactgcaacctctgcctcctgggttcaggagattctcctgcctcagcctcccaagtagctgggactacaggcgtgcgccaccacacctggctaatttttggatttttagtagaggcagggtttcaccatgttggccaggctggtctcaaactcctgacctcaggtgatccgcctgccttggcctcccaaagtgctgggattatagatgtgagccactgcacccagccactacagttatctcttaaagccatacactatccatatcctctggaaaatattgattttctaagactaatatttttagaaaagttcctaaaatcaactttcacagattttctgcacagcagagtaataataataagatagtccccgaatgtgccaagcattttacagaatgcattattaacacatttaacctttggcaaccttatgtaataagcattcctgtaatcactagtttacagagaaaaataattgcaatacaaagtcatacagccaggaagatttgtcccagactagtgcttcttgaactttttcatgtttgtgtgaatcacctagggatcttgttaaaatgcagaatcagattttgtaggtctgggttggggcctcagattctgatttttaacaggcttctaagtgatgctagtgctgctgtccttggttcacattttcagtagcaaagccatagtcattttttcttgagaactactcaaaaagtttttggttataacttccagtttttcattccatcaggcaattctatgaatatacatagtggatatttcacacctatatcttactttttaaaaaatatgataaaacatagcacttaacccacaaaatatcttaaatgttagaaaatatttaagatattttgcctcctattggccctgcagaagctggacctcctgaactgtgtgacctacttcagtggtacctcaggttctacatggtgagtatcctggggactggaagagtggagatgatcagggcccataggggacctggttaaaattgactattttaactatttttaagtgtacagttctgtggcattaaatacattcacattgttctgcaaccatcactgtcatccacctccataacttttctatcttcctaaactaaaactctgtactcactaaatactgacttgccaacttcccattccttctgaccccctagctcctggcaatcaccatgctactttctgtatctaggaatttgactactctaggtacctcaagtaagtgaactcatacaatatttgtcttttttgattggtttatttcatttagagtaaggtcttcaaagttcattcatgttgtaccatgtatcagatttccttccttcttaagactgaataatagtccgttgtatgtatgtatcacattttgcttatctgtcattagacactagggtggcttccaccttttgactgttgtgagtaatattgctgtgaacatgggtgtatatatcatatatttgtccaagtccctgctttcatttcttttgactatatacccagaagtggaattactgaattatatggtaattccaccaatatcttactttctaagaaaccagtttatgtttaagttattgtgttccttttttttttttctaagtgagacagggtctcactttgttacccaggctggagtgctggaatgcagtggcatgaacatagctcactggccttgacctcttgggctcaagagatcctcttgcctcagtctcccaagtagctgagaccacaggtgtgtgccatcacacctggcaaatgtttaaagatatttttcatagagacgggacctcaccatgttacccaggctggtctcaaactcctgggctcaagcaatcctcttgccttatagcctcccaaagtgctgggattacaagtgtgagccacttcacccaatcttctctctctctttttttttttttaaacattccttacataaagtaaatctttaaaggtttggcaggaagagtgagttttcagtacagattttcattaaagtctattgtctgtagctactttgtaattttcaatcaatcacaaaagaatattgagaaatgtcctttgatccttagaaggttggtaattggttaaatggcaccaagtagagaattagagagagagtgctcatgttctgaaataaaccaatactaagaaggtttatatcacagagaaagttttatataaatgaatttaagacctcacctgacaaacaggtagtcaaggaacaggtgaaccccttgttaaatttatgctctcctttaaagattttctggaacaactatcccaggatcttcaaaaattttgtggtacctctttctctgtggtctttaataatacattaaattctcgtttgtttataagagtttggtgcaagattctgcctgctacctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctgtggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaacccccttcaattttattattttgaattataatcaagtccaaggagacttggcctattattaacaactttgtatgaagtatttttttcaaccaaattcatatcatcttgaataagaacaaaggattatggtttgagaattattatacttgctggactttgaaccaacagagttgatatatttaatacttccacttcttagatgaggtggtactgaggaaggggtttgtaacatctaagggggcccataaaaatagtgtttagttttcagtgaaatctacaggtgatgctaaaatgggaacatttttaaagggatcctagtgagaacaaaaagacaacaaaaaagaacctaaaggctatagctgcaggcagaaaatagaataaaatttaccttaaaatgttgtctagtgcaatgccaagcatagatatacagtggatgagcaaaatcttgtaagaaattagaattgagtttaaaaagttataaaagaaaacagacaagaaattagatgaaactatggtatgtgatctggcagtaaaacagacaaaagctgttttaaggtctggagatagagaggaggggaaggaatggcaggatctgcagatgactgagggaggcctcacctgtgactaaactcagcttcagtagcagaagaaaatagtacagacagggtgaaccagttgacaaaagagatacagaggttggaacatagagctgaagagaaagaaataacagatgacaggtttagaaaccacataaagaatgtgagatgtaatatgtagcagaaggtgagatgtaacagaaatactgtaaagagaaacagtctgtccagaaactcttcctaggggataaggctaggggatatttccccagagaaaccatgaaaacacaattattctggatttcaagtgaaattaggcaagctcctggaagctctgttataaagagctctgcttagaggccttgttgaaagaactgaaggatcttgtaggaacaagacaaattagagatttacggtaattgttgttatttttttttaattgacataacattacacaatatttggaagacaggaagaaatcaataataagccaaaaccctaatccagtgaataaatacaattcatatcttttaaatttttaatcactttccttattcagacctactttaaagtagctaaaattggctgggcacggtggctcatgcctgtaatcccagctctttgggaggccgaggtgggtggatcacttgaggccaggagttcaagaccagcctggccaacctggcgaaaccccatctctactaaaaatacaaaaattagctggccatagtagcatatgcctgtagtcccagctactcgggtggctgaggcatgagaatcacttgaactcaggaggcagaggttgcaataagttgagatcgcagcaccacactccagcctggatgacagaggaagaccctgtctcaaaaaaacaaaacataaataaatgaagtagctaaaattatcatgtacacacaattttgtttccttttttgtttgtttgtttcttcttttattctcagtaccttcctcaggatcctccttaaatataacatatgaatcatgtttttataatttaaatttctaacatgctataaagagtatgtatgtgtgcagtaaccttttcccagtgctcggcgcattgattttccatcctgtatttccctgtttctactggcctggagtaaccagccttataaaaaaagatattccttcatacttaaagctgcaaggggtaagcagatgtgaattaatcatcttatatcagccggtaagaagctgatgtgttagggatggcacctgcgagtttaccatagcatgccaggccttcaggaatgagttttgaagtttgagggcttcaaaggggagtttgaaacattttaaaaccctgacagggttttacctgaattatatgcaaagatccaatggggggaagagtttacttcagagaagcagcaactgaaaaccaggtcctttgcgtagccttcctggaaagaaccgtctttcttccttagcagcagcccccagggtaggaccagtgctctatttcacggctattttaagaaagttctttatggatttgggtaacagaaaagcacttggtgaagtgatcaaggaaagaaactaactctgctactgaggattacttaggcagaaaaaaaatcttgttatgaaacaccaatgtttaagtccttagagtgaactgataagctgatttggggcttttttgctgttgcagaaattataaatcctatccactacaatggcagctcagttctcacagatgggttcacctatccttagacagtaacttaagattgatagtccctgttggatttcttcctaaattgttttttaaagaagccaaagatcttggattctaattctaatggagccactgctgacaagaagaagatgaagaagattgttagtgctcacttgcagtgtggcacatctctattttcttttttttttcttttttttttttttgagacggagtcttgctctgttgcccaggctggagtgcagtggcacgatctcggctcactgcaagctccacctcctgggttcacgccattctcctgcctcagcctcccaagtagctgggactacaggcgcccgccaccatgcctggctaattttttgtatttttagtagagacggggtttcaccatgttagccatgatggtctcgatctcccgaccttgtgatccgcccgcctcggcctcccaaagtgctgggattacaggcgtgagccatcacgcccggccacatctctattttctatagcatttacaattatttctttgtagccaacagaaaagttgcactcaatgaacctatcaattcatgatgcatatccgtggggagaagctcattccgaatacatcatatgttaaatttatccttggattcaggatcatattgttcacttactttttcctgtagtcagcatgttgtaattttgaacaatagaataatagataacaacagcctactagagaattagaaatactgtagttctaagaactgtagtaattagaaatactgtagttctaagaactgtagttcttagaaatactgcattcaacttttgtaaagaaacttttttgtatcactatataagaaagaagctggtgtgtaaggcaacttctgtgcaaatatgttgtctaaactgctttggggttctgtaacatagactagctgacttgcctcactgatttctcttatcaagttagcattgccaaattctatagctgataggcaatgggaagaaaacatttcagggctttaggcttcctctgaatttcacaaggaaacaaagaacaaatccagggattgttaggtcaggagacaaaatcatgccataggaatatatatctttttttttcttctttttttttgagacaaggtctggctgtgtcatccaggctggagtgcagtgatgtaatcttggctcactgtaacctctccctcccgggctcaagccgtcttcccatctcagcctcccaagtagctgggactacaggcgcaggccaccatgcccagctaattttcatattttttttttttggtagagacgggatttcactatgttgcccaagctgatctcaaactcctaggcacaagcaattcatctgcctcgggctcccaaaatgctgggattacaagtgtgagccactgcacccagccacagaaatatatctttagagcctggtgactttgtgcaaaacaaaactgcagttagccaacctgttagtggaaaatatgccccaaaagtcttctcctcccagcttgcccctttccaactcagaatatattttttccttctgtttatagaagcaacacaaggttactttaaatcataattttggccaggcatggtggctcactcctgtaatcccagcactttgggaggctgaggtgggcagatcacctgaggtcaggagtttgagaccagtctagccaacatggtgaaaccccgtctctactaaaaatacaaaaaaattagccgggcatggtggtgggcacctgtagtcccagctacttaagaagctgaggcagcagaatctcttgaacctgagaggtggaagttgcagtgagccaagatacaagattgtgccactgcgctccagcctgggcgacagagtgagactctatctcaaaaaaaaaaaaaaatcataatttcataatttttcccaagatgttttggatctttggtcttatatattctgtggaggccaattcatatgctgtgtttgaatcaccttagtgtggccagtttgtgctgcatagttggatgtgatctgctctcctgttttacttcttggcagatatatttaggattccttgaaaaaaaaaaaggctgggcacagtggctcacacctataatcctagcactttgggaggccaaaacaggaggatcgcttgagcccaggagttcaagaccagcctgggcaacatagtgaggcctcgtctctactggaaaaaaaaaaaaaaagaaagaaaggaagaaagaaagaaaattagccgggcatggtggtgcacacctgtagtcccagctacacaggcggctgaggcaggaggattgcttgaaactaggaatttgaagctgcagtgagctatgatcgtactactgtactccagccttggtaacagaataagaccctgcctcaaaacaaaacaaaacaaaacaaaaaaaacctatcagaagacaagttcaattccaattctaacagaagataatccactctaatgagctggcctggttttagaaagaaaaaaaggagacaggagaatggcctaggaagactcaactgccatcatccagttaaacagtgcaggtcaagattcactggccgttttcagtttgagtgagaacaaggagcacctggaggacatagagtgctgttggagttttgaagttttgcctctttgcacattaagaatgagctggaatattttaatttggtcctcttgcccatgtctttattacttctatatgtggaatgtgaatagctatttatatatagatccagtatggttacagttatttatttatttacttatttatttttaacttttaagttcaggggtacttgtgcaggtttgttacataggtaaacttgtgttgtgggggtttgtggtacagattatttcatcactcaggtattaagcctagtacccattagttgttttccctgatcttttccctcttcccatcctccaccctccaataggccccagtgtgtgttgttcccctctatgcatccgtgtgttctcatcatttagctcccacttataagtgagaacatgcagaatttggctttctcttcctgcattagtttgctaaggataatggcctccagctacatgaatgttcctgcagaggacatgatctcattcttttctatggctgcagactattccatagtgtgtatgtaccacattttcttcatcccgtctatcactgatgggacagtgtgaggaatcctcaaagatctaaagtcagaaataccattcgacccagcaatcccattactgagtatatacccaaaggaatataaatcattctattataaagatgtgtggttacatttatatttaattctttcttggtagtccctgagctattgcccacttcaccagaataatttaaatcaattcttgctttttgctagttaatagccaaaattaagatgtttatgtggaattgacatcatacataaattcttagaatttgtatctagtttttcaggagaaaatagataccacttaatagaattctgtatgactttttctgtgcaaacagcgtttgttactagaagagaacatgaaattgtatcaagaactcccattagcttaacatgtttacaaatgtctgattataaaattattaatttttaacacagctcctgctgtgttttcttaatatattactggagaaaactgccctagagctgggcatggtggctcacgtctgtaatcccaatgctttgagatgctgaggtgggaggattgctttagctcaggagtttgagaccagcctgggcaacataacgagactctgtctttacaaaaaataaaataaacaaaattagccaggcatggtagcgcatgtctgagtcccagctacttgggaggctgaggcagggggatcgcttcagcccaggagtttgaggctacagtgagctatgatcgtgccactgcactccagcctgagcaacagagaaaaaccccatctctttttttttttttttttttaaaagagatctcttaaaaaaaaattgccctgaagttaaatattgtattagggttctctagagggatggaactaatggaatagatttatatatataaaggggagtttactaagtattaactcacacaatcacaaggtcccacaataggccatctgcaagctgaggagcaaggatagccagtaaactgaagaacttggagtccaatgttttagggcaggaagcatccagcatgggagaaagatgtagcctggaagggtaggccagtctctcttttcacatttttctgcctgcattttattctagctggctagactggcagctaattagattgtgctcactcagattaagggtaggtctgcctttcccagcccaccgactcaaagttaatctcctttggcaacaccctcaccgacacacccaggatcaatactttgtatccttcaatcagtttgacactcaatattaacatgacaaatattaagctaataaaataggaaaactatggaatttattttattgtcaaaactaaattaagagagatttgtactcagcccatttcattttttttactttagaattttttaatttccagtgaaaccaaattttactactgttgtgaacacagccttcacatttgatgcaaatgggagggcttaattataatcacttagtgacagtattgtagacaaagccaatagtgtatggcacatagatgattatatcttctggagagagttgactttacaattaatacaaacatatttgactaaagaaaatggaagcatcttcagaccatttcatcttaattatatcttgtaaggttaaaaatatataactcacaaataaattttaatttaaaaaatttttttaactttcatgtcacagccaagtccaaaaaattttaattttgatgtttctggttctcttgtggctagataatccatagagatttcctgaacttcttattcatgatagcttaaaaagaaacattcagatccctgtgaattggacaaaaggatatctattttatgctactttttgtagcataaggaagaagaggaaataaaaacacaatgggcccttgaacaacatgagggttacaggtgccgacctctcctcttcacttagtctaaaatccacatataattttggactcaccaagaacttaactactgatagtctactattgaccttaccaatagcattaaaacagttgattaacacataccttgtatatgtattttatactgtattcctacaacaaagtaagctagagaaaagaaaatgttattaagaaaatcaaaaggaaaatatatttactattcattaagttaaagtggatcatgataaagacctccatctttttcttcttgatgttaagtggctgaggaagagaaagaggaggaggagttggtcttgctgtcttaagcgtggcagggaagaagaggtggagattgtagaaggggaggcaggcacactcggtgtagctttatgaaaacacatggtgatttctgattttttttgccttttcatgtctttaaaaatgtttctatatggtaccaatttttcttccatttgctttagtttcagtgcctgtatcactgaagagttcatgtcataaaagaagtcaaaagcagtcttgaatagttggaactcttctgccagatggtctaatgtcagtttgttttctggccctgcttctgtgtcttcttccccttctattccttcttttctggcactggttcagaagcactcaccttcatcaagttgtcttctgttaattcctctggtgtgatgtctgttagctcttgaatttctccaagatccatatcttgggacccttcccccaccttctttgccatatccacaatctctttcatgatctccttgattggctctgtcgtaaatcctgtgaagtcatgcacaacatctggatgcagttttctccagcaggaatctattgtttggggctcaatggctttttccataacaacagtggcatcttcaatggtgtaatcctcccagactttcttgatgttctatcaggattctcttccatagcgttgacagtcctttccaacagagtactatgtgtaatgggccttaaaggtccttataaccccctgacttaggggctgaattagaaacattgtgtttgggggcaagtattacagaccattttgatacctttggtgttgaactcatgggttctgggtggccagggacattgtccaattcaaaagaactttaaaaggcagtccatgttggtgtgctgcacccattaattcatcatttacgttaggtatatctcctaacatggcacatgtatagatatgtaacaaacctgcacgttgtgcgcatgtaccctagaacttaaagtataataaaaatatatatatataaaaataaaaaaataaaaataaaaggcagtccattaccagcaaggtacatcctgacttcaggaagaatgttgatgaaacccagtccagaaaaaatggttctcattatccagggcttcttgtacaacacccaaaactggcaactggtatttatcttttcccttcaaagctcaggggttaccagctttatagataagggcagtcctaatcataaacctgactgtgtttgcacaaaatagtagagttagcccatcccttcctgccctaaatcctggtgcttgcatctcttccttactaataagtgtcctttgtggcatttttccccttagcatctgcattaaaaaactgctcaggaagatatcctttttcctcaatgatttttaaaagcttctttttttttttttttagagcagggtctcactgtgttgcccaggctggagtccagtggcatgattataattcacaccacctcgaattcctgtgctcgagtgagtttcatgcttcagcctctttagtagctgggactacaggcttgtgccaccacagtcggctaatttttatttttggtagagatggggtttttccatgttgcccaagctggtttcaaactcctgggctcaagcaatcctcccacctcagccttccaaagtgctgggattacaggcatgagccactgcacctggttgcctcaataattttcttaatggcatctggaaacttgtttgctgcctcttggttggcagatgctacttcccctgatatcctgatattttttaagccaaaactttttctaaaattatcaaaccatcctttactggcattaaattctccagctttagacccttcacctttcttctgctttaagttgtcatataatgacttcactttttctcagatcatattagggtcatatgcctttcttatagaaatcctgcactcctataaaagctgtgttttcaagacaagttaaaaaagtatttcaccaaaagtgcaatgtttttatgcctgctgatgtagctgcagcaactgcttcatgaatttcctttgtttataattgtccttaccttagattcatttatcttgaaatgaaggccaaaccacagctgcagatctcaatctatgatgtatgtcaagcaattcaactttatcttgtaacgtcatgaattttctctgtttcttgggagcacttccggcatcactagtgacacttcgtatgggtccgatagtgttatttgaggtttatggttttgtactgaacacgatgaaaaatacatgagaaccatgagagatcactttttactgtgatacacaatttactggagaaatgaactgcccatgcagagatgattagcatcacatggtgttttaagcagatacttgcaacacttgtgctcactgcaatagcaacaggagttggctatgaatgaaattattatagtagtacagtatgagctacagttaattttatacagttatgatttaatactgtatgtttgcttacatttctctccactatgaatggcaccatgtatggtctgtgtgtgtgtcagttttgctaaatgttaactttttataacagatttgtgtatattttaatgtagtaaatgataaaatggactagtgtctacatattttatgcattcaggacatacttttaaaaatttttccaatatgtgtaggatgcacagttggtctgtgagttttttttaaattgctgaaatccctccaaaatttctaatatatttattgaaaaaaaatccatgtataagtagacccacacagttcaaatccatgctgttcaaaggtcaactgtatatacatgtatctgctcatctgagaaaaaaatatgcacacaggaagaataaaccagagatgaatgagattcattatctctaagatgttagtgaaatggagtgaaaagatatatatatatatatatatattatatatatataatatataaattatatatattatattatatattatatattatatataatgtatattataatatacaatataatatataatatattatatataatgcatattataatatataaatatatatttatattatatattatatattatattaatatataatatatataatatattatatttatatattatatattatataatatatatattatatattatatttatatattcaacaagattgggggagactctaaaattgaaaacaaacaagtgaagcaaattgtatttcaaatgaataatataccgtactgcagggggttggagaaactaatctaaggaacataatatttggactatataccctcaggctaaaacaactctaaacaagtattaaactctaattagtaggcttctttttcacagaggaatgggttagctagctcagtacattttaggattaagcaaataagtaaatatgttatagataataggagcctttttctcactttagaaaaaggacatttcagatatggaaagggaagatgatagaatgtaacctgtagtgttgaactggaattgaatcagtgtgagctcatagatttgttttgttttgttttgttttgttttgtttgagacgcagtctcttctctgtcacccaggctggagtgcagtggcacaaccttggctcactgcaacctctgcctcccgggttcaatcaattctcctccctcagcctcccgagtagctgggattacaggcgagtgccaccacgcccagctaattttttttatttttcttagaggggtggagttttgccatgttggccaggctggtctcgaactcctgacctctggtgatccgcccacctcggcctcccaaagtgctgggattacaggagtgagccaccacgcccagcctattctttactaaaaacaactgggcttcttggataaatggctggctccagggtgaagtagggaaagaacaagatgatcctggaacatcttattctatcaaaaaaggaaggaagtgatcagagaattatgtagatgtgtcaaaaggacatagaagtcagcttgaagggcttccatggcaaaatatgggatcatttgaacataaaaatatataatgatagtaaaggattataacctattgaataaagaatccatgagtccacaatgatataaataaataagaagggaaagctcttccttattgtagaaggtcgacttaaaaacgtagatgaaacgacgtagttggaaaaagatcaccatttggcaaaaccttcatattcattgttggttctggcaacaattattattattattattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtgcagaacaaaatgaaaagtctcccacgtctacctctttctacacagacacggcaaccatccgatttctcaatcttttccccacccttcccccctttctattccacaaaaccgccattgtcatcatggccccttctcaatgagctgttgggtacacctcccagatggggtggtggccgggcagaggggctcctcacttcccagtaggggcggccgggcagagggctgaccccccccacctccctcctggacggggcggctggccgggcagaggggctcctcacttcccagtaggggcggccgggcagaggcgcccctcacctcccggatggggcggctggccgggcggggggctgacccccccacctccctcccggatggggcggctggcccgggcggggggcggacccccccacctccctcccagacggggcggctggccgggcagagggactcctcacttcccagtaggggcggccggccagaggcgcccctcacttcccggatggggcggctggccgggcggggggctgacccccccacctccctcccggacggggcggctggccgggcggggggctgaccccccacctccctcctggacggagtggctggccggacagaggggctcctcacttcccagtaggggcggccgggcagaggcgcccctcacctcccggatggggcggctggccgggcggggggctgacccccccacctccctcccggacggggcggccggccaggcagaggggctcctcacttcccagtaggggcggccgggcagaggcgcccctcacctcccggacggggcggctggccgggcggggggctgatccccccacctccctcccggactgggaggctggccgggcgggggtctgacccccccacctctctcccggacggggtggctggccgggcggggggctgacccccccacctccctgccggacgaggtggctcccgggcagagacgctcctcacttcccagacggggtggctgctgggcggaggggctcctcacttctcagatggggcggttgccgggcggaggggctcctcacttctcagacggggcggttgccaggcagagggtctcctcacttctcagacggggcggctgggcagagacgctcctcacatcccggacggggcggcagggcagaggtgctccccacatctcagaggatgggccgccgggcagagacgctcctcacttcccagatgggatggcggccgggaagaggcgctcctcacttcctagatgggatggcggccgggcagagacgctcctcactttccagactgggcagccaggcagagacgctcctcacttcccagacggggtggcggccgggcagaggctgcaatctcggcactttgggaggccaaggcaggctgctgggaggtgaaggttgtagcgagccgaggtcacgccactgcactccagcctgggcaccattgagcacggagtgaatgagactccgtctgcaatcccggcacctcaggatgccgaggctggcggatcactcgcggttaggagctggagaccagcccagccaacacagcgaaaccccgtctccaccaaaaaaatacgaaaaccagtcaggcgtggcggcgcgcgcccaggcagttggcaggctgaggcaggagaatcaggcagcagtaccgtccagcttcagctccgcatcagagggagaccgtggagagagggagagggagaccgtggggagagggagagggagagggagctctggtactttcttatagccacacgaacagataaagactgtacctatctgttggctgggcgcagtggctcacgtctgtaatcccagcacttcgggaggcttagacaagcggatcacgaggtcaggagatcgagaccatcctggctaacatgatgaaaccccgtctctactaaaaatacaaaaaatttagctgggcgcggtggcgggcgcctgtagtcccagctactcaggaggctgaggcacgagaatggcatgaacccgggaggcggagcttgcagtgagccgagatcgtgccactgcagtccgtcctgggcgaaagagcgagactccgtctcaaaaaaacaaacaaacaagaggtccagagtgtgacaacatggccttgcaaccttgtgctcagggaccctggaggcagtccttcataggtctgctggaactcgccaacaattattaatagatactaaaatttgtgaatgaaagtttgaagagtaactatatatttccacagactcaaaatgtcttcccacaggatacttatccattacaaaggctaactttatagtggcaaaacctggcagatgctgctctaactaaagaatcaaagttaacatccccagtaattagactaatcagcaagtgcccccagatgtgatgcactgagaggaactcagcatcacctttgtgataatcctgccaaaggggcataacctgaattgaattatgagggggcatcagacacacccaaattcaagaacattctacaaagtaacctgtacaacaggttttcaaataactttgtttcatttaacatcattttcattgtaactattttgtggtttaagatcattttatgaagagcaagaggcagggagagatggcagggaggacaactagagcacttctacacccaccaggagaatagactccctccctgcttcctgttgtgctggacccctattgacttcagtagggatggcaccatgtttgcgaggctgaaaaagagacatggagccagcaaatgaaacataaggttttttgaggggatttacatacagggcagtccaggggcagcatgctgaacaggagaactgctaccacttataaaaaagcatgcagtttatacagcattttcacttagcccctcgaccccggcaatctccacctggcaaccttcatccaacccaaaacaaagggcctcgaacccctgtatggcctgtgatccatgggatggatcagatggttcagatgttcctcatagataaagaatgaatctctgggttggccattcccaaattccttcactcagaactctgaacacacattcatcttagaccacagggtcattctcagggtatgcttcaattatttatgacaggtgcatctaccatacacctgctccccaagtggctcccttgtactatggcagcggtggtggggagggatttgtgtaaactctgccctggagggtggggaaggtgaaggttggatgtaaaatggcagcagctggggctggcagtggtgctgctgggtgctacagggcttgtagggttccataaagagggctgagaaggtgttgactttgtctgccccctgcacctcatggggaaacagtggcagtttcacagtgcaaaagtctttataagtgttctccgtctggttcagatacttggcctggatcttgtgtcaggcctcacatatctttcaggattttcagggttggggaagagaagctgggtgatgatgatgttgtatgtgtcaatcttgtacttggccagctcctggatcagtcactctgtctcatacagggatagaactcagggatatattcgcagatgatacaggtaatctactcagggcccttgaactgtttgctgacaaagtagatgatggacagtgtctacttcagcatggaggacagcacgtctgtgttcatgtccccaagacctagaacgttgcatgtctgtaagataaaggggctgatctggttcttgatctgctgagtgtcatgtcaaccaccaccactgagaagttcatgcccttcaccagcctcatgacctcagcatagctcatggcctcattgatgccgggaaaggcgctcatggcttcctgcatcaacttcttgctcatgctcagcatgttttccttctcaaagaactcactgggcagctatgctgcaccctggctggggtcaatttccacagtgaagaggttgtcagagcctttgaccttggtaggcacctttgagaacttctggtcaaaaccatctgagatgttgtgggctaggtctgtggagatgatcagaatactttcatgcccttttgatagctggatggccaggctgcaactgcaagtggtctttcccatgccacctttgcgccagcaaggatccacttaacttaaggctgcatttctcaatgatgttgctaaacctaggctccagtggctcttggaggctgactttgggagactgaggtggaaggatcacttgaagccaggagtttgagatcggcctggaagtgagaccccatctctacaaaaaaaaatttttttaaatagacaagcatgattgtgtgtgcttgtagtcccagctactcaggaggctgaggtgggaggatcacttgagctcaggagttcaaggctacagtgagctatgattgcatcactgcattccagcctgggcaacagagcaagtccctgtccaaaaaaataaaaaataaaataaagaaagagaggaaggaaggaaggatggatggatggaagaaagatttcattatttttagggaatatttttaggaattccttatttcctaatttttatttatcttgctcagcactttgacttctgttttttttttttttttgaaatactgtaggagtaaacaagcgtcacgtctataacttactcttaaatagttccaaaaaatgataatatgtatatacatatgtacttatatgtctgtgtgtgtgtgtgagagagagagagagaaaagagagtgagtgagagtaaatgtagcaaaatattcacatttgagtaatccaggtaaaggatattcaggaattctttgtgctattataactttttggtaaatttgaaattacaatatgtcaaaatttttaaaaattaaaatcttcaaggaaaaacttcaacaacttaaagaataaaaaaaattgctcaatgaaatttgaatactcgttttggcaaaatctgtttatggcagacatatggtgtacttctgtatggcctttaagatatttttaggaacttttttgttttactttagaggaaagattaatgtctattaaagaactttgtagtttagtcaaatacaatgaaaaattagtgcaaatatgcatttttaagcttggtaggtcaaatgtttgttttggatttctggtcatgatggcttgcagtgttcatgacttgggcctcttattcatttcatacacatggtaatgatacataaaattttctaagatttttaaggacatagccatgtataaaattaatataaattcatctgactaggaactcactaaaccacaatgcagtaagtgggactgtaaccacatgcctcctgtgctctggattcagaaggcgtaggtaactgaaagctcatttcttgaatggtggagactcaaaatgttatacacacagtgcaggagactggagctagccccttttgcctccaccactttaagaaagactcaaaaaaagttatgactgctacctgagaaatggcttacataaaacctggaggtttagccaggtgcggtggtgcacacctgtagccccagctgtttggaaagctgaggcaggagaatcccttgagccaggagtttgagaccagcctgggcaacatagtgagaccccgtctattaaaaaaacaaaaaccttgaggtgtgggaggaagcagacagccttacagccaggtcttagtggtccaacctccttaggggtacagtgacaatctgtatgatatccctaatatcaggaatggagccataagccatccaatacaagacctggttctggactagggtctgtccacaagagagagtagaaacctcccacttcacatgaacttatacgctgaaattctaaaatacatgaggaacactgatgttgagaaagatagtcaataaacccaataaacataaatttactccagagaaaacaaaaatagttgaacatttaaaactgactttgaggccaggttgaggtggctcacacctgtaatcctggcattttcagaggccaaagtgggtggatcacttgagcccaggagtttgagaccagcctgggcaacatggcgaaaccctgtctctacaatcctgtctctagatataaaaaggcatggtggcatgcgcctgtagattcagctacttgggaggcacttattatctttaaattattcattctctattctgtctggtcagcctgaataatgcaggttctacaatgtatctaccatgtaggtttatttttatttatttatttatttttgagatggagtctcgctctgtcacccaggctggagtgtagtggcgtgatctcggctcactgcaacctctgcctcccaggttcaaccaattctcctgcctcagcctcccaagtagctgggattacaggcatgcaccatcacgcctggctaatttttttgtgtttttagtagagacagggtttcaccatattggccaggctggtcacaaattcctgaccttgtgacccacccgcctcgacctcccaaaatgctgggattacaggtgtgagccaccgctcctggacagtttatttttatttatcttactcagcactttgacttctgttttgttttttgttgttgttgttagttctggaaaattctcagccaatatatatacatgtgtatttcttgagataggatctcacattattgcccaggctggagcgcagtcacgtgaatcttgcagaattgtagaatctgcattacttaggctgaacagacagaatagagaatgaataatttaaaagataataacataaagagataaaaaactatgaagacaggtaagaggcattaaaaagctacaatgtatatctaataggaaacagaagaaaatgatatagggaatggcaaagaagcaatattttaaaaagaattggggggtgcagtgactcacatctataattctagtactttgggaggctgaggcaggaggattgcttgaggaccagcctgagcaacatagcgagctcccatctctacaaaaaaattaagtttagccaggcatggttgtgtgcacctgtagtcccagctactcaggaagctgaggtgggaggatcacttgaacccaggagttcaagcttctagtgagctatggtcatgctactgcactccagcctgggcaacaaagtgagatcctgtctcaaaaaatgtatatgtgggctgagaattttcctgaactgacaaaaaacagaagtcagtttaaagtactgagcaagataaataaaaataaacctacatggtagatacattgtagaatctgcattaatgataaagaaaattgtttatatgaattataagaatgattaactccaaaggaatggcaggagtttgacagcagtttgcttgatatcagtgataggtgcgaggtgacaactgggtggtatctttaaagtgctgagagaagataagtaacaaccagaattctccactgaattaaatttcactccagaaggtaaaataaagatattttgaggtagatgaaaactgagagcatttaccactcacaggcttttgctgaaagaactacaggtttatgtatattaataaatttcacaattcaaaaaaagctttgaaaacctgaagttgtcctttggtaagttttcagcaacctcatttgtggggcaaacttgacctaaactagttcatgggctaattttggtctttgtttatcccacttagtgtgaatacttatatgtttcactgtggagactttaatatgtttgaatccatggggtgctatcccaaccctgctgaaggtgttatatcacatctggtttgtgcaacctttataaaatctcaaaatttgtcacttccaaaccagaaaggtcccaggatttcagataagtgattatggatcttattaaaggattatggatcttatttctttagcaagaaataattgaaccaagagtgaaggagcagaatgtgggaaacagtagtgagcatgaaaattgatttgataaatgtaggtaaacttaattaattattgatttttttaaagtagtcatttttttcttttttctcttttttttctttttgagatggagtctcactctgatgcccaggctggagtgcagtggtgccatctaggctcactgcaacctccgtcccccgggtttaagcaattctcctgcctcagcctcccgagtagctgggattacaggcacctgccaccacacctgggtaatttttgtatttttagtagagacggggtttcaccatgttggccaggctggtcttgtactcctgacttcatgatgcacccgcctcagcctcccaaagtgctgggattacaggcgtgagccaccactcccagcctaaagtggtaatttttacatttaaaaaggtatattgtcctgtaggtatgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccaccaaaagaaaaaaaaaaaaaaaaaacttctagagcttataaatgaattcagcaaagttgcaggggacaagagcaacacataaaaatcagttgtttctatataccatcaatgaacaatctaaaaaggaaattaagaaaagcaattctgtttaaaagagcatccaaaagatttagtctattaggaataagtctaactgaggaggtgaaagacttgcacactgaaaactataaaacattgctgaatgaaattaaagaagagctaaataaatagaaagacaccctgagtacatggataggatgatgtaacactgttaacatgtcagttctacccaaagcaatctactgattcaacacaattttcttttcttttcttttatcttcttttcttttttttttttttttttttttttgagacagagtctcactctgccacccaggctggagtgcagtggcgtgatctcggctcactgcaacctccacctcccaggttcaagtgattctcctgctcagaatcctgagtagctgggattacaggcatccaccaccatgcccgactaatttttgtatttttagtagagatggggtttcaccatgttggtcaggctggttgattgaacacaatttcttttcttttttttttttttgagatggagtctcactctgtctcccaggctggagtgcagtggctcaatctcagctcactacaacctccacctcccgggttcaagcggttcttctgcctcagcctccagaaaagctgggattacaggtgcccgccaccacacctggctaatttttgtatttttagtagatacagggtttcaccatgttggccaggctggtcttgaactcctgacctcaggtgatctgcccgcgtcaacctcccaaagtgctaggattacagacgtgagccaccgcacctggcgattcaacaaaatttctatcaaaataaataggctttttcactgagagaagaagctaatcctcaaaatcatatggaatagccaggacaatcttgaaaaaagaatataaaattggaaagttcaaacttcccaactataaaactagctatgaagccacagtaattcaagtattatggtcctggcataaggacaaacatatagaccactggaatagattaggaagcccagaaataaatctttacatatatggtcatttgatttcctgcaaaggtgcaattcaatagggaaaggacagtcttttcaaccaatggtgctgggaaaactggatatccacgtgtgaaagaatgaaattggactacaacactcttagaagaaaacaggggacagttttcataacattaaatttagcaattatttcatggatataacaccaaaagcataaggaacaaaaaatatagataaattggacttcatcaaaattaagaacttttgtgcatcaaaggatactatcatgaaagtgaaaggacaacctacacaatagaagaaaatatttgcaaatcatatatccaataaggaattaatatccagaatatgtaaagaactcctgcaactcaacaacaacaaaacaacccaatttaaaaatgggcaaaggacttgaagagacatttctccaaagaagatatccaaatggccaacacatgaaaagatgctcaacatcattagtcattggtaaaatgcaaatcaaaacaacaataagatgccacttcacatcttctaggttggctgttttttaaaaaggaaaatagcatgtgttgctgaggaggtggacaaattggagcccttgtgcattgctagtgagaatgtaaaatagtacagctgctctggaaaacagttcggttgtttctcaaaaggttaaacctataactaccatatgacccagcaattgcacttgtaggtatacatctaaaagaattaaagaaggaactgaaacagatacttgtatacaaatcatagcagcattattcacaatagccaaaaggtggaagtaacccaagggtccatcaacagatcaatggataaacaatagatggtacatacatacaaaggaatattattctgctttaaaaagaaaataaatttatggccctgcagtggcttacacctgtaatcccaacactttgggaaggtacggttgaaggatcatttaaggccaggagttcaaggcttgagaccagcctgggcaacatagggagaccctgtctctattatttaaaaattatgaaggaaggaaagaaggaaggagggaaagaaagaaagaaattttgatacatgctacatgtacggcccttgaagacattattcttagtgaaataggccagaacgacagatattacatgattccacttatatgaggtacttagaataggcaaatatatagagatagaaagtagaatagaggttatgagggtctggggggtgggcagaagggggtgttgttgtttaattgatgtagagtttttgttggggatgatgaaaaagttttgggtattgatagtgttcatggttgcacagcattgtgaatatatttaatgacactgaattgtacagttgcaaatggttaaatgataaatattatgtatagtttaccacattaaaaaagttttccaatttaaaaagagatagattctagtcacattctaaaaaataatatcagaagatgagaagactgcacataagttatagaaagtgtgctttgggctttgtcttgttttatttttatttttgttttgtttgtttatttattttgagacagggtcttgctctgtcacccaggctggagtgcagtggtgcgatcacagctcactgcagccttgacctcctaggctccagcagtcctcccacctcagcctctcaagtagctgggaccaaaggcatgcaccaccatgcccagctaatttttgtaatgtttcataaaatcaaggtttcactatgttgcccaggctggtctcaaactgctgagctcaagcagcccacccacctcagccttccaaagtgctgggattataggcataagccaccatgcctggcccattgtcttgttttggagagttataaagataatgagtattttcagacattttcaaaaatatgtagataggccaggcgcggtggctcatgccagtaatcccaacactttgggaggctgagatgggtggatcacttgaactcaggagtttgagaccagtcagggcaacatggtaagaccccatctctactaaaaatccaaaaaaatagctgagtgtgatgatgcctgcctttggtcccagctaattgggaggctgaggtgggaggatcagtgcttgagcctggagggcagaggttgcagtgagccaagatggggccactgcactccagactgggtgacagtgggagacaatgtctggggaaaaacaatgtagataaatattatgttaatgttttaagatggggtctcaccatattgcccaggctggactcaaactgctgggctcaagcgatcctccatcctcagcctctgagtagaactacaggcatgcaccaccatgcctggctgattatgttaaattttaatactgaaagattatagattttgtctatagcttccaaactaacagggagggtagaaaagaattaaaacaaaactttactaacacaatagaaggtgggaaaagaaggtggggaaagggaaagaagaatggataatgggaaagacaaaataagatatcaggtcagaaattaatcagatacactgaaaagctactcgttaacatatagtgactgtaaggttgggtagagaagcagaatctagccatatgctatttacaagagatatacataaacaaaatgacctagaagggttattaaaggcacagaaacagatacaccaggaaaataccaatcaaaataaagctggtattgcaatattataataaaaatatcagactcaaagcctggaatttagaaaaattagtaagatatagactttcaatatttcctgtgtggctagcttcaaagatacattctacctggcatcacttacctgtctttcttatctttctaaatcaatttccacaaatatttatgagtaactatcagttaggtaatgagtcaggtaatatagtagaggcaaagatgagtacagcctaagtgcttactccatagaactgacagtctaataggagaaagtccagtaactttaaaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaaaccaccccaaactggaacagccactccagttatgtccccatagccatgtcatccttatggcagctggtataggccagggagagtacagaaataatatcttttttcttttttttttttttttttgagactgagtctcactctgttgatcaggctggagtgcagtggcatgatctcggctcactgcaacctccacctcccaggttcaagtgattctcctgcctcagcctcccgagtagctggaatgactggtgcacgccaccatgcccagctaatttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtagagaaggttctccttagaactgactgtttgatctaagctgggaaggaagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgaaaccagcctgtccaacatggtgaaaccccgtctctactaaaaatacaaaaattagccaggtgtggtggcgcactcctataatcccagctattcaggaggctgaggaacgaaaatcgtttgaaccctgggggacagaggttgccgtgagccgagatcgtgccactgctctccagcctggacgacagagcaagactctgcctcaaaaaaaaaaaaaaagaaaaaagaaaagaaaagaaattggggctggatgtggtggctcacacctgtaatcccagcattttgggagcccaaggtgggaggatcacttgagcccaggagtttgagaccaacctggacaacatactgagacttcgtctctacaaaaaaataaacaaaattagccaggtgtggtggcacatacctgtactcacagctacttgggaggctgaggtgggaggatcacttgagctgagggaggttgaggctacagtgagtcatgattatgccactgactctagcctaggtgacagcgagatcctgcttcaaaaaaacaaacaaacaaacaaaaaagttaaattttattctctgggtattatttgaaggcttttttttttttaaagaccctgttgcagccgggcacggtgactcatgcctgtaatctcagcactttgggaggccgaggcgggcagatcacaaggtcaggagatcgagaccatcctggctaacatggtgaaaccccatctctactaaaaaatacaaaaaaattagccgggtgtggtggcgggtgcctgtagtcccagctacccgggaggctgaggcaggagaatggtgtgaacccaggaggtggagcttgcagtgatccaagatcgcgctactgcactccagcctgggtgacagagcaatactccgtctcaaaaaaaaaaaaaaaaaaaaaaagaccctgttgcccaggctggagtgcagtggcatgatcatatgatcatagttcactataaccttgagcttccaggctcaagtgatcttcctaactcagcctcccaactagctaggactacaggtacatgcctaccatacctagctaattttaaatttttttgtagagacggggttttgctgtgtggcccaggctggtctcaaactcctgggctcaaggcctcagcctcccaaagcactgggattacagatgtgagccaccatgccccatcttatttgaaggcttttagataggagagtggtgtggtgatatctgagctctagaaagatcattcaaaaggcagtgtagaagatggcctagactagagacaaggaacatagaagtctggtagtagttgagtgagagattagacccaacactaaggcagtatggagacagaaggggcactttcagagatagaatccataggatttggtgattggatttggcattaagatgagagagaagaccgtggtaatttccaagtttttggcttgggccactgggtaagaatattttttaaaagccttcaagtaatagccacagaataaatttcaatttttttttttttttttttttttttttttggagacagggttttactctgtcacccaggcaggaatacaatgacacaatctcagctcactgcagcctcgaccttccaagctcaggtgatcctcccacctcaagtagctgggaatatatttgtgcactaccatgtgtggctaatttttctattttttatagagttggggtttcgctatgttatccaggctggtctcaaactcctgggctcaagccactcgtccacctcagcctcccaaagtgctggggttataggcgtgggctaccatgcctggtctcctactttcatattatgtgttttcataaatacctttaagacaatttcttgcttgcttgcttttctttttctttcttctttcttgccttccttccttcgttccttccttccttcccctccctccctcccctcccttccttccttcccctcccctccccactgaggttatagtcagtgaataggtagtctccctgcttttgaatttatgagattccccaccatgctctaatcaatgctactgctacgaaactgtaacttttctaaatagctactaaatatatagctattaaacttttatatgtagttactaaatcttttctaaaacttttccacccaatatcttattagttccactgccctaagaaataggtaaagtgggtattattgtgcccattttgtaaataatgaaattgtgtaacttgcagaaagatttcatggtgaattagtagcaaagctagaaattgaacccagatttactaatatgctgatgtgctatttctactatttttacttcaatcattgcctctttgacatataactctggagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgcatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctcatgaagactgtaacaaacctcttggtatctaagcaactttagactcttggaagcaaaagttatattagaattttaaaagcctttaaaattacacttctcactttgctaattttttctgtataggaatattaatctgaattttctaagtctggcaaagattgatattctcttaatgtaaatctttacttctgtttagggatatcggctcaaaagtgccttctccaagtttattttcaattagaatttaattttcaatatatacatatatacacatacatacatatatatatttcatttgataaaataatgataggtacttcctcttctatctgtgaagaagtatctactaagggaattgccctcttgccactaacaatgagaaaatcagcatatctgaaacaacagttttcagacattgggcaataggcagtgggggctgtggattctgagagccagtttccaagcaacagtatagggagagagattgtcaaagagcttagcagtgttattgagttgaggaggcagagactggggtttagggaggctggagcagccagtatttacaggtcagaatccaagagaggaagaagttgttcagtgagctccagaatctttggctacaaattctgcatatgtgtgggctggaaaaagaaccaccagaaaacagtgggccaaacaatttctggagtatacaaggggctaaggataattcaaacttctaccagccatagggaagagacctcaaaacacaccgggcactgggtagagttctcaacagtttaaaagcaaaaaggattaaatcgatccgcaagtaatttaatgctatataagaacaaaattcaataatctttaaaggaatttaacaaaatccagcattcagcaatgcaaaattcacaaagtctgacatccaattcaaaattaccagacaggccaggcatggtggctcatgcctacaatcccaggactttgggaggccaaggcaagtggatcacttgagcccaggagttcatgaccagcttgggcaacagagcaaaaccctgtctctacaaaaaatttaaaaaattagccaggtgtgacacctgtggtcccagctactctaatggctgaggcgggaggattgcttgagcctggaaagttgaggctgcagtgagctgtgatcgcaccactgcactcaagcctgggcaatagagtaagaccctgtctcaaaaacaaaacaaaacaaaataaaattaccagacattaaaagaagcaggaaaatacagcccataaccaggagaaaaattaatcaatagaaacacagatccagaaatgacagagatgatggaattaactaacaaggaccttaaaatagttattttaaatcatataaatatgcttaagtatgtaaagaaaacatgaatatgattaggagattagtggaagatattaaaaagatccaaatggaatttctagacatgaaaaatacaatatagtgaaaatgataataatagcaattaacatttattaagtgcttctatgtagattatctcatttttcttcacaacaaccctatgtgttaggtagatgctattatttcctttgcatagaaaatgaaacagatttagaatgttaaataacttgctgtaggtcacacacccagtcaatgaaaaagccaatgccaggagaagccatgaagtctgactccaggctgtattattgcttcagcgtgttatgcatcaacactgcatgacaggctggaaatacaaatgagtaagtgacaatacttgccctcaaggagctcttattctaggagaagaaacagtagcataggaaccaacccaaatgcccatcaatgatagactggataaagaaaatatggaacatatacaccacagaatactatgcagccataaaaaggaacgagatcgtgtcctttgcagggacatggatgaagctggaagccatcatcctcagcaaactaacacaggaacagaaaaccaaacactgcatgttctcactcataagtgggagttgaacaatgagaacacgatggacacagggaggagaacatcacacaccaggtcctgttggggggctggggggtgaaggaagggaagttagagggcaggtcaatagttgcagcaaaccaccatggtacacgtatacctatgtaacaagcctgcacattctgtacatctatcccgttttttttagaagaaataaaataaactagattcttaattcaaccccaccccctctctgccaaaaaaaacctgagtggtgtagaaatagtctccatagagtacaggtgatttttagagccacacataagattccataatagcacaagggagaaaatagtcaattctatagaagcgggtgaaggctataaaggtgcaaagacagttgggatggatcttggagcagtagaaagctgttaagcaaataaggaatacgttctaaaaacagggaacacgatttctgaaagtatgataacatgaaacaacatggttcctttggaaagtggtaagaagtcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtgagggataaaggactacaaattgggttcattgttactgcttgggtaatgggtgcaacaaaatctcacaaatcgccactaaagaacctactcatgtaaaccagataccactggttcccccaaaaccctatgaaaataaaaaatttctcctgaagttagtagaatcttctccatttgtgtggtattttcacatgtaacacagacaaaagcatggaaaatgtaaggcaggtaaaagtgaaagcatagacccgttaggagactactacaatataacagaaatgaccatgaaaatgaagagctatttaagaagttggtttgacaggatttgctgattcattgtgtgagggatgtggcagagaaagagtcaagaatgaatgccagaatgtaaagtatggccagttttatccctctcttgcttttttcctttccttttttttctttcatcttttatgtttcactctgaattcacagtggttttgtgttcatatttattcattcgacaaacatttatgtatcagttcttggtgataaagcagtgactgggacagacagaaatttttattcttgtcaactttgctgtatgatcagaaaattgacaaaaatccctgcttttatagagcttacattctaggaatcagggaattgcagtgggtctatctgagtatgtgataaaaatctgttagtttttctaaaatatctattgtttatggtggacaaagtgatgtcaagggaaaatgcagacactttaggctgaaatgaagatgttggtctgacttctttttgtaattgccttgaacttcacttgattttgcttgtcactaatccttatcttcaccagtaaaaatcattcagtgaggattaatagcgctttactacaggagtgggtggctgtctttgaattattaaagagcaattgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaattttattgtttggagaaaaataaatgtatattataacatcatatataagttgttcaatggtattattttttgaaaagatcagatgactcaaaggctagtatgactgaactgtgtctgccccccccaaattcccatgttgaagccatacctccaatgtgactatatttgaagaaattcctcctgtaaggaggaaattaaggttaagagaggtgataagggtagggcttcatcagataggaaggattagtatccttgcaagaagagacaccggaactggtgtccctgtaagaggagataccagagagctgcccatgcccctccacgtgaggacacagtgagaaggcagctgtctgcaaaccaaggagagagcctttaccagacaccaactctgctggcaccttgatctcagacttccagtccccagaactgtgagaaaattaatttctgctgtttaagtcactcagtctatggtatttgttacggcagcccggacagactaacacagaggtcttctttttaactcacagtttcagcacagaaagattcattttattttgcatgttgactccaaaacctgttttgatttatcattaacattttatctgaagttgtgagtatggccgtgttgtgaccctgcgttatcaaattgagccatctaatttatttccacattgataaacttatattcaatggattttagtttaaggtagaaataatggtaattactttttttttttaactgtagtcctcatacctgccttatgtcaatcaggaaactttagtataaaagaataaattttgatacaactgcttatatccctgcaaataactcagaaagatctgcagcttaaagactttgtcctaataaaactgacagcctgtatcaatctgtatgttatccaatgtaatattttttaaaatgtaaatgttaattttgaaaactgcatgtgtaattttggccaggcacagtggcttatgcctgtaatcccagtactttgagaggctgaggtgggcagatcatttgaggccaggagttcaagaccaacctggccaacatggtgaaaccctgtctctattaaaaacacaaaaattagtgaagcacggtggcgcgcgcctgtaattgcagctactcaggaggctgaggtgggagaattgtttgaacctaggaggcagaggttgcagtgagccaagatcatgccactgcactccaatatgggtgacagagcaagactccatctcaaaaaaaagaaaagaaaacttcttgtataattttaactgctagtgcttatctacacaatatttttggctgccttctcttttatgtgatcctctactccttgaatttttttctgccattgcctttccagtcaccgtacaaatatgactaccttatactactttgttagtatcttaacacttaaagacttccattttataattatcaagcattttataaaataataaatttactttgcatttgcttctataccagatcatataagtaaaaggagagcttgacaacatctgtcttctcatccagtataaagattttatgtaatctcagctttcatgccaatatagtcctggattaaaaagaaaataaaaagaccagagcagataataatttcctaatcagtggcacatttacagttgcaaatatatatatatatttgtggagtaggagaaattccacaaatgagttaacctatgagcacaggttgatagtgtgtgtatattaaaatttactgtgtaacatatttagtgtacattttgtttttcttatagactttaaataaaagtatgtttttaataagaattgaaattaaacttttatagaaacttctaagtgcctctgcaaatttctaagcttctgtggaacatggtttgaaaactactgatctacttcaacccttccccattgtgtaaatataaaaatcaaagccaaggtctcctagtcacttggtaggacctgtaaaaccaagactaaattcaggtcttctggttgtcagtcaaatgttctagccattatcatgctctgctgctaaatgaacatatacattttgtgtcatttagtctctgagatgaatgtatgattttgtagcccaaaacgtaattgtagtagttaaggcataagaatgcattgcccatgtgattttatttcttctttcattgttttacagatgaaggtaaagtagctacaagttctttaattttaagttccattttacctatcttcaagagaaaaaatagttactccacctggtttaaaatttaaaaataataattcttattagagagggacgtataatacttgtttattggatatttcatgctttgaaggacataataagcagattttggaagttctttgaaaatacaagagttttattgttgttgttgttgctgtttattttattattattattttttttttgagacagagtctcactctgtagcccaggttggagtgcagtggcacgatctcactcactgctacctcctcctcctgggtcctggttccagcaattctcctgcctcagcctcccaaatagctgggattaccggcatgtgccaccatgcccagctaatttttgtgtttttagtagagacgggggtttcaccatgttggccaggctggtcttgaactcctgacctcatgatccacccgccttggcctcccaaagtgctgggattacaggcatgagccaccgcacccggccgttgttgctttttaattttaaagttaggctgaagtgagactgtaacacacaacgttattaaacgcattctctaaagtagatctaccaagccaggcacagtgcacatgccggtaatctcacttgagcccaggagcccaggagttggagaacataagtgcactatgaatgtgcctgtaaatacccactgatctgcagcctgggcaacagagtgagacaccatctcaaacagggtgggtggatggatggagagagggggagagagagagagagagagagctggaagtatgtaaaagcaaatataaataatgttgaaaatttaatattttccagttttattttgcttggcataacctgctcttgattcccactgataccgcctgaccctaatttagaaacctaattagacaccttggggaggttgtcaaaaagacagattccttgatcccacctcaaacgtactcgaccacagccagcaggcaaggggcctgggaattaattttaacaagcatttcaggtgattcttaggatcactcaagtttgggaaacattaagcggtttcaaccctgcttgcatattaggatcagctagggtgcttttaaaaaatactgttgcctaggtccctccccagaccactttaatcagaatctttttggttgggacccaggcattttaaatgctctgcaggtggttctcatacacactgaagcttgagaactcctgcaagacagttggaaatgtaattctctgaagcacagccctggtcttgtcactgctgctgagaacctcaatggttctgtattgcctactaatgaaatatgaatttatgactatcataaggctactcatgacccaacaccagctttccaaccactactctcctacttatagactatactctggccacacagaaacactttccccaaacactccttgtgctttccccctttcacacctctgtttttgctttcccaccatgtagaactttcccccatgtctgtctgtcacagtcctgcccatcctcaaatagacccagctcaagtagattcccatttcctcctgtccttgccctcccctgcctccattcaaaagcgacctcttagggcatttgtcctatcataccttatatttagttattggcagatacatagtctctttcataaaatgccatgtggaattaagaataagtggatttttatctttcctttttccccatctagattgtaaatttgtaatatcaactatctgtttacttctgtgtgaggcactaaagagaaagactttagagtcaaatggccctaggttcaggtgccttttttattggatatggctgtgtgaccatggtcaggttaatttttccaagccttagttttctcatctataaaatggagaatatactacttcagtgttgtgaaaactagatttgataaccgactggagccttcagtaatcccggtatgtaataactgctctgtcaaagtctgttgcttttatcattgtgataatgatcattgttagctcccttgagggcaaagactgcatattttatctttggatccccattctgaaccttgcttattgtaggtgcttgataaatactgggtgaataaaataatgaatgcctgctgggtcgtgcttacttatatagtccactaccaatcagttcagcctgtcttggaaggagcacttcaaatttcaatttaaccatcagataaagatagaaaataggatttccactacaaactttaaaaactgtattaaaaaggccaaaaccccagttaaactgtaagacagctgctctctttctgctgccaggaaatagagaaaaccctccaaggactatttgctgtttgtttgtgcatcatataataaacatgctgtgacttggggagagcacacacttcccctgcaggcaagcttgggtttgggaagttgcatgtagcagcagtgaggaagaaatcccccactctgtgggagaggttccttcacggactccactaagcccatttgcagttttgctgagttatttactaagatgaagggactgggtgtggctggtctgagattcctcctgggaagtcacttcaagaatctccttaatttcctcacccttcatctttgttctctggctttggtgcaagggtgcagtcagtcgcacccagttggctgctgttcccagcacactgaattatttgaagctggctgtggcagccaaggattccctgttctgttcttttccccttgccctgatttgaaaaacggtctggaaattctcatctggcatgaccagaaggaacttagtaggttgcaagctgtttttctagatgcacaggaccaaacagaacctttaaagctgtaaattaccatttctcaaaaactcaatttgatggattttacatggacaaattatataacgtaggctttaccatcaccactatcgtttaaacaagaggccatccaattgagatgaaaccgatataggaaagtaattatcatcagctttgtcacttgaagaaggaatgtgaggatatattagctaattgaaacctcaggaaagatgtataacaaaacatataaggattaatgagtagtccacaaaagtgtttaccagatgaccaatatcttttaaaatatatagatgtattccagctcttttaattagaaaatatatatatatacacacacacatatatggataaaaaatgaacttataattacaatagatgtgatgacaaaataattcatagtctgaaaaatatataatttcagtgatcagagccttatgtattatgctaattgtccaataatttcttgaaagtatgtttctacttttaaagtaaaattaaattcagaaagcaatgatgagcaaatatgtgataatattctaggcagacactgaacatttatatttattgtgagaacagcatgatggtagagtactatttatataaaattatgtatctttatgtctttatatgtttacatgcatacaaaaatatttggaaggaggtttactgaaatgttgtgaatgattttctcttagtgttgagactacttttttcttcacacatttttatattgtctgagtttttataatgagcatataacatttttataatcatagtaaaaataaagctatttttatagctttcatataggaaaattttgcttgagcatctgctatgtgtccaaagtggtactagaaattatgagatataggaaagaaggctgtggcctggctaccaagatgcttacaatctagctgggaagacaactagggagtgggatcctatagaatgtaatccggtgtcgggatgtatggttcaaaaaggtgctacggagcatcaggaagaggagaggaagctctcaatggaaggaagctttcatcgaaaatgaagattaggctgggtgcagtgactcatgcctgtaatccgagcactttggggggccagggtaggagggttgcttgagcccaggagttcaaaaccaacttgagcaacatagtgagaccctgtatttttttgagaaatattttaaaacttagaaagaaagaaaaggaagcttagattggaccttgaaagatggacaaaaattgaataggagggagagaagaaggcattttaggcagcatgagcgctaaagtgataataataatgctttttgaaaagaaaggaggaaaccagcttgtctagaataaaaagtaaatatgatttgtgatggagaagtttgctttattgctaagtttatttcataagatatctttgatatattacaaactatatttttgtatacttgagcaggtcctagaaaaatattttgtaattattctgaatattgactctaaagtgatgtaaaaactatgactactatgaaaaattcattattttagtgtattgagggtagaagatttcagtacatatgctgtgtaacactgtcatctctgtgcacaagcttgttctcaagtcaaacagtggcttttcatatagtcttttaatttgtggttaatatgttcctacacctttcttcttctattaaaaaaatcaaattagccgaacgtggtggtgcacacctgtaatcccagctacttgggaggctcaggcgggagaatctcttgaactcgggaggcagtggttgcagtgagctgagattgcgccactgcactccagcctgggcaacagtctcaacaacaacaacaacaaatcaaaaagcaccagttgccatggctcatgcctatagtcctagcactttgggaggcaaacatgggaggattgcttgagcccaagaatttgagaccagcctgggcaacacaatgagaccaacatctctacaaaaataagaaaaactcaccaggcatagtggctcacgcctctggcccagctacttgggaggctgaggtgggaagattccttgagctcaggaggttgaggctgcagtgagctgtgatcatgccactgcatttcagcctgggcaacagagcaagatcctgtctcagaaaaaaaaaaaaaaaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaagaaaactgatgtataactacttgcaaaaggaaaaaggtatgtttgtgccatagaggcctaaaagggttcaagaattggaggtgggttcaagaattggaggtgtcggccaggcgtggtggcctcacgcctgtaattccagcactttgggaggcagaggcagacagatcacctgaggtcaggagcttgcgaccagcctggccagggtggttaagccccgtctctacaaaaatacaaaaattagctcagcatgatggcaggtgcctgtaatcccagctactcaggaggctgaggcaggtgaatctcttgaacctgagaggtggaggttgctgggttgctgtgagctgatattgcgccactgtactccaggcctgggtgacagagcgagattcattctcaaaaaaaaaaaaaaaaaaaaaaaaaagaattggaggtgtcaagtactctgaaactgggagtgagaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttattttccagctcccttcccttgcttagctgtcagaatgctggcttccaaatgaatataccccaggtgggattctggaatattttctggagaaactgaaatagcctcagaggaagtccctacaaatctgacatttaggagttgcacaatgaaatgaccaggtttccgcccattcattctacagtgaagctcaatataaacaagctccaattcattcagataaccagttttttagtacctcgcaccaaataggaatgaacatattcaggtattcaaggatcaccagaaatttgggggaagtctctaatatgatagccagaagccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaaaaaaaagaaaactgaaggcccagtccaggagtataagacctaaaaatttgaagttctagaaagagaaattggaagaactagaatgccatcaggcttctcaacagcaacatgagaagcttaaaaaaaaaaaaagtgcaatgcttttagaattctaagagaaaattattttcaacctagaattctgtaccaaaccgaactatcaatcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatgacaggttagaagaattactacagtagtttggttggggtgaaatgagttataacttccaagagaaccattttagttgagtgacggaagcaacgttgaaggagttactgagtgaatgaatgggtagtaagaaagaggaggtaatgagcatagcatactcctctgagaaatctggctttgaaaacaaagggaggagaaagcggtgttagtgagttgagtctatgaaagattttttagattaagacaccacttagacatgtgtgcatagacagcaaggagttaatggagaaggtaaggtcaacgatgcaagcgtaaaggggatagttggtggagcaaggtcccagaaactgagataacatggactcaagagcatagatggaaagattaattgtaggaagagaagggaaagatttctttctctgaaagaaggaaggaagaggtgcagataagtgaaaatgcagagaaatattaaggtataaaggaaggaaattgagggacttaaaaaggtggcttcagtcttctcaagaaaataagaggttctctgctgagagtttggatttggggcataggattagcttggaaatttgagaatggaaaatatctgaaggcatgtgatgccaagttaaaaggagatgactaaaatgattatccagtagccacgagtgtccagttgaggttagatagcagaaatttgtaataaagccaatcaatatggtttctggacttccctcaagaacgttctatctccaaaagttgtattaatcatcatcttggctaggatggcgtttccttggagtgtcttaagagacattccagggttcaaaaactttagaaaatgcttgctcaaggagagtcagtgctcaagaataccagagagaaggttttcttgtgggacacttcaatctaggtcattcggaggtcttgtgggggatcatgagcaacgaaaaagaaatatacttgagagacttaaatgacacaaaacagtttgatatcaaaaagatctgtagctgcatggacatctggacacaaatctgagggtgagagcgtgttggagaacacctggattcagataaaagaagagcagaagagaagtgacatcattgtgggattagaatatagactacctagccagatggaagaaatagataaagcatttctgatgcagatcgcaaaactggcctgagtcaagagagcttggtgatagggatttcaagcatcagcacataagctcaaagtcaagttcagccaaaagctgcatacttgattaattctttttttcctgtttgtttatgtttttctgatcaaagaaaaacttgctcattgtagaaatgtagtagtacaggaaagtgtaatgaagtagaaaaataatcactcataaatccactcaccattaaaatacttgctaattatttctagtatttttatgcattgttgtctttgcatagtagagattatgctgaatatacatttgtctaaactgttttttaacataaaagacttttctcatatatatttcttatatatctcatatattttcatatatatctgaaattctttttatatgttcatctttcagaaggaagaaatacggccgggcgcggtggctcacgcctgtaatcccagcactttgggaggcggaggcgagtggatcacttgaggtcaggagttcgagaccagcctgaccaacacggtgataccccgtctctattaaaaatacaaaaaaatttagccgggcatggttgcacacacctgtaatcccagctacttgggagggtgaggcaggagaatcacgtgaacccggaggcaaaggttgcagtgagccaaggtcatgccattgtactgcagcctgggaaacatgagtaaaactccatctcaaaaacaaacaaacaaaaaaaaggaagaaatatgagataggagtccaagatatatataattataaaaataatttcagggccgggcgcggtggctcacgcctgtaatcccaacacttggggaggccgaggcaggcggatcatgaggtcaggagatcgagaccatcctggctaacatggtgaaaccctgtctctactaaaaatacaaaaaattagccaggggtggtggcacgcgcctatagtcccagctgctcaggaggctgaggtaggagaattgcttgaacccgggagatggaggttgcagtgagccaagatcgtgccactgcactccagcctgggtgacagagtgaaactccgtctcaaaaaataataatttcactatttactctttgctaacattatttccatttttctgaaaataaccagtcaatgctactgtattaggcaggaaaaagaaataagaggcataaaaattttaaaagagaaggaaaaattacatgattgcaggtgatatgattacttagctggaaagcccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaattaatctacattggggagagcatttaaattaatgagcacaactggtagccatgttaagaatatgatattggattctttcctcacatcttatatgcaaacaaattctagatggatcaaaaatttcaatataggccagctacagtggctcatacctgtaatcccagcactttgggaggccgaggtgggaggattgcttgaacccaggagttcaagactagcctgggcaatgtaaagaaatctgtctctacaaaaaaaccttttttttttttttttttacagcagggtgtggtggcgcacgcttatattaggttggtgcaaaggtaattgcggcttttgccattcgtagcaatagtctcagctactcgaaaggctgaggtgaggggatcacttgagcccaggagttggaggcttcagtgagccatgatcacaccactgcactcccgcctgggagacggagtgagaccctgtctcaaaaaaaaaaaaaaaaaatacaaaaaacaaaaacacaaacatgaagaaaccacagaaagatgttcttacaatctcacagaagggaagatgtttctaagagagctgataaaaaaaaacctggaagccataaaagaaaagattgatatattttgttgcagaaagaggaaaaatatttgcttgccaacaaatactgtaaacaataacaaaagattaacaacaaacagaaagtatttgcaacttatatcacagatgaagggctaatttccttatatacagagttcctaaaaatcaataataaaaataccaaaaactcagtagaagattgaaggatgaaaatgaacagagtttatagtaaaggattgtataagtggttctttaaaaattatttttaataactagattgagatataatttatataccatacaattcacctatttaaagtgtacaattcagtcgtttttagaatattcagttgtaaaaccatcaccaaaatcagttttagaatattttcatcaagccccctctgccaagaaaaataccccgtacacattagcagtaactcccctttttccccacccacaaactcccagtcctaggcaaccactaacctactttctgtctctgtggatatgcctattctggacatttcatatagattatatatagatagaatcatacaatatatgggcttctgtatttggtttctttcactcaatgttttcttttctttgtttttatttaagttcttggggtacatgtgcaggatgtgcaggtttgttacataggtaaatgtgtgccatagtggtttgctgcacagatcaacccatcacttaggtattaagcccagtatgcattagctattttttctaatgttctccctcccccgacctcaccccccaacaggccccagtatgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccatgttgtaacatgtatcagtactttattcctttttgtggccaaataatattccattgtatgattataccacattttgtctatccattcatccattgatagacattggattgtttccactttttggctatcatgaataatgctgctgtggatgtttgtatacacacttttttgtgaacatgttttcagttctcttggatatatacctaggagtggaatattgggtcatatggtaattctgtgtttgaaagaacagccaaactgttttccaaaatgcctgcactctgttacattcccagtaacagtttatgagggttacaatttctccacattcttgccagcatttgatgttacgtgtcttttttattatcgccagcctagaggtgtgaaatggtatctcactatccttttgatttgtattttcctgatgactaatgatgtcgaacatctttttacatgcatattagccatttgtgtatcttttctggagaaatgttcatccacattgtggaatgtatcagcacttcattcctttttactgctatgtagtattccgttgtatgaatatagcacactttgctttttgtttgcttgttaatgtacacttgggttatgtacagtttttgcccattatgaataaatcttctaggaacatttgtctccaggtctttttatggatgtatgttttcatttatcttgggtaaatacctaagggttgaattactgactgctttctaaaacagttgtaccatcttacattcccaccagcaatgtatgagaattccagtttttacaattgcttgttaacatttggtattgtcagtcttttgcattttagccattctagtggttgtgaaatgaaatctcattgtggttttagtttgcatttccctgatgactaatgatgttgaatactttttactgcttgttggtcatttgtatatcttcctttgtgaagtgtctcttcaaatattttgcccaatttttagtgggttgtttgtctttttattatccagtggtaggagttctttacacattctggttacaagttagatatgttcattacaaatattttctccctctgtggcctctttatttatttccttagtgatgtcttttattgagcagaagttttaattttttagcattttttttcttttatggttaatgccttctgggtccagtctaaaaaatctttgcctaccctaaggctgtgacagtgttaccctatatttccttctaaaagcaatagaggtttaacttttatgtttaggcctataattcatcctgaattattttttgttggtagtttaagattgagggtcaaggtttttccccgctcccctcatggatagccagttgagacagtatgatttattgaaaagactttccttctcctacttgttgtggttcctttgttaaaaataaataaataaattgaccatgtattaatatgtgcatatctatctctggattctctattctgttccattgatctaaggtagtgtatgcccttcaactttttctttttcaagattgttttattcattcaaggccctttgcatttccatataaaatttagaataaactggttcatttctacaaaaaaagcctgatgagaattggattgaaattattaagaatcgccgggtgcgatggattacgcctgtaatcccagcactttgggaggccaaggtgggcagatcacctgaggtcaggagtttgagaccagcctgaccaacatgcccctgaccaacatggagaaaccccatctctactaaaaatacaaaaaaaaattagctgggcgtggtggtggacacctgtaatcccagctagtcgggaggctgaggcagaagaattgcttgaacccgagaggcagaggttgcagtgagccaagatcacgccactgcactccagcctggcaacagagcgagactccatctcaaacaaacaaacaaacagtaagacccgaaatattatttttgaaccccaagctcacttttgtatagatatacctactctagaaacaatgacaaaactaggaattgtgacacaatactaaagacaatattaaaaggcttttttaaaaagttacattgggagcaaaaagaacaaggaggcctaggtgggtggtatcatattaatgaatgaaagaaagaaaatagagcattcacctctattttggtttagtcttctctgtcaaagaggatactctttggactggaaaagataaaataaacactggttccagggaatgcagtcaaacgtagttgagattgaaataggtcatgcaactgctttaaatgatttcaagttccttaatcttatatttcaagatactgaggactaggctgggcgcagtggctcatgcatgaaatctcagcactttgggaggctgaggtgggtggatcacctgaggtcaggagttcgagaccagcctggctaacatgacgaaaccccgtctctactaaaaatacaaaaattagctgggtgtggtggcaggcacctgtaatcccaggtactagggaggctaaggctggaaaatcacttgaacccaggaagcagagccaaggtcgcaccattgcactctagtctgggtgacgagtgaaactctgtctcaaaaaaaaaaaagatactgaggactagtggatgagctggctgaagcattgctggcagtctctgagaaagtgtgcatggggagggggaattaggggatgggggtcggggatggatagaaatttcagaagattagagtcaaggaactaatattcaggaggtcacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatccaaaaaaaaaaaaaaaaaaaaaaatagctggctgtggtagtacatacctgtaatcccagctacttgagaggctgaggcaggagaatcccttgaacccgggaggcagcggttacagagagccaagattgcgccactgcactccagcctgtgtgatggagtgagactctgtggaaaaaaaattttttaaaaagaataaattaagaaaaggaagttgggatcaccataagcttaccagaatttattgaagatggagacagaaaaggggaggaagtagggggtaaagggggaaaggaagaagggaagagaagataataaaggggaagggaagggacaggaggcgaaggaaaaggaataggaaaagattccaggcttagtgggtaaagaagacttgatttcaaccctggctcttttacttcttagtaaaatgatgttaggcaagttattaattgctataagctagatttccttattggtaaaattgaaataagagaaactacttcatagagtagtcctgatgattaaattaaataatgtgtataaagtgcttatttatcaaaagcagtgataactgtgaagggggtgaatgatggtaatgacaataatactgacggagaaggaacgggagtagacaatgtaaacttactccctttttgaagagattattacattggtaagttgacagaaatctgtacagtatagctatatttagtatagctatatttagtatatttgtttagctaaattggatttctacaagactttgacaacatctccatgacatccttgcgaacaaggagaaggaatataggctggatgatataggctggttgaatagtcatacttaaagtgtgctgattaatgggttcctgtcatgctgaaattctccaggagtgtaaatctggactatgtacttagccaagcttttttaaaaaatcattatttgcataagagcattgatagcaggctaattaaatttgggaacaatagctaataagctgactgaaaaaaacagaacctaaaaagaaatggtataatacagagcaaagaatatggccttaatgtcatggatctatcactactagctgtgtggctttgagtaaattgcttaaccacctgagccttttgttcctcatttgcatggagataatactacatattccatgtggttgtgagaacataaaagataatatatgtgtattatcacacctgtaatcccagcactttgggaggcccagggtgggcagatcacaaggtcaggagatcgaggccatcctgaccaatatggtgaaaccccatctctactaaaaatacaaaaattagctgggcatggtggtgcgggcctgtaatcccagctactcaggaggctgaggcaggagaatcacttgaaccagggagtcggaggttgcagtgagccgagatcgcaccactgcactccagcctggcaacatggcgagactcaaatatatatgtgtatgtcaaatgtatgtgtgtgtgtgtgtgtgtgaattagttatctatttctgtgttataaatctcccccaaaaaacctgggggcctaaaacaatacacatttattatttcacacaggttctaaaggctgggaatccaagagcagcttactggggtggttctggctcagagtctcttctaaggttgaaatcaagattttgattgggactgcagtcatctaaaggcttgaatggatctggagggcctgcttctaagctcagtcatgtgggaggcctcagatctttagcacatgatcctcgtgatatgaggaactggcttccccagagcaagtggtcttagaagaagagagcaagcaggaagccacagtgcctttatcacttggcctctgacatcacattctgtcgcttttgttttattttctccattagaagcgtgttgctaagtttagctcatattcaaggggaaaagaattaggatccacctcttgaagtgggggagtatcatagaattttgtgggcatatcttaaaactgcaacaatctaaaaagtactcagtacagtgcctagcacataagtgctccataaatggcagttgttattctactattaatagtctacacttaatatacatatacaattaatatacatggtccctactatgaaaccggtgtgggtaggacaagataaactcatgatttcttagattcctggaaaacacagaaaaagaagtaccacatatgactacattaattacatctgttttgtacaccaaaatgaatggattatttttgcactgcatgtaatgcactaagaacaggactagtaaaaataaattttagtaatatttatttatttatttattttgagacagcgtctctctcttgcccaggctggagtgcaatggcacgatctcagctcactgcaacctccacctcctgggttcaagcgattctcctgcctcagcctcccaagtagctgggactacacgcatgcaccacaacactggctaatttttgtatttttaatagagatggggtttcaccatattgtccaggctggtctcgaactcctgacctcaagtgatccacctgcctcggcctcccaaagtgctgagattacagatgtgagccactgtgcccggccaaattttagtaatatttaataggcatacataaaatgtatagtctgtaaatatgagtgatatgaaaaattcgaatgacaacctaaaagtgatattatatggttttgttaaagagttttatatgtacatttaaatataagtattgatcatctgagaactcatcaaagcttaactgaataatgtatcaacttgtctttctgagtgtccttttctcatttccatttaaaaatgtgccacagctaagactgacaggccccagtctgcagcaaagatggggaagacttggtagttcacacgcctcccctgagggcaaggagtaattctggggggatgtaaactaacaaacataaaagtattatatcggcaaaggggtcgattaagtaaaagagttgatgttgacagtaaaaatttagaagcaataattaatgtggctgaatcactagataatttcctctttatgtatacatttatatgtgtatatatatatttatatatgggtccataatgcccatcattagcctcaaagattgtctaatgttcattggaaacaaaaacataagaactctcccacccgggtggacagagtaatttactgagccactttggtaagataagaacattagattgaaggtaatgtcacaccttaaacttgttaatttattggtgttttgatttgcattaaacattagacagatcctcaggctagcggctgacatggtagaactctccttagtatctcaccaaaatagcagtcaaacttctaagatgttcaaaacatagttactaatttgaaagtaagtagaaatggttgctgaggagccaggatttacagaggttatatgcatcattgtaggtgaggcaggaagtctcctaagatttcacagggagcctcctgacttataaatgcataaatcacagtattgatcaggtcagcagtgacagataaaaagtagtgacgtgggttttaactgttgctagccttagccacacactgacagttgtgataaatggtaacagaaaagggagttattatagatccaaacagtgaagagaaaatatatatttaaaaaccaacattttaagtaagataggtagtaatttactgtgtagaggacaaataaatggctttatacgtctttttgttctttttttgtttgaacggagtttcgcttttgttgcctaagctggagtgcaatggtgggatctcagctcaccacaacctctgcctcccaggttcaagcgattctcctgcctcagcctccggagtagctgggattacaggcatgtgccaccatgcccagctaattttttgtgtgtttttagtagagacggggtttctccacgttgctcaggctggtctcgaactcccgacctcaggtgatccgcccgccttggcctcccaaagtgctaggattacaggcgtgagccactgcacctggcatgtctttttgttctttaagggtatctactatggtccaagaaaatgagcagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctcacgcctgtaatcccagcactttgggaggccgaggtgggcggagcacaaggtcaggagatcgagaccatcctggctaacacggtgaaaccccatctctactaaaaatacaaaaaattagccaggcgcggtggcgggcgcctgtggtcccagctactcgggaggctgaggcaggagaatggcatgaacctgggaggcagagtttgcagtgagccgagatcacacaactgcactccagcccgggcaacagagcgagacagcgagactccatctcaaaaaaaaaaaaaaaaaaagataaggaaattgagacatagtggttaaaaatttacctaacattggctgggggcggtggctcacacctgtaatcccagcactttgggaggccaaggcaggcggatcaggaggtcaggagatcgagaccatcctagctaacacggtgaaaccccatctctactaaaaatacaaaaaaattagctgggcacatccagctactcgggaggctgaggcaggagaatcacctgaacccaggaggcagaggttgcagtgagccgaggtcacaccactgcactccagcctgggtgacagagcgagactccatctcaaaaaaaaaaaaaattttacctaacattgttcatgtggttaagtggcagagcccagaatcaaagtgaagtctgagtacctccatccaggtttactatctcagtctacgtgttttatggaaatgaggcatgccctttctgagaaggaatgatgttattatacctccttatatattttcattaagaatgagtgaggatctcctcctttattatttattcatgtgaccctttcttttccctcaccctgtgggaggctgaataatggccctaaagatattcaggccctaatccaggattatccaggtgaaccctaaatgtaatcacaagtgtccttttaagagggagtcagatagagatttgatgacgggagaggaagaagacaatgtgacacaagaagtgggtgtgtttggagcagggaagtgacatgacatggggccacaagccaaggaatgaggataacctctagaaactggaaaaagataggaaactgattctcccctagaacctccaggaggaaccagcctgctgacaccttgattttagtcccataagactcattttggacttctggcatccagaactctaagagaataaatttctgttgttttaagctaccaaattgtagtaatattttatagcaaccataggaattgaatacatatcccatattactggcttcaggacttatttgcattatactttctccttgtatttttcctacattttgtaactgtttattacttccagaatgcaactgtagagtgtgtaaataacatattcgtaaaagcattgtttcagataaagtctaaaaaagaggtattttattttaaaataatatccaatcctatggctatcccatatcccagcctttccaatggctgtaaaagggaaaattatgggacgaatgttgtcaagtatataatgaaaggaaatcttttcaatatgaatgatcaataaacttgtagaaaaatgtccaccataacgagagtcacaccagttaatcataacccacatctctgactaggaatgcagtaggtttcccccattcccaccactctttatttggagatttgttgaaacctataagagaattatgagaatagtatgaaggcacttgtctgcccttcaccaaatgctaactaatatgtcaccatatttgtgaacaacagatagataacttgaaactaagttatgggaatcatgacatcttacccctcacatccctcatctcctaagagtaaggactttctcctcttctcctgcataactccaatgtcatttgagaaaataacactaattttataacatcacctaacatccagtccagtgcaaattacaatttccccaattgttcctaaacattattaatagctgtttgttttctgacccagcatccagtcagggtttacacattgcacttggtaatgtctctttagtttcttttaatctggaacagaccccttacaattttgttttcatgatactgacttctttgtgttttcctgaccctcccacactagaatgtacattttacaggggcagggattttcgtctctgttaattgccatgtccttagcattgagaatgctgcctagcactttgtaaatatttgtttaataactagatgaatgaataagtaatacaagtacaatgagtgtcatgaaaggtgatttagaggatgccaagggtcctgagaatctaatctgttgttgtttgtgtgtaactcttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccacatggagcttacattccatgatgaacaaacaatacttaagtaagttttttgagggtaggggctctgtgctttcacaagagaggcaacatagcgtaatggtcaagagcagtggtttttgagccaccagacataggtttgagtcccagtttgtatacttttttgctgcttggtcttgggtaagttccttaagctctcagagcctgagtttccccagtagtaaggtcatggcaaataacagtacagcctcataggttgggaagggacttaagcgagataatgcatgagaattgtctcacatggtgcctggcacttaatagcttcttgataaatgttagttgttgttttcatcattattaacattgactaactaaaacatgtcttactagaaaagggatttgaaaccaaatgatgaagaacagttgaaggaaccagggatgttaaactcatagaaaagtaaatggaatacatgcttactggtttcaaatacttgatgatgtagcatgtgacctgagcttacttattctgtgtggtcccagaaaacagaattaggtccagccggtggaagttaccaggaagacaattttcacaatgtaagaagaaatgttcttaacaattagaattatctataaatagaaagagctgcttgggaggaaatggattttctgtcattagagataataaagcaggtactagacatgtgctctccaatatgtagccactagcctcctatggctatttaaatttaaagtaattaaaattaaatacagttataaaggcagaggataggatggtggtttccagggattggggaagggagaaactgggtattgttgttcaattggtgtaaagttacagttatgcaagatgaatcaattctaaagacctgctctatagcataatgcttataactaacaaaattaggaacctaacaatttattaagagggtagatctcatgtcaatcattcttaccacacacagagagagagagagagagagagaaacttttgaggatgtggatatgcctgttatcttgatggtagcggtgatttcaccattttatgcatatatccaagctcatcaaattgtacatattaaatatgtatagttttttgtatgtcagttaaacctcaataaagctaatttttaagaaattaaatacaaatacaattcagttatttagtcacattagtcacgtttcaaagtgctcacaagccacatatggctagtggctgctgccatattagtgcagaataacaaacattgccatcatcacagaaagttctgttgtatagtgctgttctggacaatgaacaaagatgtttaagaagaaatggaggcacaagatgagaaagaagagctgaattaattaggtaacttgtaaagtccattctaagcctcagttttatagattatgaaaggtcatcttttaaccatttcattttggaataaaggaagagttattctcacagaaataaaactgttgtgttatttggagatatttttattttactgatttgacttaaaaattgcttcttttcagctcatcactctagttagagaaataaatttctgaggggaaatggcctagcaatggcatggcccaggagaagtacagtaatcattgcatctttttcctgaaagaactttccatgattttttagttcagcctgaagagccatttgtgacgcttaaaaatcaatgaaggggaaaaatgggactgagctgggccagttttcaaaggacatgaggggtgagtcttgtttcagttgctagtattagacaggatttcatttatgaactttgttctcttgtccaactccagttcctacaggtttcctttttcctttgctctccagtcaaaaggaaaaatactcacatgattattagaaatactggagcaataaattgtttgagggacttgaaacaccctttttttctttcccttcaaagccttaaatgatagttgcttcattgaagcttacagatcattaaaagcagtcctgccagggtgttgtaatatatgttttagcttccaattgaaggaaaatctctaccaaactaacctttgagtcatacagaattttttattttctatttttgatgtcttgggtgttccagcactttttcatcacctgccatatacaaaattcccatatcttatttgagccaaaaatgaagcctggtatcacctctaacaagtacaaattcctagcgcttttcaactatgttattatttgcctattttatttattgcagaacagttcccaaggagtaatgtcctggagaaacagaaataacactgtagaagagcagtagtgttatggacattgagagtaccattgcaaaacctgattttttttgcattttcatggcttcagtttcgagtaattgtagatggacagaggccaagctgttttcaatttgacccttggttaagctaaaaaactacataacaactaagggtaccctatctcctgttacagagatagatacataaaagggccagactaacaagaaaccaaatagccagtctggggtatggccagagaatctgtaactctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaaaaaaaaaagttactatcaaaatgtttccaaagttcaaaagcagaagaattagcactttttagtttctttttataaaatgcatctacttcaagccatagcaaatttgaagtttcagatcctctgtccacaagattgagtacttaacgatagcccttttggctccttccagatctcctaataaagcagggagctcctctcagcccggccagccaccccgtccgggagggagatggggggtcagcccccccacccggccagccgccccgtccgggagggaggtaggggggtcagccccccgcctggccagccgccccgtccgggagggaggtgggggtgtcagccctccgcccggccagccgccccgtctgggaggtgaggggcgcctctgcccagccgcccctactgggaagtgaggagcccctctgcccggccagccgccccgtccgggagggaggtgggggggtcagccccccgcccagccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcggcccccctgcccggccagccgccccgtccgggaggtgaggggcgcctctgcccggccgcccctactgggaagtgaggagcccctctgcccggccagccgccccgtccgggagggaggtgggggggtcagccctccgcccggccagccgccccgtccgggagggaggtgggggggtcggccccccgcccggccagccgccccgtccgggagggaggtgggggggggtcggcccccctgcctggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaataaataaataaaaaataaaaaaaaataaagcagggagctccttcagtgtccagcatactactctggggagaaggcctcttcatcttgtctagagcagggcttcagatatctgtgccagaggcttaggaaagacctaccacttggaatgtagaacaaaagaaatgattgttttcttttttctttttttttttttttggagatggagtttcgctctgttgcccagggtggagtgcagtggcgggatctcggcacactgcagcctctgcctcttgggttcaagtgattctcctgcctcagcctcctgcgtagctgggattacaggtgtctgctaccacagctaatttttgtatttttagtagagatgaggtttcaccatattggccaggctggtctctaactcctgacctcaggtgctctgcccgcctcagcttgttttgttcattttaaacaattttccataaatttataaagccattctccatgacatgcttaccactttcacggtctgtgtaaatctgatccatcagtaatatagtatggcagcacctaattatgtgttttgtgaaaagctatggaacaaaaagtaccacctgttacttaactccctaattgtaaaattgtgttttatttctgtgccctgaggttggaccacagtattgtgataaaccatgggactgacgggtcttgctacccattcctgttctccattaaaaaaaaaagtaatcagatttcttctaactctcaaacctctaaaagcgcttctgaaaacttagatctaactgtttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtccctggcacaaatgaagactcgctcttcttggcagcatccatggctgctaagagaaactttgccccactgcctttgatgtggtgaaacaaagcctttaccagagtggttggaggatctgtcaccctggagactcctagggacccccacccacaacctctttgggaagttcttttcctaaagttgtattcagatttataccaatatgcagaggagacgtctttcttataaaaagcttgcttttcctctcaaagctgtgaagaagctagtgaaggggaagttgaactgggtataatattgacaaatgttttgagcacttcagataaaaatgtttgataagtgcagtcctgtttgtattgccttattacactgctcattggagaaagtgttttctttggtcacctgccaatgaaaaagattagccttttcctgtatttaggattgtttctttgactagttatgttggtagaacaagatagacaaatgctgctgaaattagcaaatcagtattggaacacagtgatactcatttctcctcactgccctttccaattcattgacagttgccgcaagcagtatgaatgggttttttataggactctctttctctccttacctattccaatttgtattttcactttagttcccttgctctgatgttcaagactttaaaggatttgccactgcccaccacaccatgctttcctattttataggatccaataagaaacattttttcatttaaatgcctcttctataacatgagtcaccttttagatttctataccttgtatcttctagtttctattttagtacagaaaaattatagtttcatcttctttgaggcaagatatgaagatttttttttgccctccctcaaatttattccctgtttacagcaaaggaagccactggctgcttttctaacatttctctatcagaagctagttgagctaaatgtatatacttttatattccccttaatatgtttagattgatctggggtacatcttttggatctggacattatgaaacaaagttaagccctttaacccatcatcagcctacatctgtctcttcagacaaaaaggaaatgaacttccattgctgtaggaaaaatttatgtcacacataagggcaaatttgttagcaataatgttattcaagccaggtgtggtggcgcatgcctgtaatcctagcactttgggaggccgaggcagtggattgcttgagaccaggagttcaagaccagcctgaccaacgtggcaaaaccctatttctactaaaaatacaaaaattagcctggcatggtggcatatgcctgtagtcccagctccttgggaggctgaggcacaagaatcgcttaaacccagaggcagatgttgcagtgagccgacattgtgccactgtactccagcatgggcgacagagggagaccctgtctcaaaaaacaaacaaaagagatagtgttattcagtactgggttcctaagcagtattacagtataaccttctctgaaattctttgcttttgtttttaatagaatagattttcataaggaatggattaggtgcagaccttcttgacagcatgagataacaagttatttcttgaagtcactctttagaataaataagtcgtattttattctgagggaatttttttttttttttagacagagtcttgctctgtcacccaggtaggagtgcagtggtataatcttggctcgctgcaacttccaccttctgggttcaagcaattcttctacctcagccttctgaatagctgggattacaggtgcctgccaccacaccggctaatttttttttttttttttttttttttattttatttttagtagagatggggtttcaccatgttggtcaggctggtcttgaactcctgaactcaggtgatccgcccacctcagcctctattccaagggaattttaacattgatttaattgagagaatcaaaagagcctgagggtagtttacagagaagagcccttttaggtagtattttttatttgacttgccaacctctaattctcactgacttatggtgagtttcaagtatggatagttttaagatgtggttagttcccatgactacaaaataaaatatgaatttcccatgttacttgaagactgtttgtgggaggtcttcatttaggtctttgcatcttctcaggagcatatcataatttaatagcctgtcatcggaaccctgcaaagatagtgatattcatcttagaaaaaaaaaaaacttgcatacctcctatacagcattctttgctgccacctaaagccatttgctcatgaaacagtaacctttagaacaatagcccgagttctcttcctatcagtcaattcttagagactctattagcaccttcctttgcttttgtcctgtcagatggagagacggggttggcagaagcaaaacagcctttataaatttttcttagaggtccgtgatcctagattaaagtaggaatcagaagacatcaggtctagaaatcctcagagtgaccttttttgacagagaagatatttatatgaagaaacatcagtgccaatgacctaaatttagctatctaacctctcaatatgatcatttctctgcttgtaaaaggggaatagtgacaccaatcactaccgtcctctggagtttgagagatacttaatgaaataatgaacgtaattctcctcttgcaagggaatatattgttgacttttaggagaatgatttgggggtccctaaggggcttaacaatctattacctctctggcactcaaataggattattgtaaaaagctaatctactgccaaaaagtaagccatttattctgtggatagatcaggtccagtgtgaaaaaaaggattttgatctcttttttggaataactattactaactagataggcacaaagatgtcttttttttctttctttctttaaaaaaaaaattagaacagaagtgtaattgtgtttgatggttcactttgggagaatgttaggttcaatcctgaacacagtaaatcagatgatatacttcttttaaaaagcctctagaatatgccttctcaattgaggcaatattgcctccaagggggcaaaaattggttctttgggaggcaaaaaaaaaaattagatattataatggtttgtgacccttaaaaaatatatagatagataatatgttcatgatatcaaaatttcatggggagtggacaaatagaaaaaaggtctaaaaagctagggggtgataatgaaaaaaagactgagaaacttttctcaagtctagaatgtgcatataactgtcaattactctttcagctgtgtttgtccctaagcatgggcaagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaaaaaaaaaaaaaaaaaagccagattgggagaaagtgtggccccaaaggcatactttggagagagtgtggccccaaaggcaggaagggaataattgactaaatagtaatgtaaagtgtacagcatcggcagggtgtggtggcttatgcctataatcccagcactttgggaggccaaggtgggaggatcgcttgagccctggagttcaagaccagcctgggcaacatagtgagacctcatctctacaaaaaatacaaaaaaattatcctggtgtggtggcacatacctgtagttccagctactctggaggctgaggtgggaggattgcttgagcctgggaggtgggggttgcagtgagctgagatcatgccactgcactctggcctgggcaacaaagcaagaccctgtctcaaaaaaaaaaaaaaatgtacagaatcaaagtcaagaaaattgatgggaattgacactgaagtacttaagaaattttaagtttgctcttgctgctggtattaataaactttcatatatccaacatattcttccttccacctttctcatatgtcttattagttctttcaaacactcagaatggatggaatgatccaaaattgacttgctacatactggggaatttggaagggacctgtgttttgcttagcagccctgaaacaatagaatggccttttttttttttttttttttttttgagacagggtctcactcttgcctaggctggagtaaagtggtgctatctcagctcactgtaacctctgcctcctgagttcatgcgattcttgtgcttcagcctcctgagtagctgggaccacaggtatgtgttaccacgccctgctaattttttttttaattaatggggtctcactatgttgcccaggatctcaaactgctgagctcaagtgatcctccctccttggcctcccaaagtgctgggattacaggcatgagcgactgtgcctgataatggccatatttaaagatatattttttcctcagtctctgactcttccttgcttaatcatcctattctttaatatacaaacctataactttgaggaaagagaatcagagattatttctccctacttacccatttcatggtgcgacaatgagcactcttctccaagccaagcatttgataagcattcattgctatgggtattttactgccttaaagaaatccaccccaattccctgccgattgatttcttaagatcacagaagaaagtggaatgaatcctagagaggccttcaagctccctgacacccatggggcccactcatctccacccccaatactccaatttcaaaatctaacacattgtccttttcttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatccagcgtgttgaaatgtttgtcattttatgaccccaggaatgctgcagggtaaggcagtctgataccagatctgtgcttgcaaacccctcttgtgttcagtttacatctgtttgtctcaacaggtggaagcctaggaaaaggctatatctgctaagccagaatctggggtgggaattctccaggtcaacctgcagttcccaaatcaaaatgaagttccagagtaccagggtttgatctctcattgcccttccatcagttaccccagataacccaaacacttgtttccagtgtagtgaaggatggtttgaggatctaagcccagcttggtaaggaatgaagaaactcccatttcatgtagctcatgtgcctgccagccaccagttaagtccctgtgcctattatttagaggattcaaagagtaacaagggccaggcatggtggctcatgcctgtaatccctacactttgggaagcagatgtgaggggatcacttaaagtgaggggttccagactagcctgggcaatatagggagacctctctcaaaaacaataaataaataaaaattttaaaagtagttgggcgtggtagcctgtattcccagctactcaggaggctgaggtgggaggatcacgtgagcctaggagtttgaggccacggtgagccatgatcatacaactgtactccagcatgggcaacagacagagactctgtctctgaaaaaaaaatttttttttaattaaaagaaacagtaagtacagctatcatttattgaacacttactgtgtcctaggcatggtactaaacatttttgttatataatcctcacaataatcccatgaaggtattcccattttacagatgaggaagttgaaactcactgatttgatgtcatgggtctaagatcacacatcagcaagtggcagaagaggagctcagatttcgatctgtctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacattgtttcaacaactgaacgcctggtttattacttaaagtactatcattgtactttgtcttaggggtgggaaggagaaccgatcaaattgttgttatcacaaaagctacacctgattgtttgtaaagaaggacttctagtgaaaggatgaaagtgaaacagctatttctctttcttctatttttctccttgaaaattcagggacctaggccaagacaggcggatcacttgaggccaggagttcaagacctgcctggctaacatggcaaaaccccgtctctactaaaaatacaaaaattagccaggcgtggtgacacgcacctgtagtcccaggtacacgggaagctgagacacaaaaattgcttgaacccaggagggagaggttgcagtgagccaagatcacaccactgcactccagcctgggtgatagagcaagaccctatctcaaaaaaaaaaaagaaaagaaaagaacatgaaagaaagaaagaaaactcagggaccttacttggtaatttttacctaggcaaaatgcccaggaatgtttccacagaatggtacccaaagcccacccatgcaggagcccttcctgccaccaaggtaaccaagactaggaagcaattgaaactgggccttcctttcccaggcctgtggctgtcaacttggctcagaaagaggcagactgatgactttgtctccttacccactcacactaccacacagttctcatttgagcctggtcacatggctgtgccttcttatggccaaacaaggatacgctgtttcccgttctttgcaccctgggtttggcctgagcatccttagatgaaaccatcaggacccccaaaccttgaagcttttccaggggcaaattgcatgcaggggaaggaggggctgagctgtgtagtggagcagcggatggtgtgcagtcgggatgtttgcaagagccaaggggttagttcattgctgctttgtatactcaggcacaccagaaaactcagattaataggctgtttattcttcagcatgttccttgaatcaaaggctctggatggtattattaaagagtgtttgtgagagcgccctggaacactcctcctgggctccgctcactgaagaggaacgattgagtcctttcatttcctgggcagcatccctctcactcattgctcactgtagtataaaggtctgtagaacctttgttagaaacaggatcttttgttctgtccttatgaggtcccattacctacagcaccttgatctgttggagtctaattatttaatgttcttgtcttttgagctacctgaacctaatgaatgcagtccactctatctcagggagttgttttgctttggttttttgcctctatttggcaccagtttcctgtttggacagtattgccttttattttcatggttttttttcaaggagtttgtccaggagagaaggagacatccacctgaaacctactctgtgaagcaaatgaatatgttttttctattagaagattctcctaaaatgttctgaagtttgttcatatctgggaattgaagcacattgaattaagaaagaattacttcctccacctccacccctgcaatagagatttatactggacaaggtggcaaaaaaaaattagggggaaactgctcggtacaattcccccccagttcccttggggcagcagcgtgctgcacatgaggaatcactgtaccttgttcccctggcagtgatacttctctgtggccaggcaaatacagtagtccaggccttccacaacttctgcatgtgcgcatgtgcgcacacacacacagacgctcaaaaccatacccctcctgggcatccccttaatagaggcatccagtatattgcaaaggtactcatcactatacacagtgcaaatactcagcactcgtttatagcaaacccagtatgaataattagcaatagtttgggatctggcacaacccttaattaccacaactagaggccagaaaatgaaatcagggtcatatatctgaggttagaactctagaatctgtctggcatcctatagcccaaagcaccacagggaggtacaccttggagcaatgggagcactgtcatccaggagacactgtcccctcactttcctccaaaaccagcacagctgtttgcacgagggctatctgccgtatatacagtgagactaagatatatatacacaccctggcgcttcgcctgatttcttctgtgaagtccatctgtttatccagttccagatcccaaaaggcagtcaccaaaaactaaatagtgagaagggacaggcttttttttttcttttttgataaacatgttacagtgaacaaaacagattttgcaaacacattccatctagtaaatcttacctcacagctgtgtgagaagagcttggaggagagaaggatggggagcaggagggtctcaggacttgattggagaattagaaagttcagaaacccacaagggtgggacagttcagtactatctacttttttttttttttttttttgagatggagtctcactgcgtcgcccaggctggagtacagtggcacaatctcagctcactgcaacctcggcctcttgggttcaagcgattctcttacctcagcctcctgagtaactgggattacaggcgccggccaccatgcctgactaatttttgtatttttagtagagacagggtttcaccatgttggtcaggcttgtcttgaactcctgacctcaagtgattcgcccacctcaccctcccaaagtgctgggattacaggcgtgagccaccgcccctagcctatctacttcttatagggtgataattggccttttcccttcattctagcccctcatcctaaacctggaatctgtgatgggctcaccaaaaatgaagatctggctgcagactttggcttctttcactgaaaagctgatctagccagactttatcttcaaaagacaggccctgcacttctgatgttccctgagcctctcccactgagcctactctcgtccactgtagccatgatgctctctggattcagacaatggtgtgttgtcccagaacactgtatctggcctgtctgtgcttcacatctacccctttggctaggaaaatgagggacagagctcacatcagtaacttggattctgaggaccgaggacaagcagaagaaattgaccttttgcctcagaggtggctggatgtttgtgtgtctctcttcgatgtcaaattggctcactgaaccactcaagagttgttttttaaaaatgttctgctcactcctcatttgcgggtcagatgctttggataatccagtggaattctctctgcttcactgctggttgctgccagacacagagtgctaaatcctgtcagtcggtgacttgaaatgatgatgtgtgaaacagtgctgcgatttggacatcctgcactcatttgcatggactcctttgccagttaaccacagtagtgaaatggggcagcctggggcagcttccacagcccttgccttatctttcctcagtgtccccaccctcccccatggcagtatgtagctccagtaattggtaaggcttggaattctgtttcatttaatattattcccttcctaggcatcatagagcaatttctttaacatgctagattgcaacatgccagagacagagaaatagcatttgtgtgcagaatggagaggcgggaagcaaaacactcttgttgctgattcccatctcccggtctttgcccttccttctttccctagattgcatggctggctgattctcatctggtgagttctcagctcaaatggtacgttctcaaagatgagcctggcacagccatctcatgtggtcccaccctcagtcactgtgtatcacaccaccctgcctgatttatgtcattgctctcctcacttcctaaaagtatttctttctttgttactttttattctctgtctccccaaccactgcctccacacatacacactagaatgtaagtaccatgaaaatagggatttttatctgtcttatcccttgctgtttccccagaatctagcacagtccctggcatacctttgacacttagtatattgactaaataagtagctaagaatgtagcaattaagaacttctaaagcaaatatccatggttactatcaggaaatagtaaaggcagacagacagagagtttgaggaatggaatgagaagacatgatttcttatactgattttaataatggtcttaattacaaattgaatacgttaagtcaaagatcacaatatcgagtcgctcttcatttcttctgactcagactaaactgccccttattgagtaggttaggtcagggtcatagagaccaagtactacaaacttcctggccaaactggcataattgatgccacaaagtatgcccacttccagatttccactgggtggtgcctggctttgctttccttagggcagttgccagaagaaactggcacaatttaaagcagtttaaagcccagcctgggtatcttcatctagcctttattatattcttgcctgcctccagttcccaaaaagactgcattcctgtctgcaactccagggccctgaagccccttcagtcatgaaagccatggaggtgggttagccctgatccacccagcgtgagacagtatgaccaagagaacacatctttttttttttttttttgagacagagtctagctctgccgcccaggctggagtgcagtggcgcaatcacggctcactgcaagctccgcctcccgggttcacgccattctcctgcctcagcctcccgagtagctgggactacaggcgcccgtcaccactcctggctaatttttttgtatttttttagtagagacggggttttactgtgttagccaggatggtctcgatctcctgacctcgtgatctgtccgcctcggcctgagaacacatctttagtccagcagatacatggcactcatctcctcaagagtccttcacccaaacgagaattattagcttctcagaagttatcctttgtcttgttggggcaagatctgtgcctagtgtcaagagagagatgttaaagattaaagagcctccaccaggaaagggaatggttttgcctgaatctcttaatttgtttttccccgctacgagtgcattcatgttgctgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactccacaccccactccttccctgtcttttattgatgctatgttgactttgcatgcctcagttagttcagttttctgagcacctgcagagaattaaccatctctgcttgctgctgcggatcacctaggcctttgatctgtttgatttctgtacttctaaaaatgttgaaggactctctaaccccaccaaagtacataaatggtgctacagttcctgtagcctgacctcctccagactagctctgcttagggaacagaagatcttcatgtaaatacagatgtagataccatttattaaatgttttctatgtacgattttactgttctaagcacttaatgtgaatatttcatttaatctttgcttatagagctaaaaggccatatacatgaactggcccattatttctctaacctcatctcttcttcctttccctcttattcttttggctcctgccatgttggtttccatgctgttcctcttacccaataggcacactccctccttaagactgtaatggctattccctctgcctggaatgctcttccctcagatgtctgtatcagttactccttaaccccttcaaatcttcacttgagtgttaccttctccattaaacctacctagaccactctagagagaattgaaccaccagtaccacctcatattccctatctctgacttgctgtattctctttttttccattatatttatcactgaatctcttaatttgcctcagttaactttctatatagcttatttgtttgtttgtttgtttgttttttgagactgagtcttgatctgtcacccaggctggagtccagtggcacaatctcagctcactgcagcctctgcctcctgggttcaagcgattctcctgcctcagcctcctgagtagctgggattacaggcatgcaccaccatgcccggctaatttttgtattttttgtagagacgggttttcaccatgttggccaggctggtctcaaattcttgacctcaagtgatccgcctgccttggcctcccaaactgtcaggactacaggcgtgagctgctgcgcccagcctatttgtttattttctttatcattcattatctgtcttccccactgcaagataagctccatgaaggcaaagagcttgtctatttcttctctaatgtatcctaagcacctaaaaagtaacatgtgacacataatagatgctacataatatctattaagtcagtgaactttgtcccctaaaaacccatgctgtaggttcttctgttatccccattttgtttatttatttatttttattatattttaagttctagggtacatgtgcacaatctgcaggtttggtacataggtgtacatgtgccatgttggtttgctgcacccgtcaactcatcatttacattaggcaaatctcctaatactatctctccccactcccccaaccccacgacaggacccggtgtgtgatgttccccgccctgtgtccaagtgatctcattgttcaattcccacctatgagtgagaacatgtggtgtttggttttctgtccttgtgacagttttctgagaatgatggtttctagcttcatctatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttataatcctttgagtatatacctagtaatgggatggctgggatggctgggtcaaatggtatttctagttctagatccctgaggaatcaccacactgacttccacaatggttgaattagtttacagtcccaccaacagtgtaaaagtgttcctattcctccacctcctctccagcatctattgtttcctgactttttaatgactgtcattctaactggcgtgagatggtatttcattatggttttgatttgcatttctctgatgaccagtgatgatgagcattttttcacatgtctgttggctgcatagatgtcttcttttgagaagtgtctgttcatatcctttgcccactttttgatggggttgttttttttcttgtaaatttgtttgagttctttgtagattctggatattagccctttgtcagatgggtagattgcaaaaattttctcccattctttaggttgcctgttcactctgatggtagtttcttttgccatgcatcagctctttagtttaattcgatcccatttgtctattttggcttttgttgccattgcttttggtgttttagtcatgaagtccttgcccatgcctatgtcctgaatagtattgcctaggttttcttctaaggtttttatggttttaggtcgaacatttaagtctttaatccatcttgaattaatttttgtataagatgtaaggaagggatccaatttcagctttctacatatggctagccagttttcccagcaccatttattaaatagggaatcctttccccatttcttgattttgtcaggtttgtcaaagatcagatggttgtagatgtgtggcattatttctgaggcctctgttctgttccattggtcaatatatctgttttggtaccagtaccaggctgttttggttattgtagccttgtagtatagtttgaagtcaggtagcatgaagcctccagctttgtcctttttgcttaggattgttttggcaatgcgggctcttttttggttccatatgaactttaaagtaattttttctaattctgtgaagaaagtcattggtagcttgatggggatggcagtgaatctacaaattactttgggcagtatcaccattttctatccatgagcatggaatattcttccatttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgatttttgcacattgattttgtatcctgagactttgctgcagttgctgatcagcttaaagagattttgggctgcgacaatgggttttctaaatatacaatcatgtcatctgcaaacagggacaatttgacttccttatatcctaattgaataccctttatttctttctcttgcctgattgccctggccagaacttccaacagtatgttgaataggagtggtgagagagggcatccttgtcttgtgccggttttcaaagggaatgcttccagcttttgcccattcagtgtgatattggctgtgggtttgtcataagtagctcttattattttgagatacgttccatcaatacctagtttattgagagtttttagcatgaagggctgttgaattttgtcaaggccttttctgcatctattgagataatcaagtggtttttgtctttggttctgtttatatgatggattacatttattgatttgcgtatgttgagccagccttgcatcccagggatgaaactaacttgatcgtggtggataaggtttttgatgtgctgctggatttggtttgccagtattttattgaggatttttgcattgaagttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatccatctggtcctggacttcttttggttggtaggctattaattatttccttaatttcagagcctgtctattcagacattcaacttcttcctggtttagtcttgggagagtgtatatgtccaggaatttatccatttcttctagattttctagtttatttgcgtaaatgtgtttatagtattctctgatggtagtttgtatttctgtgggatcggtgatgatatcccctttaacattttttattgcatctatttgattcttctctcttttcttctttattcatcttgctagcggtctatcaattttgttgatctttaaaaaaaaaaaaaccagctcctggattcattgatttttttgtagggttttttgtgtctctatctctttcagttctgctctgatcttagttatttcttgccttctgctagcttttgaatttgtttgctcttgcttctctagttcttttaattgtgatgttagggtgtcgattttagatctttcctgctttctcttgtgggcatttaatgctataaatttccctctacacactgctttaaatgtgtcagagattctggtacgttgtgtctttgttctcactggtttcaaagaacatctttatttctgccttcatttagttattaacccagtagtcattcaggagcaagttgttcagtttccatgtagttgtgcagttttgcgtgaatttcttaatcctgagttctaatttgatggcattgtggtctgagagacagtttgttgtgatttctgttcttttacatttgctgaggagtgctttacttccaattatgtggtcaattttagaataagcgtgatgtgatgctgagaagaatgtatattctgttgatttggggtggaaagttctgtagatgtctattaggtctgcttgttgcagagctgagttcaggtcctggatatccttgttaaccttatgtcttgttgaactgtctaatattgacagtggggtgttaaagtctcccattattattgtgtgggagtctaagtctctttgtaggtctctaaggacttgctatatgaatctgggtggtcatgtattgggggtgcatatatatttaggatagttagctcttcttgttgaattgatccctttaccattatgtaatggccttctttgtctcttttgatctttgttggtttaaagcctgttttatcagagactaggattgcaatccctgcttttttttgctttccatttgcttggtaggttttttttttttttttttttttgagacggagtcttgctctgtcacgcaggctggagtgcactggtgccatctcagctcactgcaagctccgcctcccgggttcacgccattctcctgcctcagcctcccgagtagctgggactacaggcgcctgccaccacgcctggctaattttctttgtatttttagtagagacggggtttcaccatgttagctaggatggcctcgatctcctgacctcgtgatctgcccacctcagcctcccaaagtgctgggattataggcgtgagccaccgcacctggcctgtttggtagatctttctccatccctttattttcagcctatgtgtgtctttgcacgtgagatgggtctcctgaatacagtacactgataggtcttgcctctttttccaatttgccagtctgtgtcttttaattggggcatttagcccatttacatttaaggttaatatttttgtgtgtgaatttgatcctgtcattaagatgttcgctggttattttgcctgttaattgatgcagtttcttcaaagcatcgatggtctttacaatttggcatgtttttgcagtggctggtaccagttgtttctttccatgtttagtgcttccttcaggaactcttgtaaggcaggcctggtggtgacaaaatctctcagcatttgcttgtctgtaaaggattttatttctccttcatttatgaagtttagtttggctggatatgaaattctgggttgaaaattctttaagaatgttgaatattggcccccactctcttctggcttgtagggtttctgccgagagatccactgttagtctgatgggcttccctttgtgggtaactcaacctttctctctggcttcccttaacactttttccttcatttcaaccttggggaatctgataattatgtgtcttggggttgctcttctcaaagagtatctttgtggtggtgtctgtatttcctgaatttgaatgttggcctgccttgctaggttggggaagttctcctggataacatcctgcagagtgttttccaactttgttctattctccccatcactttcaggtccaccaatcaaacatagatttggtcttttcacatagtcccatatttcttggaggcttagttcatttctttttagtcttttttctctaaccttgtcttctcgctgtatttcttttcttttttttttttttttttttttgagacagtctcactgtgtcgcccaggctagagtgcaatggcacgatcttggctcactgcaacctccgcctcccaggttcaagcaattctcctgcctcagcctcttgagtagctgggattacaggtgcctgccaccacgcccagctaatttttgtatttttagtagagacggggtttcaccatgttggtcaagctggtctcaaacccccgacctcgtgatccacctgcctcggcctcccaaagtgctgggattacaggtgtgagccaccgcgcctggcctcttgctgtatttcattaatttgatcttcaatcactgacaccctttcttccacttgatcgaatcagctattgaagcttgtgcatgcgtcacgaagttcttgtgccatggttttcagctccatcaggtcatttaaggtcttctctacactgtttattctagttagccatttgactaatcttttttcaaggtttttagcttccttgcgatgggttcgaaaattcttctttagctcggagaagtttgttattaccaaccttctgacgcctacttctgtcaactcttcaaagtcattctctgtccagctttgctctgttgctggtgaggagctgcgatcctttggaggagaagaggtgctctgatttttagaattttcagcttttctgctctggtttctccccatctttgtggttttatctacctttggtctttgatgttcatgacctacagatggggttttggtgtagatgaccttttggttgatgttgatgctattcctttctgtttgttagttttccttctaacagtcaggtccctcagctgcaggtctgttggagtttgctggagttccactacagaccctgtttgcctgggtatcaccagcggaggctgcagaacagcaaatattgctgcctgatccttcctctggaagcttcgtcccagagggcagccacctatatatgaggtgtctgtcggcccctactgggaggtgtctcccaattaggcttcatgggagtcagggatccacttgaggaggcagtctgtcctttctcagagctcaaacgctgtgctgggagaaccactgctctcctcagagctgtcagacagggacgtttaagtctgcagaagttgtctgctgccttttgttcagctatgccctgcccacagaggtggagttagaggcagtaggccttgtagagctgcggtgggctccgcccagtttgagcttcccagccgctctgtttacctactcaagcctcaccaaaggcagatgcccctcccccagccaggctgccgcctcgcagatcaatctcagactgctgcgctagcagtgagcaaggttctgtgggcgtgggacctgccaagcttggcacaggagagaatcaccttgtctgccagttgctaagaccttgggaaaagcacagtatttgggcggagagtgtcccgtttttccaggtagtctgtcacggctccccttggctaggaaagggaactccccgaccccttgtgcttcctgggtgaggcgacgccccaccctgcttcagctcgccctccatgggctgcacccactgtccaatgagtcccagtgagatgaaccaggtacctcagttggaaatgcagaaatcacccatcttcggcataggtcatgctgggagctacagaacggagctgttcctattcagccatcttggaacactgcccacttcttttttttttttttttttttttttttgagatggagtttcactcttgttgcccaggctggagtgcaatggtgcgagctcggctcaccacaacctccacctcccgggttcaagcaattctcctgcctcagcctcccgagtagctgggattacaggcatgcaccaccacgcccagctaattttgtatttttagtagagacagggtttctccacgttggtcaggctggtctcgaactcctgacctcagatgatctgcccaccttggcttcccaaagtgctgggattacaggcgtgagccaccatgcccggccttatccccatcttaatgatgatggaattgaagctcaaaaaatttaagtaactaacttgccccagatcatttgtctagtaaccagtggagctgagctatgaacccagaacccaggattgactaactccaaaaaatgtgctttcaaccatgaggacaatcctaagagtcacctgagctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataaatggtttagagacagtaaacatccaaagacgcagaagagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgtttaccctgtctaatctgtattgggcttagaaactagtggccaagcttgttaaaactgcgagtataatcagagtatgtcttggaaccctgtaagttagccacacgagcttttgtatgtggacttcatgaaatcttcttgcctacttggagacttattgacatttagatatttggcattgcctattagttaagttttaaattgactagatattactgtgtaaggtacagatacctgaaaaaaaattccattattctcagctttggaagttgatccaatctatgacttcacaacttaaaagagccttgggaatcatgggctcataggtctggccttttactctcaagtaaatagcaattgattattatctcttttttacagacaaagaaattgatccctaagtgtaagtagcttgttcaagtgaggtagtctggcaaagtcaaggcagagtttcaagtctcccaagcctgcccttccgctctgccacactgttcccaggaggaaacaatcatcttaggctgtagaaaggaaggaaaactatcaataaatatggttaaagattagaaaaatggcccagcacgatggctaatgcctataatcccaacactttgggaggattgcatgagcccaggagtttgaaaccagcctgggcaacatagtaaacacagtgacatccctacaaaaaaaaaattgctgagcatagtgatatgtgcttgtactctcagctactctggagactgaagcagaaggatcacttcagcccaggaattcgagggtgcaataagctatgatcacaccactgtactctagcctgacaacagagcaagaccctgtctcaaaaaaaaaaaaaaaaaaaaaaatatatatatatatatatatatatatattagaaaaatgagatctatggaggatattgtaactattcagttctatgcccttattttgatagatgtttttcctgtcactcctgccctcatttgaaggggtttataaccttagtatgccatcagtgagcctgaacatctctataagggaggaccaaggggcattataataagatccaaaaacatagaattataaaagatgatgatcttttcatcatggatgaaacaaggtgtagggaaggaactaaatggcattcaggtgacttagagggggaagaaagagccactgagaacgagggacatggaaacaggtttctgaaggaagatacatacttgaccatctctgtggatggtttcctgcctgccggcctgccatccttccttccacagctttgttaagatacaatttatataccataaatcaaaatggctttttaaaaaataaatcttcttaaataattcttttttattttttattttttttgaggcagagtcttgctctgtcacccaggctggagtgcagtggcatgatctcagctcactgcaacctccgcctcccaggttcaagcagttctgcctcagcctccctaatagctgggattacaggtgtgcaccactgtgcctggctaatttttgtatttttagtagaaacgtggtttgccatgtcggccaggctggtctcgaactcctgacctcaagtgatccaccggcctcggcctcccaaagtgctgggattacaggcatgagccactgcagccaaccaaaaaataaatcttattcttctgattgcaagaaagcacatatcatccacggtccccaaacactgagttaactactatttttaactctgttgatgtatcccattcttttccctatgcaaatttttattcttttttttgttgttattttaaagcaaacatggaaccatactctatatgacaatttttattttgctctttcctcttaatatcatgaggtcatgtactttgttttcatcttaaactcatttcatcagatgaattaaatctttattgtaaaagcttccaaagagaaattcctcatctggggttgaaaattcagatgccaacactggccaggcaggtcatataagaagcatacgtgttattcggtggtaaactggcaacagcatcctcttccccagctccagctgattgtggtcatgcaggaatgctggcccatcattaccaggtcttctgatttttttctaaaaaagagagctatctgaaatctagattgtgttgtgggaaatatcttaatgttttgcctcaaaatttaaaaagtacacttcaagccaaacaaaacctggctgccagctatattctctgtcccagacagtgagtgctaagagtttcacaagcattatctcatgtattcttcacagcagtcttgctcctctaatggttatttattaggaaccaacaatgaataaaaaatcaaaatccttgctctcttggagcttctgttggggagacagttactgctctggagaaaaaataaagcaggaaaacaagatgggggtagagggagagttcacagcattcccactctgctagcaagttatgtgctagatggtcagattatgactgggcaccgtggctcacgcccgtaatcccaacactttgagaggccgaggtgggtggatcacctgaggtcaggaattcaagaccagcctggccaatgtggtgaaatcccacctctactaaaaatacaaaaattagccagtgtggtggcttgaacccgggaggcggacgttgcagtgagccgagatcatgccattgcacttcagcctgggtgacaagagtgactctgtctcaaaaaacaaacaaacaaattatgcgctacccagtctttgtgctacttcctcaaccacagagaatgacaatgaaagaatcctagaatgttaaacccaaaagcaaccgtcacaattattgagattaaaaggtttgtacattttcaaatagttcttaatggtcttactttttttttttttttttttttttttttgagacagaggctcgttccgtcacccaggctggagtgcagtggtgcgatctcggctcactgcaacctccacctcccaggttcaagcaattcttctgcctcagcctcctgagtagctgggattacaggcacgtgccaccacgcctggctagtttttgtatatttagtagagacggggtttcaccatgttggtcaggctggtctcgaactcctgacctcgtgatctgcccacctcagactcccaaagtgctggggcataagccaccgcacccggccttaatggtcttacttttaaaaaatcctttgatgtcttctcattgctcatacttttgtttactttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgcattttaagaaaatcaaatgcataatctgttccacttcttatttattctgtggctgctttggacagtggaaagctcagaggaagtataataacttttattcatttttgttttctgtggcttgctctcttaagttctcatcagacagctttgctaataacataaaatttcatcctaatgataagcctgattttaaattgcaaagaaaaaggtagtggggccaggagcagtggctcacgcctgtaatcccagcactttgggaggccaaggctggcagatcacttgaggtcaagagttcaagaccagcctggctaagatggcaaaaccccgtctctactaaaaatacaaaaattagccgggcacggtggcacgtgcctgtaatcccagctacatgggaggctgaggcatgagaattgcttgaacccaggaggcagaggttgtagtgagctaagattgtaccgctgtattccatcccgggtgacagagcaagactctgtctcaaaaaaaaaaaaaagtgggaagtattttttatatatataaatgaaatatacttttctcttcctaatctgtgtctagtcctgttaaaattgcagatacaggcttataatggctttaactgtttattacttttgttgtctcttctctattttcttataggcatcagtagcaagtcacttaaaatagaaagggcctgtcagtttgaggggaagcaagttacaagccagacagactacatctgaccctggagccaccctaggacaaaaagtgatagaaagagatggaatagctagtgggagatttaaatgttcacagtaatagtcactggccaggtgcggtagctcacacctataatcccaatacttcgggaggccaaggcagaaggatcatttgaggccaggatttccagagcaacctgggcaacatatcaagactctgtctctagaaaaaataaaaatgaaaaaattagccaggcatgatggtgcatgcctgtagtctaactacttcccgcctaggctaaggcaggaagagctcttgaacccaaggaattccaggctgcagcgagctatgatcataccactgcactccagcctgggtaacagagcgagaccctatctctaaaaaaattaaaataatggccagcacggtggcttatgcctgtaatcccagcactttgggagaccgaggcaggtggattacttgagctcaggagtttgagaccagcctgagcaatatggcgaaaccttgtctctacaaaatatacaaaaattagccaggcgtggtggtgtgtgactgtggtcacagctatttggggagctgaggtgggggggattgcttgagcccaggaggtggaggttgcagtgagccaacatgacgccaccgcactccagcctgggcaacagagcaagatcctatctcaaaaaaaaaaaagaataaaattaaataataaacaaaataataatagccagttgcagctaacatttactgggttctcactgtgggaattcactgtgccaggtgtttttcatccatagacgaaggaaaagcaggttgggttcccagagacttacagcaaaaagaaaaggacatcatagggagccagtctgtgtagcagagaaaggccagcctttgaatgagaaggcttgatctgatccaggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaaaaaaaaaagattttttaatcctctcaaaaattcatgattagcattatcattattcataccattattactattattcactgtcattttcaattggctcgcctaatgtcacatggctagttagcagaagaaccaggatttggacccagatcggctgattcaggagccttgattattattattattttttttttgagatggagtctcgctgtgtcatgttgcccagactggagtgcagtggtgtgatcttggctcactgcaacctccacctcccaggttcaagcagttctcctgcttcagcctcctaagtagctgggattacaggcatgcgccaccaggcccagctactttttgtatttttagtatagacgaggtttcaccatgttggccaggctggtcttgaactcctgaccaagtgatctgcccgcctctggctcccaaagtgctgggattacaggtgtgagccaccatgcccagccttagcctgtactcttaaccattgcactatgtaagacccacttaggttttagggcctaactgccctttgtagagctctagagttttaaggtagcacctcaggccttctttcctcgacttctcgtctgggtgagagctgttgaagagaaagttggctaaaaaaggctttgtttttataaatattaaatattgagattccttacaagattttcatttgttatctctttgagacagggtctcactcagtcacccaggctggggcgcagtggtgcaatcatggctcattgcagccttaacatcctaggttcaagccatcctcccatctcagtctcttgagtagctgggactacaggcgtgtgccaccatgcacagctaattttttcatttttattttttgtggagatgaggtctcactatgttgcccaggctggtcttgaactcctgggttcaagcgattctcccgtcttggcctcccaaagtgccgggattacaagcatgagccattgcgccagacctagatttctattttttaaaatgtatatatattaaaacatttttttcaggccgggagcagtggctcacaacatccttattttacaggtgagaaaactgaggcctagaaaaattgtgcccagataggtataatcctttgccgaagtcagaccaagttcttttctctatcatgatgtgtctctgtagtaaacttttgcccccctaaaacaacataaaaaccttcattctggctttaaacaccccccagaaataaatttaaaattctgcctctttttcaaaggttgagtgaggtatatcaccattgggagggtgtgatgttttctcttgcctttagtcaccattaggagggattaaggtttattctccagtttagctcttgtgcctgtttaaccatttctgttcaattaagaacaggaatgggttgcaggagtttgtaacaacacctgcttcttggaggagaattataacttggccctgagttgtccgtttcaaagggcccaccctgtcctcctgtttccaaagaaaaactggaagtggtaacacctggtggagctgcatgagcacgtgagtggtggtgcaaattctaggctggagtcacttctttgatgggctgccggagcctttgagagcttatggtgccaagatcctgctctacattctagtgtccaaaactgccttccatttcctcaataatgggtaggaaactgtgtccatgccagagtagctagccccgttgctactagagaggctttcttttctcctagcactggtgcctccttccacaatgcatacggctgcccaccctcgccatatgcagcctgtgtttcatatcctcacactttctaagacaggacctcccccagaacaaagccttgccttggtcctccaatccctaatggccccatcgtgatgaacagacccccaagggttcgacacagtataggggattcttatcagaccaggcctgtggtttaagccaccagtggtggttcaggatggccatggttagcctaaaaacctgatcagattgccatggtatgtcctacatgaccctgggtagaatgttgagatcctggttagaaatgcctgcatttctttaaatctttacctgctgtatataaacagttcctggagagttgtttttgttcattttaaacgttgccataaaattgttactgtgtctgatttaatactttgcctagaacaaagatactgccaaatagaaatagactaaatacatttctagcttggtgtctggcttagtcataataaaatataaaactaaaggggcagccgggtgcggtggctcacgcctataatcccagcactttgggaggccgaggcgggcggaccacgaggtcaagagatggagaccatcctggccaacatggtgaaaccccatctctactaaaagtacaaaaattagccaggcatggtggcagacacctgtagtcccaggtactcgggaggctgaggtaggagactcgcttgaactcgggaggcagcgtttgcagtgagccgagatagcgccactgctcttcagcctggcgacagagcaagactctgtctcaaaaaaaaaaaaaccaaaaaaaaactaaaggggctttctgcccccattggaacacactgaagatgctctggggagtaatgagctggcaaagggtagtgttcataatggcccaaatactttaccccacaggtgtcattcgaggccattgcctcttattccttttgtaaggtcatttcccattcagtcaactaattatcatttccctccatttataatataaaacaacagtgctgccagaggagataaaattgaataacacagccttctcttcttctggggctttgcttgacaggaacatggccctagtagggtagcaatctttctgtgacatgtgataccaactgctacatggggagtgaagtcgtcagatgtcttgcctccttcttcccttcccccacactgtccctcactcccttccccctcctcacagagtagcactgagaagtatttactcagctgtggcctggtaacaaagccttggtgccccagggattggaaggggtggtgtggtcatgccccgaactatccatgtccttccgagcatctcttggcagagcagcctggctgaggatgagtgtcatttagagtgagccttcacaacccctgcataaaagaacataaaaacaattgcagctgaaaattggagagtccacacatgggctgtggtattctctggcctctgtggtagtactattgagatcatgcagccaacaaactagaggctgttcagtcctctgggactcccatggcttgtagcatttcattatctttagctcttgtccagcactagctcactcaaccaacatataggcactcacacaaatgaatttagactgagccccatttcatcccccataaatttagagctaaaagtctttgacttcaggctttagggaaggttttctctgaaggaatgaatatatggccccacttccttccatctggcactcctccatgggtattctttagtgacaccactgtgatcctggcaaaggtaccatttcccaggaagaggagaggtatccgatctacagctatattccaccacagttctgagcaaatgtggacacgcatggtggtctgcaaggaggatgtagaaatgactaagctgctcccacagagcttcagaagcaggacttgccacagcaagaaggcagaccagatgtcaaaaagacatccttttcctacaaatgagaatgagttagcccttgaatatattgggaatcaataatttctgactaattttcttagctaaagtaaattcatctaacactctctaggattagagtggatataaccaacagaagaatattttgagtcagggcagtgcttatcttgaaagcagtagtattcatgctagagttgtaacagcaataaagtgaatttctgtgaagtgaaccctaggcttcctttggttttcatggaaaaatcagtgacatggcctggcgcagtagctcatgcctgtaatcccagcactttgggaggctgaggcgggtggatcacctgaggtcaggagttcgagaccagcctggccaacatggtgaaacctcacctctactaaaaatacaaaaattagcctggcgtagtgatgcatgtctgtaatcccagctactcgggaggctgaggcaggagaatcgcttgaacccagtaagcagaggttgccatgagccgagattgtgccactgcactccagcctgggtgacagagtgagactctgttaaaaaaaaaaaaggaaaatcagtgatacattcttatgaaaagaaatattcaagctgattgaactgagcacttggtgcaaaggccaacaagcccatgaagtgtagtacactggtcatggtttatcatgtttactgacagttatagtacctagcacgtaggggattttccttttttcacactttacaactcctggtttctcctcatacccctgtaattttgcagaaatgcctcctgtgcctggagaccccctatctttgtgttcacacagtaaccagaactttttccctatgaatttttatttgggtcactgtgtgaggcatgtttttatttattcattccttcaacaggtgtttactgcaatgcaccaggcattgtgctgattgctttagctaagttcaaagattccttaatttcaggacttcaagttttaatcagttaataattataaaataatgctaccacttattgagcactttgctaacttttttcagaaaagtgtatatgttacctcttttgatcttttacaacaattccattaggtaggtactgtagttcttacacttttaagacaaggaaaccaaggttcagggaagttgtacagcttgtctaagtcatgctggtggcaagtagtggagccaggtttttgaagccaggtcatctgattgcaaagtcagagttctgcactaatacaactgccctgcccaactaccctgtgctgtttaaagtggcctgcctgaagggtacctgtatgtttaacttagatagaaaatctgtcagtcacctggtgtgaataatcctaacatcagaagtccttcacaaaccagctggatcccacctgctagggtggaacttgcaggaccttcagagcctgtgctaggcctaggtctgaatctcagccctcttcctagctgtttccttgagaaaatgattacacctcactgagccctagtttctttatttctaaaataataatagcaagtactaacagatggcccttacgatgggtcagacactgttctaagcactttacattaactcataacaactctgcaatgttcatactgtcatttcatagatggggaaactgaggcatggagagcttaaaagtcaagtaacttgaagtcagtggcaaagctaggatttggacccgaacaatctaactccaaagtccatgctattaaccacaatgctatgctgtgctgcctctggagaagataggatcaagggtgtaaaacacctctggtctggagccagccacataattggtgagactagtgcaaggcttagaagaagaaagtttagcagtctgaccacccacaaaaggagacacacaaatttgtggagagtgttctgattttgatcttacaccaaagccttattatgtctttgcctttgaacttgcaggacctactggctgacactcttctaattgtggggggatctagagaaggtgtctactgatacacaatacttacctcccctgcacctgccaggtagaagagtggctggcaggtgggtggggatgagagaccacggtgtggccaccagcacagtggtcccccagcccatgccctctggcctgaggctgctgtgctggagcctcagtcttccctgttgacagtaattagaacttttcagactcggtttcttacatggaaaatctcaattcacttgaattgtctccttgatccagttcaactggagctatttagttcctgcagttagtttggaggggaaaacaagctcttaagcctcacacattatagctgataagatcaaggtgctgacagtgttagctgggtaggctttggagccagactgcctgggtttgaattccagttctacctcttaagtgtgcacaatctgagtttttgtgtctgtgaaatgaggataatagtcgtgaagattagtgaggtgacatatgtaaaccccttagaacagtgcctccccaagaccaagtgctcaataaatgttagctgtgttattgttaagcccctcctgccatcagcctcccttctctccctcccaccctgagatcttgctcagggaagacaggtccccttcctctcccctaccctggaccctcctctctttccttgctcaccagcttatttcatccctctaaactttctcatcctcatctgtgaaatgggactggaaataatggagtctacttcataaggtagtatgctgtgaaggctaagtgagttaatttttttttattttttatttttttgaggggggaaggagtctcactctgtcacccaggctggagtgcagtggcatgacctcagctcactgcaacctctgccttctaggttcaagagattctcctgccccccaagtagctggattacaggcacctgccaccatgcttggataatttttgtatttttagtaaagatgggtttttgccacgttggccaggctggtctcgaactcctgacctcaggtgaactcttgccttggcctcgcaaagtgctgggattacaggcgtgagccactgcgcctggcctaagtgagttaattcaagagctgagcacagatctccatggctactcactctctttacagttattgctggagcacaaagggctgtgagaagggcctttgagatcttggacagttctaagagccaaagggcccaaaatagacaggagcattagggtgaactggtgcccaaatgcaggctgcagaagctagggggactgctaccttgttcatcataatggggagcctggaacagagcaggcacatgggaataggaagtgagtggccactgcaggagagtgttcaaaacggatttggctcaggcaacccaacagagaactttcaaggcagaaaacttttaggtgtttaagtgtccaaactcagcaacagccaggctcatgcctgtaatcccaacactttgggaagctgaggcgggaagttcaagactagcctgggtgacggcacgagaccccgtctctacaaaaattttttaaatgcgcagggtgtggtggcatatgcttgtagtcccagctacttgggaggctgagatgggaggatcacttgagctcaggagttcgagactgcagtgagctatgccactgcactccagcctgggtaacagagtgaggcccccatctcaaaactaattaattaattaattaattaaaatttaaaataaaaaaaactcagcaacaaataccttcctcctctcttcttctcacctccagaatttgaaaacagaaccaaaacaaactcccattgtttgatgttactaagttctagacattctgctaagcactttatagacatcatctctcttacacttgactttaaccctgagaagtgtcagtgtcacttgcattttacagatgagaaactgagacttagagagattaagcaatttgcccaagattacatacctggtgaatcgcagagccaaaatttgaatcctagcctatggagcagaaagggaacaagctcccatatgcctatcagtgttctgattttgaaataagtcttaccacttatagttctctcaatacccactgtacaacagctgaggagtgtctcgaagtagcagaaatcatctgcccttgacattatctggtcactacttcagtagaattagaactcctctctccacatcccaacacagagtctgcatggaagaataataataacaactaatagaactactctctccacaattaaaagttgtttatttgcttgcattttcattaatctctttatctgactactgtcctcacttaacatttagaagagtcaagttccagaagtggtgagcaggatgtattctgtttttcatatttttaagagcttttgttgtgttagagaagcacgcagtgatttttgtaaatcattcttctgtccttggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctgactctccctaagaatgctatcagatatatccaccaaagtttagcctagaaaagcacgatgattcaaagatagaactttcctttatttactccctgccctgccagaaatcactcttctcttttctctacatggggagttctggagtgagaataaagtgggaacacattagactcagtggattttctcccttcccttcgcctttttcctcaccccaagcctgagaccacgagtggcaatgactccctcccttgaagaacaagacctcctgccaggctgtgcccgaggtcaggcaagtgggaagaggagagtgccacaaaaccatcttgatcctttgacctatattgacgctgagtctgttcctttggtgtttctgactttggcagtgtggttagtcaaactctctgtccccaccttgaattaagctttgatgaaaaagtactaggaacccaggcctttccctggagatttggggtttttgtcttggaaaagcatcaaccaaactaacgggggcaggagatctggattcctgtggcttgggctaacttaggtccaaagaaaccaagtgcctgtgatcatcatcttcattccccaaatgtagccatgccctctggattccctcctctcactcatcctcctcccaattaggcaggcttccgggtggattgctctcactttagcattaccaggcccttccatattcgaaatgctttgatatatgataatacttacacattcttactccttggctgatctaaaatcttttgccttcagtacatgcagcaacaaaataacttaagcatcagtgtatttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggatattctgagaaaagaggggctgcatttgtgtgttttcacgctactgtaaagatactacccaagactgggtaatttatgaagaaaagaggattaattgactcacagttccgcgtggcctcaggaaacttacaatcgtggtggaaggcaaaggggaagcaaggacctttttcacatggtggtaggagagagaagtacagacaggggaaatgtcagacgcttataaaaccatcaaatgtcttcagaactcactcactatcacaagaacagcatgggggaaactgcccatgtgatccaatcaccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcccctgaagccaggtattcaagaccagcctggcctacatggcgaaactccatctctactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgtctcaaaaaaaaaaaaaaaaaaaaaaaaaaaaaaaaacctgagctagggttgcaaatggacgtacagcaaaaatcatgtttatcgaagaatgcctaccttccctatatcatactgaatgcatttaccttcattgttctatttaaatttgtttaccttaactatctcacctaatccttgtaaaaactgttacttccctttaaaatgatcctttgtggtttctgtggggagcctccggctctgaagacagagttggagggtggtgagagtattaggcaaacaacaaaacacacacacaaatacatacccacactcccacacacacccctagaggatattctgagaaaagaggaggcaagggttggcagtgacttgtgatgaagagggttgcggttggagaccagaagggcctgaaagcagctgggcgtggtagctcatgcctgtaatcccagcactttgggaggccgaggtggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacctgggaggcagaggttgcagtgagccgattgtgccactgcactccagcatgggggacagagtgagactgaacgtcaaaaaaaaaaaaaaagggagcatgaaagtgatgaaccccagttgagggaagggtactgttactgctcacttcactgaagtgggaactgaggctcagacgggtgacaatgttgtgcgaatatactgatagcttgtaagtagcagtggcagaactggaaccgcagtcagcctgaatccagagatgggggatcgggagcacaaggagtctcttcatgctcccacctccctgtgtcatggcatcatttctgctttgtggtttgacccactgaaaacaaagctgcattggctgcactgcaccaagaatcacctcgctccttttgaaatgtgccaaccagctcctctattgacttggaagatgggaactccattgctcccagtgacagacaccagcctcacggtggggcacggtgttttgcagctaacagctcatgacctacttttgctggtcatgtgcaaaacctgtttagtgatcacacatgcaaaattttgtaggtttttttctccctcattattcagtggataattttctttcctgatggcaactggccactggtaaaagccgcagttcaggttttataattttaatttatctgctatccaaaggagatttggatattttttttcttcactgaaaaaaaaaaagtatgggagattatctcttgtaatttaaaagcagccaaatggagttagctttaaatttccatgatcgttcccctttgggcagaaatcattttattaaaaacatttttgtttgtttgtttgttttctttgagacagaatctcactctgtagcccaggctggagggcagtggtgcaatcttggctgactgcagccttcaccccgcctctccctgggttcaagtgattctcctgcctcagcctcctgagtagctgggattataggtgtgcacaccatgcccggctaattttttttttttttgtatttttggtagagacggggtttcaccatgttgcccaggctggtctcaaattcctgacctcaaaagatctgcccacctaggccttctaaagtgcctgggattacaggcatgagccaccacagccagcctgggcccagattgttttaaggaatattcagccccaaaatctggggagataaactcagcatccttaaagaccgaacttaaggccgggcacggtggctcacgcctgtaatcccagcactttgggaggccaaggcaggcggatcacgaggtcaggagatggagaccatcctggctatcatggtgaaaccccatctctactaaaaatacaaaaaaattagccgggcgtgttggcgggtgcctgtagtaccagctactcaggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaattgcttttaatatatttccagagttgtgcatccattaccacagtccattgtagaatgttttcattaccctaaaaagaaatcctacaccccttagccattactcttcagtccccactccaccgtcttccccaaccctaggcaacccctaatctactttctggctctgtagatttatccactgggcatttcaaataagtagaattgaggccaggcacagtggctcatgcctgtaatcccaacacttggggaggctaagtggggaggattgctcaacatggtgaaaccccatctctaacaaaaatacaaaaacttagccaggcgtggtggtgtgcgtctgtggtcccaattacttgggaggctgaggtgggagaattgcttgagcctggggggcagaggttgtagtaagctgagattgtgccactgcactccagcctgggcaactgagtgagactctgtctttaaaaaaaaaaaaaatcaaataagtagaattgtatatgtggtcttggccaggcatagtggctcacgcctgtaatcccagcactttggaaggctgaagcaggaggatcatttgaggtcaggagttcaaacccagcctggccaacatggtgaaacctgtctctactaaaaatacaaaacttagctgggcatggtggtgcacatctataatcccagctactcaggaggctaaggcaggagaatcacttgaacccgggaggtggaggttgcagtgagccgagatcatgctgctgcactccagcctgggcaacagagctagactctgtctcaaaaaaaaaaaaaaaaaaaaaaaaaaccacgaccaggtgcagtggcttacgcctgtaatcccagcagtttgggaggccaaggtgggtggatcacgaggtcaagagatcgagaccatcctggtcaacatggtgaaaccccatctctactaaaaatacaaaaattagctgggcgtggtgatgcacgccagtagtcccagctacttgggagcctgaggcaggaaaatcgcttgaacccaggaggcagaggttgcagtgagccgagatcgcgccactgcactccaggctggtgacagagtgagactccatctcaaaaaaaaaaaaaaaagtgttttttttgtgactagtttcatgttttaggttggtgtaaaagtaattgtggttttgccattattttcaatggcaaagactgcaattacttttgcaccaacctaatagcacaatgttttcatggttcatccatcttgctgtatgtatcagtacttcatttcgccaaatgtttcttgagtgcatattttgtgccgggagctattctgcaaatggggatacagtcatgaataagatatagttcctgcccctcaaagaacttgatatagaaggggactgcttaggtactggtcattggctgccaccactctgtgacgtatgaccttggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcaggaggaagcatcgtagccagtccatatcaatagcagtctgagggaattatgggaatggcagtaacaacagaagggccaagggtaacccacatggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaaaaacaggaaaagaaaaagcaaacagactccatgacagcagccaagccagagatcccctccacctcacatattcctgcagcaactggagtagttcttttatccccagatgatcaccacagcatctcccactccccatcctccatggactggaagctttctggatggttaagagcatgcagttggaaccagacttcttgagttcaaatcctggttccacaatatactagctgtgcccttgagaaaggtatttaatttgagcctgtttcctcacttgtaaaatgggaataataatagttgtaatgattgaaggagaagtatatgatgtgcttaaaatggtggctggcacagagtaaacttgtcataatcgttagaaatggtaatattaaccttgacctagaagaacacaggccccatggcattagaaagatctactgtacatcccacctgtgccccattaactggatgaccttgaggatatctcttaacttctctgagccctgtttttatatctgtaaaatggggatgataataataatagtaactaactcatagggtgtttgtaagatttcagtaacaccaacaaaaccatgaacactgcttaccacattgtagacattaaatcagtaataattttttttttagatgaagtcttgctctgttgcccaggctggagtgcagtggcgtgatcttagctcgctgcaacctccgcctcctgggttcaagtgattcttgtgcctcagcctcccaagtagctaggattatagatgcccgccaccacgccttgctaattttttgtatttgtagtagagacggggtttcaccatgttggccaggctggtctcgaactcctgacctcaagcgatctgcctacctcagcctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgggtggggtggcacgcacctatggaatcccagctactcaggaggctgaggcaggagaactgcttgaacccgggaggcagaggttgcagtgagctgagatcgcaccattgcactccagcctgggtgacatagcaagactctgtccctcccaaaaaaaattatttaaaaaatgttattattttttgaaatgaggtcttgttctgtcacacaggctggagtgcagtggtgcattcatagctcactacagcctcaaactcctgtgctcaagtgattttcccacctcagcctcctgagtagctaggaccataggcacgttctacaaagcccagctaattttttattttgtagagatgggggcagtgatcttgctgtgttgctcaggctggtctcgaactcctggcctcaggcattcctcctgcctcagctttccgtaaattattttattttattttattttattttattttaagatggggtcttgctgtgttgctggggctagactcaagctcccaggctcaggcagttttcctgcctcagcctcccaagtagctgggactacaggtgcacaccaccacacccagctaagaactttttaataaagaattcctacaaattggctgggcacagtggctcacgcctgtaatcccagcactttgggaggccgaggcgggtggatcacctgaagtcaggagttcaagaccagcctggtcaacatagtgaaacctcctctctactaaaaatacaaaaaaattagccgggcatggtggcgggcgcctgtaattccagctacttgggaggttgaggcaggagaatcacttgaacccgggaggtggagattgcagtgagccgaaaccgtgccactgcactccagcctgggcaacaagaatgaaactctgtctcaaaaaaaaaaaaaaaaaaaagaattcctacaaatcaataagaaaaagattaaggatctcagtagaaaaatagtccaaagatataaacaggcaatgcacagaagaacattagtaataaacctttgggcatattttcatgcccacactcactagtaatcaggaaactcccaactaaattgagataccacttcatacctatcaaattggcaaaaattttaaagtctcataatacaaatattggtgaggatgtgaaatagtgggaactctcataaactgtgtgtgggagtgtaaattgttacaattactttcagacaatttaggcaaatttttaaagttcaagagctactcctgggaataaggaaacatgcagtattgtttgtaatggccgccattggaacaatctgcacgtccctctgctgaaggaaagaataaagtgtggcatattcataccatagttgtggaattctttccagcagctaaaatgaatagctatatatgcatcaatcctgatgaatctcaaaatatcaaagttacagaatgacacagagtttgagaaaaagcaaaacaaagctatataatgttttaagaacacagacatttgcatgagttaattatagtataaagacatgcagaggaatgctagactcccaagttttagtaaatcatggtgatccccccaggaagaaaggtagaggataggatgagggaggggtgcacaggtggctgaaatggtatctgtaatgctgcattttacaaagcttttaaaaactgaagcaaagatagtaagacgttatggtctgataaaattggctagtggggacacaagtgtttgttatgttattctctgtagttttctgaggttctaaacatttcctttaaataaaaaatgatggggggattaggtagagagcaatgagagcaaaaagcatttcagggaaagtaagcagcatggaaaagaagctaggctctcaccaatgatggcctggaggaaccaagagaagccagtaggtctggaatttgaggcatttgagggcagagggagggaaagtggggctttacaggccatacattgggtttgggtctttattctaaggtctgtggaccagttcacccctagctctcaggcttcttgggaagttccagagtaatgacaccttcaggctgtctacagggaagcagcagcacccaggccaaatcttccagtccttctgcgggcagctgctctaacaaacactcaggctgggagaagggaaaggggcagcaggaaggcttcattaccacgagacagcacagagtccactctttcttaccagaagtggctgcaggtggtctcggaactgtgactagcgtcagagaggcctgtatttgaattatagcttttttgctcctagtttgtaacctgagtcaggtttcttaattcctctgaatgtctgcgttctccataaagatactcactgaactgacctcataggattaatacgagcagaaaatgaacttatgggtgtgtagtgctgacagagtaagcccttggtgaatattcactattattatcatcatcatcatattgtttcccacaccctctggatcaagcgtcttaggcatttcagggcaagtagggtttgggataccctggaggtgcgggctggagctagggcagagcaatgacctggacaccccacgccacttcaaggccctaggctagaggcagcttgtgcagcacgagtgtgcctccaacacagtccagaagaggagcaaccctcaggaaatggcccaggacaccttcatagcggcctttttcctcccacctggagaaggtaaccagacatcgtgtcatcgctgcttctctcatggccctgacattcaaacaaaaaccctagaggtgcactgtgagcccaaacagacatggggacacccttcagccaccccatgactgccaccttgacctggggacacccttcagccaccccatgactgacaccttgacctgaggacaccctccagccaccccatgactgacaccttgacttgcggacacccttcagccaccccatgactgacaccttgatttggggacaccctccagccaccacatgactgacactagtcatgtgacctcctcaaagaagtccagtcatggaaagtggctcttctttctggccgtggctgagggctggcttcccccaaaagtaaactggaaactagatcgctggcttctgcctgagacctctgcctggtggatgctggcagcacgcatttcctctgggctctatttttatttgctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtggccagtctctcagaccagccacgtgctctttctccactccagttgcctgtcctaggctccaccccacacatggttctgctcagcacagcctgaaccaaagtgcctctacttctccccaagagtccctctctctagcccggaggcatggtccgcaagggtccctccatgatccaatagatttgtgcagactctcactggcagcagctccctgttggctccacttcaaagcaggggcggccgggcacctccaggtgtcagaagcagctggcacgttagcagaaggcctctggcaggaaggggtgttgagccaactgccagcaactggaaaacagcacatggggatgacctcgtctccaagaagattctttcccgagccctctgggagtggcaatgagcttgagttcagaaggaaggagctgtctgtggggatagaagggttgcaggcaaaggcaaagaggcaaagacagaccaggagcttcctgcttgccttttcccatagttctgctgagattccaaagcaagatgcagatgcccacagccagaaagatcccataggtgggttaaagacacagatgcctagaactttcatggtctcagcattcatttggagacagacagcacagcatatgatgtgattaaaagcacctttcagtaagtcttctgcagccatagacctctgaacatcaaactgtccccccactagatttaacactaacaggaggagctgttagttctgtccacccttgggacaacactgtcagagctggaagaagccctttgggaagtatgagccttcaaacttctgcttgaacatttctggcaatacacatctcattcctttacaaatcagccacaatcctagaactaagcagcttgaaaatgtctctagagccaaactctagatccccgtggcatctccccaagaggcagtcctttgagagttgggtctcagccttcacttcctccctagtcttcacttctaagcaaaagatctaaatgcagccatttatccagtatcctggtttttagactgtccatcagcctgaccctcttctccaggactctagtttactccccttaaacggactgtccagacctgaaggtagtagtatttgaatgacagctcttttgctcctagcttgtaaccttcgccaagtttcttaatccctctgaatgtctgcattctccataaagattgtaagtatctttatgagagggattaagaaactgctccaggtgccacctggccagaggaaaaggggaccgtggcttctctcactcatttgttcatgcatttcttcattcaacagacgttgactgagtgcctactatgtgccagacaccataccagagtcaagccacaagcagggagacagaggtgtcacttggtagatcttatgttcccaggacaaagacaacagtgtgaggaggtttccgagaactgcagaagccagtagcaggggggcctattctaggctgggttagaaaaggtgctttcctctttcatcttccccaagagatgctgtggaggcttcagcctgaagaatatggagatatccggtaggtgaggaggaggcatggagggcagggagcatcatgggtagaagggacagggagcattatggctagagggacagacttgtctggagggcatgagtaaggacagcttcagggaggatggaaggactagtgtggccagaatgcagtgggggagtcgagggaggcagggggcagatggagcgggctcacaggccagatccaaatgggggaacgtgtcctaagggcaatgggaagactgtgaaggtttttttttttttttttttttgacatggagtcttgctctgtcatccaggctggagtgcagtggcacaagcttggctcactgacatggccacctcccaggttcaagcgattctccagcctcagcctcttgagtagctgggattacaggcatgagccactgtgcccggcctctgtgaagggtttccaacacaatggtaaaatggtcacattcacattttaggaaaatctttctgcccacaggatggatactcaattagaagaaggctcacgcctgtaatcccaacactttgggaggcctaggtgggcagctcatgaggtcaagagatcaagaccatcctggccaacatggtgaaaccccgtctctactaaaatacaaaaattagctggacatgctggcgcacgcctgtagtcccagtactactcgggaggctgaggcaggagaatcgcttgaacctagggggcggaggttgcagtgagccactgcacttcagcctggtgacagagtgagactccatctcaaaaaaaaaaaagcaagaggagtagttgcagggaaactgggtaggaggtcatgccatcatcaagaaaagagaggtgaaggctgggggtaggatggtggctgtggacgtggaaagaagtagatggattcaagagaaatttcagcaatagcattgataggacttggtgactggttgattggcttggagcagagggtggcggggggaagtttccaggatgtctagtatgcccagcgtttctggttgaggagagtcatagccggtgttgctgttaacacaagctcggatccatttggctttttaaaaggtagccagtcttacttcttgcagttgaaaaaaaaccctcagtcctttatacatgtgctgctgggatccagccacatgtcccccagaaagaaagccctcgcctctgtctgcacccgcttcactcgccccctactccctcctgctcggcatatgtttcagctccccagtctctgagactcagactcttcacctgtagaatggaaataacaataagacccacccgtaggactgttgtagaataaaatttaattaatgtagtcaaatgccttaatagcctgccatgaggtagggtactcaggaaagatacctgcctctataggcggatcacttgaggtcaagagttcgagaccagcctggccaacatggtgaaaccctgtctctactaaaaatacaaaaattagccgggcatggtgacaggcacctgtaatcccagctgctagggaggctgaggcaggagaatcacctgaacctaggaggcggaggttgcagtgagccgatctgcaccactgcactccagcctgggcaacagagcaagactcaaaaaaaaaaaaaatgcctctattgttacccgtattaagggcacctgcagggctgccctgctctgacggacactcctaccctcccacggtgtgcgccccctcttctgcaacggcccatctccaaagggactgctgatgtttgaggtcaagatggcccctagcagaaagctgcagaccacttctgaggctggaagggtgtgccctgtttatagcttctagtcccatctgtggctgaaagaggaagatgctagtggcactcagcattaaggcttccgcgaggctgcgaggcaggggtagccctttgggaagtacgagctcaagcttctgctccgaggcaggctctggaatgggcctattggtgagaattgcaaatggaggtaacttctgtaattagacagtggtgatggtggcgctactttgtgaatatactaaaaaactgaattgtacgcttttaaagggtgacttttatggtgtgtcattatatcacaatgtaaataaatagcaagtggaagttgctgctatgggagtgctgtgttccaactgatgatcaacagaagccatggaacacggggaaagccttgggctccctggtggtttcctgcttggggatattcacagcccagtgctgttctgtcgtaattcactttagactattggggctccagctgtcctgagaacagggcagtaaaggaaagtcagtggcttctcatgtccagagcctttgcctgccctgctgagcctgccaaggaaaagctttgaggtgctggtggcccttgctccctgagcgctcccgggggagctcactcttcctctgcagtttggaggtctttgctaaccccagtcctctctagctgcccgctctctgctgtctccctgctccctcaatccagatgtcaaaacagattctgccatctgggtggggagggagctgttctgctgcctgggttttccttgggttatgagatggggtaaccacttggcctttggcactgcacttagtcctgtgaactactgacagagggaccagggcaccctcttgtggccctcagcggcactgcttcttcccgccctccagccttgaatttcttccagctggaattctagtgttgaactctggtggtggaggcagctgtcgttctccccaggagatgcctaacatatcagtaacaagaaagaaaataaatcagccacagaaactaggaggtaaaatgttagtgtttttgctctgcagctttattttcaaagaggcagtgtgctctcatggaagatgtgtggcctgtggagtccagcaagctccccagctgtgtgtgtgactttggcaggctgacctctgagcctcagactcttcacgtgtagaatggaaataataagacccacctgtaggattgttgtgggataaaatttaacgaatgcagttaaatacctcaatagcctgccacgcagtagggcactcaggaaatggcacctgcttctattgttatctgtattacaataaagactaggcaggaaccactgtctctcttcaggaagatcgcagcaaagggagtggcaccacaatatcgtagtctctgtgaagccctttccccagcagtgagcaatcctggctttctctggggctgatccagttgccagtctgggaaacctctgactcagggaagtggagagagatttagaaaaatatgagagagcaaaagaaaactttttttgttttttttttgacagggtctctctctgtctcacgggctggagtgcagtggtgtgatctccgctcactgcaacctccgcctcccaggttcaagcgcttctcctgcttcagcctcctgagtagctgggactacaggtgcccaccatgcccagctaatttttctatttttagtagaagtggggtttcaccatgttggccaggctggtctcgaactcctgacctcaaatgattcacccatctcggcctcccaaagtgctgggattacaggcatgagccaccgcgcctggccaaaaacaactgaaaaaagaaaaaaagaaagataaagccagaaggacctgatcagaaacagattgggggcccgccccaccccatctgatagcttggcgcctgcctggcatgtgatggagcccagcaaacgctcgtttccttctcttcttgtcctggctcagatgaggtgctgagcagaggatgaacatagccttggtcggatccctttatgagtcagacggttttcttcctgtgaggtgggtcctcagtgggagggactagagacaggaaaaccgttgggtgggcaacctgtgaacatggatgcaaggaggagcagggcggcagcacaagatgagtgtgggttttgaccctcacaagtgcagattccccaatagctctttgccctctccccttgtctgccatctgtgccccagggtggcggtgtctgtcgctgttctggccctttggtagcttattaaatctcagtaccacttgccaagaccctttaaaccccttagctgttctttttgccttttctgatcagctgtatttattctgaactaaatggtcctcacggcagaatgaaaggatttactgcttaagtatatgaaaagaaaccttggctgcattacagttgcaccctctcctcgccaccccctgcccatgctccatccgctagctggtgccactgagactgaaccgggagcccgctctgggtacagtgtggtcagttcagtttggtggcagagtccaattgatggagcagtgaggtgactgggaggagcttgcttttgggagccctctcctaaatgtcctgctgccccaggggagactggcggcccaggaacagctctctctctccctctcccccgcacttttcccttcctccctctccctctctccctcccctccttaaacctctcccccattctctctctcagattctctctttccccttcaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagctcacgcacagagacatcaaatggagtgccgggtttacaaattgctgactgtgttcataaacaaacttgcttaaaacaggctcttccagtaaatagaaggctgtccttagatcctagaggtggccttcctgccaactggtgtccccagccagccctggcctcatttgggcgccacattctgtttacttgatggcagcccaagggctgtacagttaggggctggagcctggggtctcgccacctgctcttagcagcaccagtcatttcccatttctctgaagctcttgggccctagagaaggagcagccatgtctgggagaacatttttccctcactgtctccccagccctcttctcacagcacccccagagggatgggacagccaccacattgggctgggagcattactgacactgcccagcggtgtgtgtagagacgagatgggccataagtcagcagttctaacaatggctcaactacgaaatttgaaaaccatttcaaatgactgactcatcagcagctttcaggctttctctgttcctcgctggtattccaacacgctttcttgaggtagagaggcaggtggccacacaccatggggcttaccagtgggagcatactcatgttcactcctccaaaaaatatttatggccttaatatgtgccaagcacagtgctaggcaggagaggccaacaaggcatgaccccgcctttgtgcattccagcaaggagacagattagacaattaatgacacagaaagctcctcactggctaagtgccagaaaaaaaaaagcctatggtgctatgaaagtgtgcaatggcaggtctcacctggtccaggaacaactgagccaaggatgggacatttgagcaaaaacacagattagtgtcatctctcatcaatgtgttgtcaaacaaggttgagaacttctgctctcaggacaccatgccctgagcactgaggctggtgtggaactgggctgacagagaagggaagacatagtgaacagacaaaacatgtcctccctgcctgagccgtccacacccacacccccacccccacggttccagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacaggtgaggaacgggcatgcagcccccagccccccagccccagggggtcggactgctggctgcggaacagagctccgcaggatgttctgcgcggcccaggcattctagggcccttgctggtcataatgtaacagtgccatttgcccccaaaccagttgttgactgaaaggctctcaattagctcacttcaaaaggactgctttcactcaggcaagaccactgtagttgaccaatttactgggtgacagactggccttaacattttagagagaaggaaagagtactccttgtataaaacttttctacacaaagagaggggtaagctgtcctgtgtggcacaagtacccttagggactgagcaacaggtttggtttcccgtagccatttcccacccccactccccaccccggtgaaagcaccagttagtgaacatgccagcccctcctgaccatagtgaaggcctgatcccccagggccttggggctcccaaggcaggtccctggcttggctgtgggtatcctcatgaacctgaaagtatggatgcagaggtggccctgaggctggctaggctctgaatgtggcatctctccttcttagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcacaggtgtgtctgcggagaccttttttccaagctgaaaaaaaaaatctgattaatctgaaagggagaaaaacaaaagtaggggaagtctgcagtggcccagtttttcctgcctgctgttttttttcactgagccttctccacccaccccactgttcctcctcccacagccactgctctcctaagagaagagccagtaagcctccattctactacagtttaaggttttttgttttttgttttattttgggacagagtctcgctctgttgcccaggctggagtgctgtgtacaatctcagctcactgcagcctcgacctcccgggctcaagtgatgctctcacctcagcctccctagtagctgggactacaggcatgcgccaccatcctggaaaatttttgtgttttttgtacagactgggtttcaccatgttgcccaggctggtttcaaactcctgggctcaagggatcccctcaccttgctctcccaaagtactgggattacagttgtgagccactacgcccagcaaggagttcttttttgtgtctcgagagatcctcctgctgtgcttgggatcccaggtgcctgagtctcaaggaaaagacacacagcatcccccttccttttgccagttgagggaatgggattaagggaaggaaagttaacattcactaaatgccaaccacagcaggctaagtactgtgctggatgctttatattttttatcttacacaatatacagttagccagggatgctctgggatacacaagcacaaaccccagcaggctgaactgcatgccacccacagcctggttattctgagtcagtgcttggggcatgcacaggtctggggagccctcaactgaagttggtagccaaggttacccactggactaagactagaaaggaggcaattgacaggccaggcgtggtgcctcacgcctgtaatcccagcactttgggaggctgaggcaggtggatcacctaaggtcaggagttcaagaccagcctgaccaacatggtgaaaccccatcactactgaaaatacaaaaattagctgggtatagtggcccgcacctgtaatcccagctactcgggaggctgaggcatgagaatcggttgagcccagaaggcggaggttgcggtgagccgagatcacgccattgcacgccagcctgtgcgacagagcaagacagtctcaaaaaagaaaaaaaaaacaaaaacaggcgagagtcaggaatcaagagtaagggggaggcgggtgggatctgccctggtgttctttcatactcctcgttatgaccactctttcttcccaccagtagcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagcctggccaacatggagaaaccccgtctctactgaaaatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactccagcctgggtgacaaagcaaaactctgtctcaaaaaaaaaaaaaaaaaaaaagtcactctcattcaaccacttttactgcacactaacattgggtggttggatggaatgggagacagaaagaagcatgtggtctcaggcctcacctgcatctccagcgtatgaaatagaaatccggagatacactggttgacgcgtcacggaggtcagccctgttcccttagtccccagggcaccccacaaatgagagggttctatgagatgtactttgaaaaccactaacttagggcaagaggggccaggaggcatcatctgaaaaagatttggaaaaaggggaaatctgcctgtgccgggttaattctggccctgacccagccttctcctcttgcccctgggatcctccttggagaagcagaggcagcattttttttttaaccatctgtctccaaagtggggtcatcctgatttagggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaactggtgagtctaaagctcctaggctgaggggagaagggagagggggagtttgggttttcggtgcttttctggtaggactaggaggtaggccagtggcccactcagacctggggacctgcctcagacaacgagcagaggggcctagcttcgcacaagagcaaccttccagaggaaaagtgctcacagctggaacggccttcaggaaacaggttcagagggttcaaggccaggttcccataactttaaagaccgtggccataaagggttaatactgcacagccttccagccagggtttcagtcaacatttgccaagcacctgcttggggttagaacagtgggatgcagctgtgaaagacagacagacacagcctggggcagacacatcccagccaagactggaggcaggtaaggacgagtgtcttcaacttctttggattgagggctgaaggggcggggtcccccagaaagcaaaacccacccagaagcccaagcagaacaggactgcctcctctgaaggtggatgtcaccactactaggcatacacatttccttgggctcatccctacccagaacggatcattacaggaactgcctcccaaacccctgcagagctgaggccaagactaggcattccagccccgaagctgctccaggatgcagtggctcattgcctgtaatcccagcactttgggaggccaaggtgggccaactgcttgagcccaggagttcaggaccaccctgggaaacatagtaggaccctatctctacaaaataaccttagccaggcatggtagcttgcacctgtagtcccagctacttgggagacccgaggtagatcacttgaacccaggaggttgaggctgcagtgagccatgatcgtgccactgcactcccgtctgagtgactgacagaatgagaccatcttaaaaaaaaaaaaaaaaaaaagctcaggctgcgtgatgagctctgtaggcccacaatgatgcacagcccataagagacatggttctcaaatcctggtgtcctcagaatcacaggaaagcctactgacgatgcaaattaccaagctccagagagtctaactctatcaacttgggatggagtccagaaattccagatgatcccaaagctgaatgagtcccaaacctacactctgcaaatccctggcttacagccccctggctccctctgcccatcctttctaatcatccacttcccagaccagtggtctgtaactaccgtgaggactcctaaggtggcacagagatgtttcagaagcccccaagagaaaggggtggccaagctaaggatttacacacaaacacacaccttttcttccctaaatttaaagggtcccattaacgtctaagagtatgtgtgtgtatgtatatatatgtaattttttcttttttgagacagggtctcactttatcacccaagctggggtgcagtggcgcgatctagtctcactgcaacctctgcctcccgggttcaagtgacttctgcttcagcctcctgagtagctaggattacaggcatgcaccacaccgcccccaccccgctaattttgtatttttagtagaaatggggtctcaccatgttggccaggctggtttcaaactcctagcctcaagtgatccacccgcctcagcctcccaaagtgctgggatgacagccatgagccactgtacccggcgttaaatatttcttaaactccactgaaacccatccccagtcaagcctactgccgtgacaaggggcaggactgctgaggttgctcgctcgccctcagccagcgagttaaagggccaactaatgccagctctttcctctgcgtgccacagggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaa

SEQ ID NO: 812 - DNA, 225549 bp, Homo sapiens; identical to SEQ ID NO: 810

SEQ ID NO: 813 - DNA, 225549 bp, Homo sapiens; identical to SEQ ID NO: 810
